United States Patent 6,812,339 (POLYMORPHISMS IN KNOWN GENES ASSOCIATED WITH HUMAN DISEASE, METHODS OF DETECTION AND USES THEREOF) - sequence listing, part 27

SEQ ID NO: 12968 - DNA, 222452 bp, Human
tttctctccgccgaagccgaccgtctggggggcgagtggggggagagccagggcagtgcggggcccggcgggggcagcaggcgcagttccctgcgggggtgggacgtccccgacgcttccttcgctgcggagcccggggctagactcgagcgggagggggttggggggatgcaggacaggcgggttgggcggccggcggcggctccccggctacctgtgtggccctcgacctggctcagacccccgggcagtccctgggggctctttcctcggcttttaaggaaagttctgaatgtagtgagtgccagaagctctgctctcgccgcggtccgctccacccgctcatcgtgggggtcgcgccgtttgtttaattcctggcaaaaggcgagcgggccagcggttgcgaggcaggtaattccgaggtgccccgggaattccggacatgcggccgtcgtggtgaaagtcctgccgaggccgcggcggccctggaggagggaggccccctaggtcccagatagctgctgaatggggagggaaagttagggtaccctactctggcgctttgttgtgcagagggctccgggggcgtccggctgcagactggaccgggcctttagccggagggggaatggggcagccacctctgctacctacagcggggaggtcctgggaatgggaaaaggttcgcgagtccgggccccgaggacagagaccttctctctcacccctggaggcgcaggatttaaccccccccaccccccaccctttgaaagggaggttgagttttgctcaggtcgaaatcagtttaaaacttaaggacgaggcgcgattatgctatccccttcctgaagttattctttaaggagacgacaagcgaaattgtggcgaacacccctttctcccacccttgggatcccgtgggggacggtgtctcccctcccccaggaccgctcgctcgcccacccccgataagccccaaccctccccgaccagatggctggtcttcccaaggtttccaccagggaggtcctcccagccggagagagaattccgtttccaaccgagactcctttaccccaaaaagaccatttgtgtatgcgagtcgtttttaaatgtctcctcgtagaaaaactgaaagtagaaagaaaggaagcaatttctgagcagatgtctgaccaccccttctcgcacactcccagcatcgggttacagggtcctgggagcccccacccacattctgcggccccacacggatggacccacagtccttccgctccagcttgtgcgcgacccctgaacgccctccggcacccctggaccccgtctccctgcacgtccgggcctcaggaggcggggagggtagcggcgcaacacaatgatatagggataaatattaagccgtgacattgacgtgcccggcgcctcccctcccccgcgctcccggcacactctgggctgctcggcacgccccctcccgttccactgcgtcccgcgccgctcgctcatccccgaggggcccctgcaacctctccgcgcgaagacggcttcagccctgcagggaaagaaaagtaacttcgcttttctcggaggaaccaggaaggattaagcggcttgggagagggcaggagcgcgcggagggtagcgatggaggcttcgtaaaggaggaggaggggagtctggaggaaccccgaggaaggcttctgggctgtctgattgcactttcttcttatcctcccgtctcctcctttaggtgcaatgattctggactgagacgcgcttgggcagaggctatgtaatcgtgtctgtgttgaggacttcgcttcgaggagggaagaggagggatcggctcgctcctccggcggcggcggcggcggcgactctgcaggcggagtttcgcggcggcggcaccagggttacgccagccccgcggggaggtctctccatccagcttctgcagcggcgaaagccccagcgcccgagcgcctgagccggcggggagcaagtaaagctagaccgatctccggggagccccggagtaggcgagcggcggccgccagctagttgagcgcaccccccgcccgccccagcggcgccgcggcgggcggcgtccaggcggcatggagaaggacggcctgtgccgcgctgaccagcagtacgaatgcgtggcggagatcggggagggcgcctatgggaaggtgttcaaggcccgcgacttgaagaacggaggccgtttcgtggcgttgaagcgcgtgcgggtgcagaccggcgaggagggcatgccgctctccaccatccgcgaggtggcggtgctgaggcacctggagaccttcgagcaccccaacgtggtcaggtgagccagggagctgcgccctcgccatctggggcctcgcgcgcgcggggagggccgagccgggaatcctcaggcccagaaaggtgcggggcagagggcgactggggaggtcctgcgcgacctgttggtcttacagagtgagagttaagttttgtcgacagagccgcgagccagagccggtgaccttgccagacagcgagccgaaagacaagtcaaaaaaacatgacctgagcaggcttccctgcagctgtgcaacttagaagcgttttctccctgcccaccctgaaggagggtctgggggaagtgggtgcgttttagggacaggataagccaacctgagacatgccccgctagcccccgcatatttttcgtggccatgccgttggggaatttttgaaagacagagtaggtgagactggagaatgaggatgccgtgtgataatcagtgggaactttatgggtggagccaagtgtaaatcaggttaacaagatgcagaaacatcataatatttttgccagtcatactctcagtttctctttattaaagttgcgtagtaagaatgactcctggtggtctaaggagtttgagtgctgatgcccaatctcaaacagcgtcataaaaatttcttccaaaactgttatccctgtgtctgttttactttatatctctgggcggacatactctttagactaattctccaaagggttaaatgtgagtccaagatgtggtatggttagatcataaatgttctgcccatgcttttcccagatggattgtgcgagtgggtggggagacagcagttcttactctctcctgtgtggtaaccagtattaaatgaaaatgtgtgacttaggataatggtgttttcttagtgatcctggaatttccccattgtgtggttgacattgtttggttgtgtcatccttttcttttttaaacagagatgcatagctttacattgaaaaggaatgcctagaaacttctgcaaattgggttgtgattttacctttctcgatcttgagaaaatgtgtagcagaaatatcttttttctcatccatttagggcttctgttcaacaaatacatgcctactgtgtgcgctgaggatgaaatgatgtaaataagcacagctaaatatttttgtaaaaagtcaaacaatttaacattagtcatcaaagtggagagacccaagactgacctttgaaataccaaactctctacagactcagagagaccaaatatctacagaatcttcttgggaggttttaacttgtctcctcttatcccaggctggtgatttgtgcggtgctttgttcccaacgcagtttagactcaagctagaaggcatcaaagaatcataaatatataaataaggcagtaaatggttataaagttaagaccgcattatacctcggcctagctagtgaaggagaatgagtgttttagaagatgagattatatataaaaacctatagatgactttttttcatgtgtattttatttgttaaaaacaacaaaatccgtttttggggctctttgtgatattggagggaaaaggggagggtatatttagccccctgtaactcagctgtcgtcctaggggaatcacctaatacatcccgaaggatgaattccaccactacaattttaagacggaagttcttgttttattttgtctgttacctatggagtatccagttaagggtgcttatcatgtatatgaatgaatagtgtccttccaaacgtagaggtactacagaggcacccctgtataacactattgtttacaaagcttacgccattcttataccagaggcacactttctgccattgtgcttgtagattttgtctgatccatcctattctcttgatttatcctcctgagattgatgtgtttctagacgtttctaactgacccatgacttggattctgtactgtgaatttcaggaggatattcttatgaactgaagacaaaggcattgttttctaaaattatttttacgtgttaaggtgatgatggcacctacctgttaaagtcgtgagaataaaatgagatggcgtatgtgaaagcactttgtaaatttgaaagtacttcagatatctaaaggattgtttgcgtttcagcagattgatggtctcttgccatggagcagcttcacagggaggggtcaattcacctgaccttttttgtagaacaaatcatattcaaacccagacattacaggctctggaaccaagaagatccttgaggataattagcctgtaagatgtcagaaaagactctcagtcacgagccatgaaattcagtgatacttgaggaaattattgatgatgtcaccctcatgagctacagatcttcattccctttttgtttccttcctgtttcttctcttctgcctctgccttgaaacaaccattggtccccatgacttgcttggccagactaagaattctggattttagaggctgcgaatatttgctcagacagggtcaggaaataaggacagttgacagcaattcttttctttccaagggagagttgtcaaagttgggtccccaaacctgtgatttactattgcccctgggattagttttacagtcttaagcctggttctttaatggtttcttaaaagggcagatgcttttataagtaccttcaagtcataagtaattgatcataattataggccctcccccacagatagttaagcctctaagctaacaggagcataataaacatattagttttttcaaaagtttaagatttaattttgatggatttgccagaaaagctgacttgttattgctggcactggtactgcctgcatgcacagggataatgacttgaaattcttgcttacctgcatttgatgtatcccaggccctcgcctgatcagccagtgagtgtctgggaagtaaatttactctttttttacatttggtaatcccaaatcctggaacctttgccagaataggacttcactgtgaacctgtattggagtttctgcactgcacaaatggatcctgtttgaacagcctgaactaaaaacaatagagataaaattatagcatgttttgtcagcagtctgttcattcaccaaatatttactgagggtccactatgtgccagactcttctagaaggtggggatatagcaatgaacaagcctggaaaagtctccgcacttgtagaacttgccttgtaatgagatgagcagttctttcttctctttaaaaatttactcatctttgttttaattgccttgttttgttatacttaacctaaccagttttatagaacaactgatatttctgataattcggttaccaggaatttcctgattgagtaggcaacataaccaaaaggctaatcagaatcaagtgctttttgaagattaaattttacctccctaacatagggattgatctatatgagatactgacacatagctaatataagtgaacatttgagctccatttattcaaaaaggatttaggaagggcatatgctttaaaaaccatggggctaggtgctgggaaagataccagggtaaatcatacctagctactctcctgaagcagttcttcccatgtttgaaggaataagatgatcaccataaccctgatacatgataggatcatgtgctgtaagaaagatacaagccagtgcttacctgtattgtttctagggattatatttattagtgtaacagtaaaagcaattcaaattcaagtattggctctggaaactaaaagtcattacatatcagtgaataaacttgtgatgtttaaatattataattagaatagtcactgctttaaaaacaaaacaaaaaacccaaagaaaaggctgtaaagcttaatgattattcaaggagagttttctaattttctctcttttttaaagatcttagtaatatattgcataaaaggtgagtaaaaatgtgattttctctggaaaacctaattgttaacagggtaaaagaaacatgacatatttgactctgtaaagccaggtcttcaattggattagttcatgagaatccttctgaataaaattgctatttgtgtggttgaataatacatttactagggcttttttcaataaaagcaggaaaagcaggagtttaattctccttttaaatatcagtatgttaaaagtatgtttgttctttctgtctctgagagttccttgaaaagtttctgatttttcaaggttgtttagtaaataaacattttcacaatggtattctgctcattttttgttcctacagaagaacttgataatgctgaatttttgacattgcagttatatcccttttatacaaccactatcaacatagaattattagaatctctctatggaatcaaggacaaaaaaggtctataagaggaaaacttgtataaacttgaatatctttgaggatattttcctatgtttaagacatgggtaaatgaatatctatgcaaataggttcctattaaaaataaattatttcttttttaaaaaaacaaatgtctcactattaatgatttcttaggaaagttttttaagaaggaaacacagcatacatgcagcctatcattgtaaaaccatggatattagggttggaagacactctggaggtcaagctacttgtctgtcatgccattttaaagttattgacttgttcttaaaactaagtagcaatttttgtttgtttgtttgatggaagcagttaaatcgggtgagtacatttctagtttggaaaaaatgaactgtatgtagacaaaagtgacagtttgccaggaatgaatgacataacgataaatgaataaaaattcagtaaattcctgaattctgcagtatgccatactgaagtatatctctacaagagtattattccagtaaattcttcttttaaggaagttgtgctataattatgataatttaaattaattataataatttaaaatagctatagttaaatgatgatacaggtaaattatgcaggtaattcattaataatattgaattcattttagacaaagaggagtaggaaaaattgaaacacttagtacttgtctgatgaatgaaatattacataatgtggctctggcacattatgtaacattctggttaatgaaataaaaacatcataatacttaaaaattagatggcataataaccatcagacacataagcaaatatgtgttttccatgccttctgaggaactaatcacactattgttctttctcatgaggttcagatgagttgctctgtcttcataggaagtaaattaattgtgagcttcttgatgtaacagaacacagcagagatgaaatctgggtgtcagtgaattgttaacaggagaagttagtgtgtatgatgttgggctttgtccaagatccaggaggcagcactgaaaacgcaccggtggttgataacaagcatacttacatgaaggtcactatttgagtgatgatccatagatgctaggtttggtggagcaggcaggccagcaatcagagagatttttccaagagctgctgggtagttttcttgaatatcaccagtttgctgccatacctgatttttattttaccagctgcacatgtagctgctcttgcctgagaggtgaaccggagggactgcaaggcatgtggcaggaatctatgcaagtgtacagttgtagtctggaagtccatttgagtcaggattattattaaacatttttgaccatctcctttgtctatagtagtttgccgaaatttggatatctactggctttgtaatttaagtagccacttaaattattcctattctctggccttcctaaaggatttagttcagtagaattagaatcacagcataaggatttttttaattggaagaagtcttagatttaacctagtgcaaccccctttgatctgttttataataataaaatttgagttgttttatgaatgcaaaaaattatctcactgttagtgaacagttttattctgtgattgtatgcattgtagatataaactgattgaggatggctaagattcagacagaggtttatattaaacattggtaagacaggatgactgatggtcattggatataccagaaaaaaatcccttgagatgtaaaagtattttcagtttagtgactttatgtttgctgacttgagaaccaggattgtgtattttatatccataaataacatggtgtccataaccattggttaacccgtatatgtttcctgattgattgaaattttaaaccccttagataagcacttttcatcgttttagagttgtatactgcattagcaagtatcttggactattgacattgggagatctgtgggtattaactgtaaggcatacacatgtgaagtctatttagtaagagtcttcaaatacttactcatatttaaacttttcctgactatgcattttttatcttcaatattgtacttgctttggctttgacaggatattctcatgttcttcctctgtatttgttaacatgtatcctacagacagatggactactccatttgccctaatggatttcttgccatccacctctattactttaatttgaacagatctctgaatgtgcacttggtacctctcctgcaccactctccacctgttgaaattctgcttatccttcagggccaacctcaaatgtcactttctttgttctgtattccttaatacctcgatttggataacatttctgcttcctttgagtcctggtaactttggacctcctttatggcacttagcttgtatctgtccccttatattatttctgttatgtaagatggaatgttaactcccatgacagccctcttctgactctctactctttcacaccctatttgtaagctctttaaggcagagagtgtcttgtgattacattcgtttatatcctgtatccattggatataaggtgaatacgtaacaagtgagtgaaatcattgaaaaggggtccagttataaaggaagacaccatatgaattatttctatcatgtgaaataatgttaatactaaggagtgtcaaggagggagaacggatctgcatattggattacacttattgggattcctgggaaataatttaggaaatactgaaaaaaggaagtttcatttttgtcttactccaatctacatagtttatatgaaagtttaagtataattcattcttatagttaactgtgcaactttggacttaatttatatactgcaaagaagacattaacattaggaaatgagcatacattcagcaaaagctgaaaatgatttgaacatttcaaatgtaagaaagtaaggtattataaatacattttgatcaattgcttgagttcttttatttttcccattaattttaatttctttggctttcaatagtggaaaacctgttagcagaattaggtaaaaccttcctaataatttctataaaagatgatgattctgaatttcatttgagccttgtcttctactcctcttcataatttgtgtacagagaatttggattccatcttgacaaactggtaggtttaattaagaagtatacttccagtttgaattcattccagtttcttaagacacatatggttggggtgtgtgtgtgtgtgtgtgtgtgtgcacgcatgtgcatgcagaacagtggagtacaagattcttgaaagaagggactgtgttgtcttgttccttgcagtatcccaagcatttagcatgatgtctggtgtcttgtaaccctgaataagtatttctaaatgacagaatatgcgccatttagaaattcagaatttaattttttttagttagaaatgagtaatcatgtctgaaaatacaggtgaggtctctggcattcagcaagtatttatgagtatctgttatattcaacgctttgttaaatgggattaaggcagtagtcacaaaaagtgcatattgaaatgtttacccaaaaaatggtatgtggtctgcaatttgtttcacaatggggtagagatgcaataagaatgaactatgagttgatcactgttgaaactgtggagttttattgtactagtctctctgcatttatatatgtttgaaattttccataataagtttttcaaatgttcctgcttgtgggctaggagtcagaaaactgattcttatcctgattcctctgcttattatttaatagttgagtaacctagggtaaattcctcatgtctcttggctgccatatccccacaataaaaatagaaattactactgctctttagaccttagtggtttactctgatcaaatgaaattatgtatacaaagatccaatattatacaaatataaggtattattaacaaaatgaattcctgctttcaagtagtttataatttcctggaagaaactgacatgtacacagatatctgtattactgattggtagcactttcattccacctcacgttgtgaaagtatgaatggagctaggtacttctgaaaagatgtgtattgagtttatagtaattaaagtaaaaaataatctttcatttgggtattggatattggtgtcgtgtttacccagtggtctttcctgtttattaatgggtttattgtgagagtatctgtggaccaaatgctgctgagaacacattgtcaaaactgatgggagcttgatgatttcttctgtatttgactattcaaattaacccaaagaggagttggattctttgcttgttctttctttcttttattttttaatttcaaaatctcaaagagaattattcatttttgtcatactttggaatttctgcttgtttattttctgaggctgttcctatggcgtgactgacttatgacatttaaaattttgttctgtgtcctctgtttaaatcgttaagagttctattcacagcaatgaagcagttcttttttaggggcactaatctttagtgaatttgctttttttttttcctttgcttccttttattgcaaagtaatctcataatttctgtggtaggtgttcctaatgattaaaaaaaaacattcatttatcctaaaatacttttatttttagaaggttcaaagtataatgttaggaacattaactctcacacctttccagcagcagagcaagaaaaacaaaagaaggccaggcacagtggctcacacctgtaattctagcactttggaaggctaggatgggaagattgcttgagcctagaagttagagaccagactgggcaacatagggagaccctgtctctacaaataataaaaactttttctgaaaaaagacatctttgcatttcaagggtagacttttaaactttagtttaaaagtttagtttactcagaccagtacattttaaaactttttagaagaacccaagagactgtctgagtcgtttcaagttgggagttttagctgatatagtatacatttcaaccatgtagaatcactttaaaaagttattaaataatcttgggttaaaatgggatattttcttgttgaaccttgagaaaccaagagacaggtttggagattggggctagaagggactcccagtgctgatcatgaatgaaatacattcaaattatgtaagttcccttgacctgggagaacatagcttctttgaaatgactttttttttttttttttttttttttttacatattaagactcaaaagaagagtggtaacattctgctaattcttacaaattattttaagcccatgaaacttaatcagtggctatttaacttctagctgattagatgagaactgatgccacttggttctcagctaaagttttgtgaagggaagaagtctgtttcacagacattactactcaagtattgactgactcaaagtgatggaactgatttcaaggagagctgtatgaatgtgactgactcggtggtaccaatccaatcctagaaaaactagacttttgagatgagtcaagagaaacatctttgtttaggaaagatggtataggtttggtttttttttttttcactttagttgataaaagtaagaggtgaatccatcattaggcaaatagaaaatggtctggagttgtatttatgtatctgaaaggacaacatgctcattaaaagaagggaagacggtggtagaagataagctaagttaaggtagcaatgagagagaaaatagaaaaaacagtaagagaacttgggatagtgagtagatctgaagtttcttgataaacttcaaactctgaaacctggtgatctgaaagtagatgaaaattctgccatatttagaaaaccctcaaaccagtgcttatggaacgagtaaactcagattatcattcttacaattctgcaaaaataaaatggcattgctgtctgctttttcttgggcaccttattttaatcatttttgcattgccccgtgtgcctagcactcaattacctgttgaatagttgtatgaattaatgttgaatgtcagcttcccattagaatataggctccctgagggcaaaaatttttgttttgctcacgcattatctccagcatccagaacagttcctagtaaatatcaattgagtaaatgactgagtgaataaatagttaagccatgactcaagattactgttttcacagcaactttattgacagtaaaaatgtaaattaacactacaatttattagatattttatttttctattcactcagtattgcatttaaaactcttcaaaattatgtagtctctaataggtagtaaattggattctgacctgggaattaggagttatttaataatgtaatgattggcaagtagattggacaatgagatataccctttctaagctaattcatccactactgttttcattaaattacgaacataattttatgccaataatattgatattttagtgatattttaaatcatcatatcagtttttgcagattgaatttacatgttttgatggaagtttgtgaacatggtttaagattctctgggctgtgactgctcatttttgttttactgtaaaattagttatattaaaatatgacttctaaagagtcatattttatatttccctaaagagccttatattaatggccatagctgtccttacaagtagggatgtccatgtaatatgtatgtcatattaaaatattgacatgcattcccctaaagagccttgtataaatggctatcactgcctttataagcagtgaagcccaagtggccagtcccattatgaaccttgtcccattacttctgtttggggctaccattccaagcaccttcctcctctgcttagaacagctgattgtgatcacgtaatgggttgtgacatcactgataatactaatatattattacatagcaataaactaattatatatataacataatttatacaatatatatagtaatgaaagaattaaggaaaagaaagggaaagaaggaatgaagagagggagtgagtaatagaatagaaaagaaaaaaaattgtggtgttcccagtcagttgtcagatatgtttcaaggaagttgttaataaagtagagtaccaaagtttgcaggtgaggagagttatttgcagttttttgtttaaaataattacatttttctattaaagcaatttttctggttaatattgcttgtagtaaattactccaacatgtaggggcttaaaacaaccattatcttatattcatgaatttagcaggtggggaattcagacagagcacagtgagaatggcatatctctgttccaagatgtctgggacattagctggaaattactcaaaaactggtagtttgattattctaggcgtcttcactttcaagcctggtggttcatgcaagttggttggcgaaggctgggatctgaactcaggtttttgagcagagcacctacactgacctacaccaggtggcctgggcttccctttcagcatcaaagcttcagaatagttgaatgtacatgttggctcatggctttaaaagttggtgtccctgagaacaagcagtgttaattatgccacgttttgttgtttatatttgagttcaaagccccagagattcaagaggtagagacatacaccacctcttaatggaaggaatgttaaagaatttccacccccccacccccagcttttttgtaatcatgacattaatactaatactaaatagtatgaaagggcttatgataaaaaggcaaagctcctgccccagttctcagatacagctattcctattcccagtactcagatacagcttcttttcactgtctgtttttggtgcttctgtttatggtctccataaatttagataatatgctgttgctctagttcttgatatttaaacttcagtaatatctattgactttctactctgaaaaatgaggacttaccttgttaatattactgtgtatttccttcgctttctgtgagatagggatatttttatttcatataataattttaaataatatccctaaacttcaatttttcatactttcactttgggcagtatctcttgattctccatttagtaagaggagaatattttatccccgtaacctttcttccacttatgttctccctttaacatcacaatttctatcagctactttgctaaaattgtttatttgcattctgttccgtactgcaacagaggcttccctgcttttctaaaggttgacccttgcaagttgaacactggtaaacagtgcttacattcttctgactatatagagagagttcagtgctaggccaaatattcagcccttatgtttccttctctccaggttcaacattataaccctatgaagctgatggagtccttcttttgtaaaaacagacatctggattctctttccttattctgcatcacttgtttaaaatatgccctattttcgtgtactttttattcaggccatgactttcttgtatcattttgtttttcctggagtttctaattgcctttttattttttcttgccatgtttgcctttatcacaatctgtgttctccagaaatactatgtgtctacatatggtgggtttcccgccaccatttaatttgctgggcattctgtggaatctttctaagtgcagatttgcttcgttttattttttttaatggctgcttcttcatcatttgttctattctctttacaaggttcttctgttagtcagatatttgatcttgcagttgggatctctgtgtctcttcttttaatcttttttctaattcatctcttttctctggtttttgctttgtattctaaagaaacttctatattattttccaaatgtctactgaatttactctcagtaattaatatttttaacttcaaaacatcattttttgttctccacttgttggtttttaaagcatcctcctctggttttctgtaatatttctttgaattactgtgaatttttttaaagtcctccacattatctctgtttctgtcagtgtttagtttttttggttaacttttttgtttttcctgtggctgaattttttaaatgcctggtgatctttgaatatcctttggcttttttaaagtcaaaacgagctaaaggtataatttttatacagtaaaatacacccattttaagtgtgtgctttttatgagtttcgacaaatttattcacctactaaccaccaccacaatcaatatctaaaatactcgcattatcccacagggccctttgcagtgaatctcctccctctaccaggacccctgccaacctaatcttctttctgtcattatagatttgtcctttctagagtttcatatacacagtatcaaagagtattatgttctattatatctggctttcattgatagtgtttttgagattcatttatgttgttgactgtttgagtagttcattttccattatatggatttaccacaatttgtttattcattcacctgctgatgatcatttctgttgtttccagtttagggctgttataaataaggctgttgtgaatatttgtgtacaggtctttgtattgatatgacatatgcttcatttgtatggtaaatacctacaggtagattgctgactggtatggcaattgtgtatttaatttttaagaaattgtcaaacttctccaaactggttgttccatttccagtgctagtgtataaaggttccatttgatttgcaccctcctgaacacttgggactgtcaatctttttatttttagtcattctatagtgagtgtgaactaataacacattgtgattttaatttgcatttacttgatgactaatgttgttgaatatcttttcatttggctattgaccattctgataccttctgttgggaagtttctgttcaaattgaccgttttttaaaattgagttatcttattgtattgtaagagttcttgagcagtcttttgtcagctacatggattacaaatattttcttcaggtctttggcttaccttttcatttccttaatgctttatgtcaaacagaatattttaatttaacctaagtccaattcatctttttttttctttgatagcttatgcttttttgtatcctatctaataaatatttgtttacctccagggcatataggatttttcctatgttttcttctagaattttatagtttttgcttttattttagatttgtgatgcattcaagtcaagtctttgtgtttggcttgagctaagagttcaggttcatttttcctgtatggatatccagctatttccgcaccatttattgaaaatactttgctttcttcattttgaattaccttggcagctttgctaaacattagttgagcatatacatttgggcctgtttttagactctttgttcttttgcattgatctatatatctatccttttgccaatgtcatactttgattactataatgtataggtcttaatcaggtagtatacattttccagctttgttcttgtttttcaaaattgttgttgctcttcttttgtattttcatataaattttagagtcagcttgttagttaacacaaaaattctcctattgggatagcatttaatctctattaattagggcgaaggcatagatattgacactgacttctgatcacgaacatggtgtatctcttcatttatttaggtctttaatttctctcatcagagttttgtagcttttagtgtaatgcccttgcttgcattttattaaatttatctctttgcatttaatgtttttggatgttattgtaaaaggcattgttttttctttttaagtgtttgtcattgagagctatagtcttttttgtatagtgaccttgtgtcttgtgatctgaaaaactcccttattagtctggtagcttctttgtaaattttagtttttttacatacacagacacatcatctgagaatagacagttgtactttcccccctatatatatatatgtcttttatttcttttcctttctttttttgccctggctagaacctctagaaaaatgtcaaataaaagtggtgagagcagatgtttttggcttgttcccaataataaggagaaaactattcagacttttgccctaaagtatgatgttagctgtaagttttcctaggtgtcctttatcagattgatgaagttcccttatattcctagtttgcttagagagtttttcatgattgggtactgaattttgtcagtgttttttctgaagaattgaattgattatttttttaaaaactctgttattgtgctgtgaattatactgattgaattttgaaagttaaaccaagctcacattcctgggataaaccctacttggtcatgatgtagcctttttatatattgctaaaattttgttaagaatattcatgaatgatattggcctataattttttttataataactctgatttttgttctgaggtaatgctggcttcataaaacgagttgagaagtgtttcttcctcttctattttctgaaagattttgtgtaggattggcattctttctttcttaaacatttaacagaatttactaatgaagtcatctgggcctagcatttatttttgagtaggttattaactacaaattatattttcttaatagatatgagaccttataggttagatcaccttttataattttgtatttttcaagggatttgtctatcctagggtttttttgggggggtggtagtttattggtatagattctttaactccttatcttttttaatgtctgtagaatatgtagtgatgtccactcttttattcctgatattggtaatttgcattttcctctttttatcttgacatacagatagagttttgtcagttttattgatgataatccagttttttgtttcattaattttcacttctgtttgtctgtggtctcttgatacttattttgtttttatcttcttttcctacttacattgggtttaatttgttcttagttttagcttcttaaaatagaagcttggatcttcaaatatatgcatcttcccacaaatttgaatatgttgtggcttaattttcattcaatttgggttattttaagccatttttagttatatattctttaatccatggattcttaaatttccaaacatgtaagggatttttctaatttctttctgtctaattctgttgtgatcagagaacaattctgtatgattctaatactttttaaagatagtaacacttgctttggtccaacatatagcttatcttggtacttgttccatttgattttttatttatatatttccaattttctcctcactgtgtccatgttttcctttaaggccttgggcatttttgtagtgtttataatagtttatttaatttctttgtctgctattccataagttctgtcatttctgagtctatttctattgactgatttttctcctgcttatgggtcatgttctgtatggctgcatgtctaataatgtgttattggatgccaaacattgtgactatgacattgtcaactgctggattttgttctactcctttaaagagaattggattttgttctggcaggcagtaaagttatgtgtggttcagttttatacttccaaggcttatttttagtttgtctcttttgttgttggggagaggatctagtgtatgtaggctttgcttccaggctagtttagccctactaagacattactcttttgtagtctctcttctttggctggtaaggagtttgaaacattttctgccctctgtgagctctggaatcattcatcttacaactccttggtgatcttttctcagaagctgacctttcttgacttcatgcagttccacatgtgtagcttaatattcagccagggactcaatagaccccatgtagatttctggagctcttcttcagtattgtgtcttccaaattttagccactttggcctccttgtcttctcaactctgatctctgcctacccagctgggcaagactacagaatttacagaactctgaggttcctccttcctgtacctgtggtctggaaattgcctccaaacagaaagctagggcaatctagggctcacctcatttgcttcccctctctcagggatcacagtcctctactacctatagtccaatatctgaaagcagttgtttcatatgtttatctagtttctagttgtttctggcaggtaagaagtctggaccttcttgctcccttactgccttgtatgtccattagtttttataaagactggttagctagtaagactattaaataggatcttttcctccctgctggctctcatttctgagtaaaatttttgggagacttgtttggcataggaatcttgggatgggagtatgcttcacaggctttacttttgggtggctggaaaaatggctgtcaggatgtggaaaaactctcaaatgtcacaataagaaatggtttactccaagatcttaggtacagggatggcaataggaatgctaactggtgcagttaccctatatacagacatttagttgactcccctgaatgtgggaagaaaatggctgcccttcttcctccctttttccattgcacctgttgactcgtagtccagcttctgcttcctccacggtgccctcatggcttgttctagggcagtggcctcccttctagtaaaaatatttgagcatgtcactgatattcactgaattataaaaattatgtacatatacagatatattattatatatttaataaaaataatgattttgaaatgaaggggtacaaaatacctaaaaatagaagatattttcttaatacatctcctgattatatgttcttcactttggagactactatctctttggtgacttcttccatcaccttatttctgtttattttcagtcacccagcaaatttactaaattctctcctttttgtgtatgtgggacgcccttttgtaattatgggtttatttcttttactgagaaagaatggaggcaaatatttgtgataggtccaccattttgaactggaagtctgattacacttcttaaaataaatttttgaataatcaaaatgtcttttttttttttttttttttgcaattcagtttgctttcctggttgggagcagaagggctgcagcccaagaattgcttattacctgcgggaagtttttgttatgcagcagttcttaaatttgggtaatgtcaaagggcatgtgaaccaaggaagttgtctgctaatttcaccagaagcaaaaaagtttaagaacagctgctctggagaaatattgggatcacatgagatatacttttcccctatttattccacattccttaatttagaggacagtataaccatctggagaggatccataattgaagaaagaacattgtttcattcttctgttgctgattgcacctggctatataaattcattgtcatcttctaggttttcatactgttgatataccatccctgaaaccaacagctgatataaattgtaacatagaaaagctaatttgacatcatattgggaatgttagccaattgatttttcttaagggaaacaaactgaaaaaataagcccactatgaattaattctttgcaggaaattcccatgtctgattatttaaaagaataaattctgcatgcaaatgaatcattacaagcttaattgaagcttgcgggatactcaagtttactcactgtggtgtgtttttgatggagacaggaagtgaaaaagcaaggtctatgagacttttttttcctatgaagtctcagccagtcttttaatgtttctcattgagaaactttggttgggagggtaaatgactcaaggtatctattgctgcttagccgtttttaagggggcatttccccccatgttcctcccctccccaaaatagctaattatgtactggaagtttcaatacattgttcacagtttgtgaagtcagcatatttctggaagctcactgtgaatgtaattcttaactgtacaaatgcttttgtttctccatctctgcagctagctctgtactgtaaggacacaattctatcgctattttttccctcacatttgatgtggtagtttgcatacagctgcagagtagacagttacctttgaaaggaacatttggctgctctaatttgattaaagaaaaccacctcaatcatttctagactgagaacgttttcattttaacttggcagtaggagttgggaatgtactcattgcacttagatatgtgggggaccagttagggaacaaaaccaactgcttgaatgaagaaagctttggtgcattttttttttaaaagcaagcagtatgattccctttctgtttccctctcaaattctctacaaccttgattttcacctccatcttcttttcacggttatttactttgtaattccagtaaacgaattctggcaggaatagactgctaccctaaagtgatttgtgatttaaaggacttcagggtccttaaaaattatcccattttacatagaaataaaatcccaaatcatgaattactatgaattgcatatattttcttggccactgttgagaaaggcaaaaaaagttgttagatcatgggtgtacagaccaaggctgggaatttagttgtaacttacttagaagaaaattgctccttgtcagaaggctgcagtcaactcacatatatgccctttgtttctgacatagaagagggtctgatcaccaaattagtatgacaattaaaaataaattctggtgattgtgaattggcatcaactttatatatgtttttagaaatgattgagcagtggttaatgtctgtacggtaaaccatgaacaaacttttgaaccacagctcagtaattcaatatatgatatccttgtgaaaggtactgtgctgtcatcttaaaaagtttgagtgtgggccaggcacagtggctcatgtgtgtaatcccagcaccttgggaggctgaggtgggaggattgcttgaggccaggaatttgagaccagcctgggcaacgtagtgagacctcatttctacaaaaaatatttcctaaaatttagccaggtatagtggcactcacctctggtcccggctactctggaggctgaggtgggaagatcaaggcttgagcctaggagtttgaggctgcagtgagccatgatcacaccacttgaccccaacctgggagacagagcaagaccctgtctcaaaaaaaaaaaaaattgaatgagaaaatttaaattaaaagtctgaagctacacatgggcctcagaaataacaaacactattacttattgattattggatattattgattacctaagagaggaggtcaaatgtgggttcacattccagttctgccacatgactatgtgtcttaaccccattatgcttcctacctctaagcttcaatgtcttcatttgtaaaattaggacacatattaagtgatgtctctgaagttaggtaccttttaagtgttttgttttgttttgttttgtttttttgagttggagtctcactctgttgctcaggccagagtgcaatggcaccatcttggctgattgcaatctccacctcccaagttcaagcgattctcctgcctcagcctcctgagtagctgggattacaggcacatagctaatttttgtatttttagtagagacagggtttcacagtgttggtcaggctgatctcgaactcctgacctcatgatcctccagccttagcctcccaaagtgctgggattacagacatgagctgctgcgcctcgcccttttaagtgtttgatacttgtcaagtacttagttgccttacttattcctctccttcagaatattttgtaggggggtggttttgttaataggattggtggcagaacttgacaaaatcttcaaattctaatattatgtgcatctctcattctcttggacaaaatgattaagtccattaggaatctctcaagtctgcctactttttctctggttaagtgtgacattatatcaggtagtagttgcaagggcaaggcataggtactacggacataggagctgttcaacaaatggttgctattagatggagttacactgtcatcttgaatgccaccttctgccatcttcaagtgctataattatttccacatttaatctcaagactgttcactcgaagccaccccagtttgttcttccttctgagagtcaaaggccaagaaagaatcttttcattttgtttttacacacggtaaggagggcgtaaatattttcagccacgtgtctcagtgtacaaggatggtgaagggactaaaacgatgtttgcctaaagtaccctgctacattggggtttgagcactcaggatttctagtagatacaacattataactgtagttgaatcccaggctcgttcacaatgcttatttatatagctgaagaatgtccaatgagtaaaatactgcagaaagcaatgctggagacctgtggaaattctatgagaaaatgctgggtactgattatttatgttacttcaaattttctttctctcaataaagtattattttgatatttctcctatataattgcctttttttttctttggcgctgggggggttctcattctgtcaccgggcgcgatctcggctcactgcaacctccgcctcctgggttcaagcaattctcctgcctcaccctcctgagtagctgggactacaggcacgcaccaccatgcccagctaattgttgtatttttagatggggtttcgccatgttggctaggatggtctcaatctcttgacctcgtgatccgcccacctcagcctcccaaagtgctgggattacaggcgtgagccactgcacccggcctataattgctttttttgaagtatatttatatagccctttactattgaattctgcccatctacttactattactgtttatcttcttatgtcacttccaacctgggtgacaacttaaacattcaaatccagtaaaattattgtatgtttctaataaaatgcatagaagctagcctgagactgaagttttgttttttaaaaaatatgtaatgaattcatcacttcttttcgtcatgacagttgtctacttcttaagtgctgttaatataattacgttcacagcagcagtgagggagactgggggaggattgttattcccgtcttgcagataaagaaacagacaacgtaaatgacttgctcaaggtcaactgtctgctggcagagtcaggactagaccacaagccttttgactccagggtgttatttcccctattatatagtttttctacctaatactacaagtgtttcagtcatgcaaaggtcatttggatttgactgttttagtaagacctgcttggcaaattaaatgcacataaactgcatgctgacaaaggcatgctgtttatttgaagaggaagctatcttgacttactggaaactagaggtataatggcttaattctgacagatagtaaatgatatacatatacacacacatacacacgcatatatattttcaaacaatctattttcatagccatatctagagaccagcatatagaattgacagtgttaagtagtgttatttgttagggttcatgctgcttctcaacttggtggcagttagctttccatgacctaccctgcgttactgagaaaaggatggaagagtagcaggtcaaaggaagtacgcatacctttgaatctggcaccagaagtgctgacgaggatgttgcatatgctcacgatgactcagcacttcctggtttctcttttcagccacactctggctaatgatatcgaatgaccttggttcaaactgagagtttcagggaacctttggtttcttcatcatcaaaaatttgcagtctttcctttctgtttttaattagttaatggtactaggtatgaaccattatatttcacactggattagatactttttgttcttaagatggtcacaatctaaggaagtagctttgaccctggactataaataaatatacccttacctctcaagtaagagcagtcctgctataactcatttggtcttttattgtttctgtgcaacctaataagtagggcaggagtggaaggaaatggagttcaaacttcagttgcactgtttgcagctttggttttaggaaaggcttagtgaccagtaaggccaagtaagggaaggtaattgtggatctgccccttgggtccctcatcactttctgaatggtccagaataggtctaccatgagtgaaaccagattgtcgttgtcaattagttttatatttaggatcagccacaatttttagactctaaaattattaacattgagcacatttggagatgaaaattttcagaaaacattgaaagttccaggaaaccttgaaactttttaagcctgagttttcctgggctattgagagtttctccatgttgacagccaatttgttttacaatttatgaaacaatttaaaaaccattttatagattatctagatatatttctttagaaatatatcttcattattaaaggaaatcttaaaccagtggtttgcagtgaaggaaatagctatagtatagcaaaaatatgcctatatttaaaatacaaatatttattgttaaatgtgtttatgtgttttcatctttacagaggcctctaaatagccaggatttctggccctttaactgcttccaaataagcaaaagtaaaaattcctacagaaaacatagccctgacctttttgcacatgtaatccaaacaaaaagttagctttgaaatggagtcttgttacataatcatactgaaaatatgcagtaatatgtattcctttgaatatctttcattcagaaacatatttttgtttatttgactatcctcccagctgaaaatgggttatgttctggttgttcatctaaccaccctacctcaaaatacttgagaaatcacatgaagaatttcattccaaagcatacaattttcagaagggctcaggacattggaaaattgcacattggatttaactccattgatgatttaaataaatagcaaataatgcaagaagatagataaacagaatatacaaacacagtttttactaggcagaatacctgtccaattaatagtgaattatttaagcagcatttactttatagaaggcactttaagtgaatcatttgtttcagatctgtctgtaacatttctaccaaactatttggccgactataccttatggtatcaagcattctaaatgtgagaatactggccaatataggcaaaagcaaagaaacctccctcttttcttgtgtgttctctcagatgctgctatagaaatctgagaattgggagcatatgcttcagactgcaggcttctgatgctgccccgcagcaacacagtaactggcattttggttcactttgcattttactcatctgctgatttaatgagtgttctgtgtattgagcaatagcaggagttctacttaactatcactaaacataaagaagaaaaataccatatgaggtgtctagttttttttattttctttttaatttacaggggagtcatctgttaacttgcgtaattgaggaatagagcagtccagttaataagaaagcttagttattagaaagttgccatctcttctgagtccccttttcaaaggattagaatgtgataaaatacacttaacactaaaactcataatttaatctttgttgagcattgagaagatacttcaagatatatcctttattgtaccctaataaaatggtagttatgatgaatgatgcctatgcttgctactagagaattatagttaataaaattttcgcttggttataccgtttgactgttcatcatgatagataagagaaggccttgtgtcatgtccaatggaaacacgaagtcaattgctgaattatgcttggttaggtataaaatttcactttttaaatttatttatggagggaaaggttgagatagtactagtgaagggcaagcaggaagtttaggtggagaataaaataatgagaaaccagaagaaaaataatatgtatttatatctatacctattatatatattgatatatatctatatagagagatgcagagttaaatacattttatttttagatagatataaacttacatataattatgtagatatatttataaggagatgtgtatctatgtctagataaagagatgtatatctatctatatctagatagatatctctagatacagatatataatctagatatctagatatagatacagaaatctggagatatatacatctctctatctagatatagatatctctagatatagatatacatgtctccatatagatatagatctactttcagaaagtagatagagtaaaagatgaccaaattagaagagatcaaattaagaaaacaaatgatttcttaaagttttaaaaatatcatggaagggtaaaaattcatatggcaaaaacttctggatctagaggctctcaagattaggtagaaagaataaatgaggttaaggggaacagaggacaggtggtgaacaaaccaaaaagttcaagggagtgatacagaattaaaactagttcagctccaaaattggtataagctacaacttcagtatggcttatcttaaattgttgacctcttgcccaaaacctaaataaatgtgtatttgtttgtcctcttcgtattatgtctcttgtgggaaacacaaagtaaatttttcttgcattcatctagcttatggtcttacggtagaaaaatatggataaaacagttgttatcaaaatgaagaaatgcagtgaagcgcaggtaaaggctcacagcctttctgtctagtgctctgaatgtcagagtgaacaaaggagttgttatacttggcatgctaacaagagaagtcggtctgttccgcatgttgcaaaatttctattggtttttattgttggcattaatatacacgatatcctgtgcccgtcatctggttacacagacatttttgtcatgttataacatgaactgactgctttaaatgtataggtaagtggtaatcaatttacaaaattaggttcttcattcctccctgacatcctccactccttcccaccagggtctgcctctttgcatgtggacacgtgcatatccattttgcactttattacatcgttttataaagatgctaataaagtgataagtagtgataaaagtaaagggatggtggggggaatcactgacaaaacaaaagatcacttcagaatctacaattgtacatgttttaacgggcgtctttgatagtcctggatacaggctcagaacactttactgaattttgggagagttgggaacatacttctatttatattcataagtataggaagaaaagccccaactatctaggtttatctcacgttgaggattagaagcttctgtagacagtgtatttcaatcatgcttttttcaagaagatagattttttaaaaacttattttattgtggtaaataaaggtaatatacataacatatgtggtcaataaacataacatacaatttacagttttaatcatttttaaatgtataatgcggtgacattaagtacattcacattgttgtgcaaccatcactgctatctccagaactttttcatcatcccaaactgaaattttgtactcactaaacaatgactcttcactccccttcccctacaagaagatacatttttaaataacattttaaaatcagaagagaaccggtaggtagtttatgccatagccagtaaccttagggttcagattggaaataatagagacccactgaaactagctcaagaaagagggattttattgtacggggggaacaaggttcatgagaatcattacacttctggtctcctggaacaggggttctggataccaggagcctctgtggagtgctttaggatagttcttaaatcgtttcgaagttttactaagccttttgaagccatgtaggtgttactagaccggtataaaactgcatgccaagacttcatggtagtttttttttggtcataacatcctttccaatttcaactatagcacatcatgattacactgagggagtttatgaagagtaggtttcatggatgaacattatcagtcttgaccatagtgacatcttgagctcactcattttggtgggaaaatcatgctttcagagtgaaaagttggaacagcatgacggaaaatggatttttattttaaaccattgagaagaaatgctgtatgactttatgatggctaggagataccttacatataattacctcacaagctgatgcttttaccaactaacccccaaagcagcatctctttgatcctgagtgacttgagccaagggaagtggcaacgtgatggtggtgaagggtgtggagtgggcagattacatgattcagtctccaactcatcccaagtctagccatgcccctcttagtatgcctactttaagggcataggctatgtggccaattttccttcatcgagatttcaagctctttgaatcaagagagaaggcaatatgtttatttagaggttaagaaattataggctttcagagttaataggttatctaatttttctactcattcgttcagtctttgaacctagaattatacaaacagtacatgaccagtatttgtcccccaagatcacattacagcagtggtcttgaaccaggggtgaatttgttccccaggggatttgacagtctttgaacacattttgtttatcacaactggggcggtagagtttatagatgttactagtgctgcgactactgccactaacatctaataggtagaggttattgatgttaagtatcctgcaatgcacaggatggctccccacaacaaacaaatttcaaaatgctgatagtcctgagattcagagctctgcatttcaaaaagacactagttaacaacaatttgtagaaggcaaaaaattataaaggtctgcagcataaattggaaaaaacacataagtccaaccatctagcattaacaagctcacattcatataattagcactcctaatattagtatttttcattaccatcaataggcaagaagaggaaaaccaagagtaaggatagtcttttcccacaattgtttgattgggagcgaggtgagatggctgaaatggacggagttaaagacaactggaaaatgtgagatttccttaagagtgtggctcagaactagaatccacggtgaaggttgttgaaattgttgttgatttgttttggttggctaaatttgtgaattagttgtatttggaccctgctagggaatcaggggtttaaaaaaggaagctaactagaatgaggcctaaggaatgggttagctcagtgactggttcttataagaggggatgcataccctcaagtgaaagggtctaggtaattccaggcaaccaagacctcaaatcagagctccctctaaattatgaatgcattgcctcatctctgttctcaattgtcctaatgtatatggttggtatattatgttttatatttttcttttcatgcctccatttataaaatgtcactaatctatatgaggtgatcaaatgaaacaaaccagtggagaagtgactcttaagattaattaaggtaggtaatattgagatctatgaatacggtagatggcttatataggttgaggctttacttctttttctactcatccagacttgaaccttgaagattaatttatcctacttgtcatagtttgatattaaccaagtctaatagattttccctttaaaacatttcctggtgcccattttttcccccttttcatactgtcccgggagtcaatcaatataaacctgtatgagtaacttttttctctctctcgtttgggttatgttccagttcatatgatgccttcttcccacatcacacatgtgccccaaaatggtcttgaatgtctaccatctcaaacccagactttttgatttgtggtccaaagctcttcgtgatctgtatccgtcttacatgttcatgtcccacactgtcctctaaatggggactctgccctcatggctctcaaacggagcctgcttgctctctccaaccagcctggttcatgtggctgccctccatggcttacttgctcttctccttgttacctatgtgatattcactcatcttcaaaggttgcacctggctgtcatcagctccatgggagcatttctgaaaactttagtactaacgttcactcctcccttgtgaagtttatatcacctggtttagtgttgtgttatatcttgtcctacagtgtccttagttattcacatgtgcatgtcttctttcctcatctatagggaaagctccttgtaagcaaaacctgtgacttattgaaggttcacatactgctaaccatattgcaagtacttaataagtgcttattatgtggttgattgtgcaagatagcctatttctttaaaaatgtcattgaaatgatatgtacaaatacagtataatattagttattatacaagaagtacttgaaaagattaattactgccagtcatcttaatattgggtgtacatgggaagggcatatttgaaaaactgtaagaacgcagaatgacgaattggccctctatagtagtagttctcaactgaaggcagttttgctcctaggggacatttggcaacatttccagatatttttggttgtcacaaatggagggatatgattagtatttagtgagtagaggtgagggaagctgctaaacattctacagtgcacaagacagtatccccataacagtgttatccagcctcagatatcaatagctccatggttgagaaaccctaatttacagcattgagtgggcaccatcattaacatactttaccacctaaaggaatgaaagcatgcaaaaagtagtgcatttttatatagaggaaatgatcatatattgtaaactcctaaacggtgggaactgcagctgtgtacataaagcagaacagtcggatagtttaaaagacatgtgatagctgcttgtaccgtaaacgagcactttatgtctttggcctggactttgagaggagagaatgattgttaagtagacagaattctcttaatactgaatgcacatagcccataattttagaaaattagaggcatttgctaacccagaaggatgtattggaatttcaggtcaaatttttaataaactggaattcctttgcaaggattgatagttatattagaatattgaatgaaatctacctccttccattttttcaaatattttagaagcttccttgaagaatacttgatagtttttaaggtgtaagaataatattatttccctaaataatgtgtacacatggaagcagagtgtagaatgttggacaatggagactcagaggtggagactggcagagttctggatggaggggtggatgatcagaggttgtttgatgggtgcaatgtaagttgcaccagtgatggatgcactgaagaccctgacttcaccacaatgcagtatatcagtgtagcaaaattgcgcttgttccccatgaatatatacaaataagaaagtgaggaaaggaaggagggaagggagggagggaggggaaggaaaggagaagggaaggggagagaacgggggggaggggaggagagaagaggagacgaaaagagaggcggggtggcgcagcagctcacacctgtaatctcagcacttttggaaagctaaggcgggtggatcacttgtggtcaggagcttgagaccagtctgggcaacatggcaaaaccccatctctaccaaatgtacaaaaattagccaggcatgatggcgcacgcctgtgggcccagctactcaggaggctgaggtgggaggattgtttgagcctgggaggtgggggtgacagtgaaccgatatcacaccactgcactccaaaagaaagaaagagagaaagagagaagggagggaagaaggaaggaaggagggaaagagaatattctttctctcttgaaattaattttgggaggtgcttatgtggccaagagtggtatggtggagggagcagttcagagagatcctgggcaggacaccttaaccattccctgcctgtttcctcattttcaaaaagaagggctaaggcttgatgacctctagctttaaaattctatgtccctgtaatttcagatagagagagagagagagcacgcatgtatgtacagttatttaagaaagaaactttgaaggcaatttttccagttcatttcttagaaatttcagaaatattccattctctaaaagcttaattccagtgtttaaagaaaggaattcctgttataaataaaagttgttctctgctcccaatcaaaataaaaagagtgaaataaaatttacaattgattcaaaagtgtcgttattagctaattttgaaatttttatctattttcttttgtttatatttaaatataaataaaatattttaataatactgacttttctcacacaattcatgttagaatttcttagatggttccacatctgagaagtttcttgcttgtaaaggtaaaacagatttggaagctttataatgatttttaatccatcatttcggaagttactggatattggacaaaatgataaagtgttattttctggatggaaaattaagtagagccttgatactcaccaggctgaggatacatcccaagaaatgaggcttgcttctatggtgtctctgttcttaggtttcctcagagtccattctagaacttggataatgagattgcctgaatcgaagatgtttttgggatgggcccagagatgcaaaggatatccagctacatattagatcttattcccagaattaatgttgctacagggaatagcagtacatggcatagaacatgttcataaatagtgccttagatgacttttggtttaacagaggttaattgagccccccctgaatgcaaggcacctactatagggactacacagtgggtcagattgtgtattccttaatctctgctttaagtgagtttataacctagtggggagagagaaagtgtgtgtgtacctgtgccaattactgtaatacaaagaataaagctatcgtgaccattcagagatacagacacaattctaggccagttcagaagacaaaattaagtttaatttgcaggagcaagaaaatgaggctccaaacaagagaagaacgatgtgaaaagaaacagacacatcgtatacatggagatgaatgacatcacgtatggcagacgaacctgaggtgctgagttaaccacagtgtgaggagaagaggaggaatggagataatgcccaatcgatagggtcagaatcatagcagagggtaaagcggcctgaaatggaatctagagacaggtgaactggttaggagattgaccattccctggagagagaaaaaataatggtggcctaaattagggtagtgcccttgaaatgagaggaaggtttgcatatgagagatagttaagtcctagaattggccaatgtgggtagctagttagatgtgtaggtgaacagagctgtagggtcaacaagatgaattatggttttatgcttgagtgagaggatagtgatggtgatgtcactgttagaaatagcattcacagcagaaggagcaggtttggagggacaatgatgaactcagttttgaacatgttgagttacatgtgttttcaggaaatagccaaggcagagttatagtcaaagttcaggaaattgagagctccatccagataggaatccggaaaacctgtggcattcttaaaggagatgtatagaaatcttttttgagccccacatttggaatatcacttttgcatataatttgtcccacaataaggagaaaatcacgaatgccccagtgtggttactgagcacatgactaggctgtcaccagctaagtgacttgttcacccatgccaaccttcacagcacaggcggttcaaaattgcctctgacacagttgctgtctgtagtagatcttcagggtcactggcaaataggaccctgtatattaaatagatgaatgagcaagaaatcctgtattttaagtgaaaaaaaaaaagactatggaaacttgagactctgcatttaggattgaaggagaaaaaagggggcagagagaaaagcagacacaagagaagtagagggagaagtaaaagaaaactctcagggaagccatgggaggggagagtttcggggaggagtaggcatctcattctggtatctgaggtgcgtccaagaggtggaagagcctaaagactgcatccagtagtggggaattactgctatccatttgagagacagatctcgctggaagagaaagaggggaaacctggtaatagataactaaggagtgagaaagtgtagcacaaagtgtagaaactgtagcacaaagtgtagactgtcattcagtaaattgggggacatggaatgtggctggcagaatgacaatctgatagagataggcacagttaaacatttttgttgttatgaggaaatagggaagtgtattagaaggagccaggaggggaacacttaaaggggaattgaatgaaagggaataaaagctgatgaattgcagatttagcatattgtggagaggcacagttcaggaggaatagggttcgtcttgaagaggaggacactttcctgtgaatcatgagggacagaagatccatatagaagaagacaatagctttgatcttctattacaagaaaaggacatttgtgtgaagcagggaggaattgggagccctaagtaaaggctgaggaagtgtctggagttaggaagagagggcaggagaaggaagagctagatgttgaagaggaggaagcagagggattggctgtcctaagagggacccaagcctgtggaagactttaaagtggtcagcacacttgggttcccttagcaacagagagactctccctcattcatcaataagagtggatttattcactgatatgtagacattaaaaaattgttagggtgacattttataaaaagtaagaactctcttatatagcagatctataaaaattagtgtgctaactgggcttagcaaaagttgggcaaatccttcctaaaacacagttaatatttgttgaattcctttttcatcaaaatgttaacttagagttgaaatgcaaaagaagagatttgataaagcattttgacatttggcattttaaagtaatttcattagatcatcaagctatgaattattaaacattattctactgtaaacagtttttttccattatctttctttgaattagaaacaagttgcatgccatttgcctagaagaagataaatgtattatgcactaaaatatacaaagattttggcactgttttttttctgctttttattcattaatgcctttgtttagtcttacatcagatgaattggacaaatttgggctttgtatggctaaagccaggaacaaaattctctaacagtgttgacaaaattcacttgaaaagtcaagtcatcattcaggacgagtcattttcaatttaatttccaccctagcacacttgagaaaagtagagtcatctgttatagtggctcccaggatagtgattccagtaacttccagaggggacagttttgctcactggagcacctccagtgttaacacatcgaaggtgtccaagatcccgttgttgtctggctgattttccgtggagagtgaggaggtgtttgacaaggccctgcaggggatttcccatcccatgaggcaattcataaccaaaacaattcagtataaaccaaactaacaattagccttttcaaaagtgctcatctgtgctgcccaaagagttgatttctttagaagttcttctaacaaaccagggtagtcctgatctttattcttataggttaaaagttgtaggagttaaagtcaaaatgcagaaacattatgctacagtgtgaagaaaaggtatgtctgagggccagggcctttttaagaggcagtcagaacaatggctggctgcccaaacatagggagccaattctgtgatgtggttgccatgttccagtatccacctggcactaaatgcctagaagcccaatttcattagtatatatagagggtttgggagtccaaggttgacagactcatcccgacctcacaagaaaactgaggtttgaacaaaaatgttaatgcattcttttccagtaaaaactgtacatgtcaagtatgcttgcatctgccagccaaatcattgtctcccttgcatgcttgtctgtgggaaagccaggttatagtaggatacttgcattgtggacatggaacctggagaggggagttagctgatgagattaatgtctgatagcctcaagctctggtgccagttgcatccattttggctgtaggagaggaagtttcattcacaaactctcacctatgacagggttgagccatgctgccagttgtgtctttccagagtttgcttttctatagataacatacatactttttgtaaaagtaccgtttagttgtcatcacagcctagtctgttcgatgtggggtggtcatagtctcttgggccttttctattggtagatcatcctcatccccacattttggttttccctatttccatcttagagtttgtccatcagttcagttcaggggataccatgttacctgtctcatgtcctgcttatggatacttttctgtctgttcattgatataacttctctgactaaaagctaacctcctggagataaatttttggcacatgacttgatagtggtatttaaaaaaaagtttaactggtataagtggaatattttaaagtgccctgtttatttacctctatgattaaacagttactaaaatataaattatagactttgagggttttttttgaattttgatacagagatcattttcttttgaataaaaaataatgtgtttacagttaaggggaaaatatcctactcttaccaactcagttttccctttcaattgtaaaagggaaatagactgtatatctttacaatgtagaaaagagatgtggaatatccaagactgaagaaacaatgtttaggataaataaacaatatttatgcacgtagcaacttataaaatattattttctctcaaattattctatgagaatgatttaaaagactaagagtctgtctaaactatctggtttgttatcatttttgtatcttgaaacaagtcagtaaaaactatgatctcatagagctacttgttatctgctaatttgtcaattttgctttttcttttacttgaaacaaagaaatgcaaaccaagaaggtagtgattaaatatccatatgtctataacttttaaaaaattgtataaatatatatttattcctagggttatatttttcaaaaaatctgttgctcattacagaaaaaaaaactgatacatgcatgctaagtgaaattttttttttggatgagtttttttttttttttctccaagttaatttcagctgctggtggtgttacctttgtcctccatttaggtagcattgctctgtgtttacaactttccatcttagtttcagtggatattcttcagagagtgaccttatgctcaaataacacttaaatgtaggacaagaaggtggctttagtagaatgacctcctagtaacagctaagaaacactagtaaatgacattaacagagatgtacttaataggctaatgcttagatcaaacctttgtataaactaattcaaaatgcataatgtaaaaatctataaaattctgacacaagaaaaactggttaaattaaactatctggatattaaaatctttgaaggacatttaaacacagataggcttattgatttagacttggaagatttagacttggaagaaatagcacgactgaatgtgtgctgtggcacagttagttctcttctattgttttaatgatgcccttaatccatactgggacagggcttatctaggatgtgatttaaggtatgaagttacttctttcaggaagttttcttttttgtgattccttggaaatttctcaaaatgttggaagagtgaaacacattgtcattgtaacacattttgtgacctagttttggtctgagtatacttttttactagcaagatacccagaggatttagactttactctgacagctaaatgaactcaaatgtatactgaatgtaaattgctttgaaggctgtggatcacaagttaatagattctggaccttgttttccctttcatgagccaaacattccttggatttaagggtaggtttaaattaaagtgtagcaaattgcttccctctttggaaataagcaaaatcacccttctgataataaaatatttcttgaacatgtcaagacagttactgaggaaagaaagcatgaggggaaaaacgacaataacttttcagagacttgctctttaggaaatggaatatgtttagtaaaaggataattgccttatcccatgtgacttgaaaataatgagacaaagagaaaatgaaaacactccatacaagaacttatatgaccaaataaatctggtcccatgggaagcagtccagtttttctagccctactttaattgagcaaaacattttcagactcttttggaattatcttcagaatcgttttatgggccaaagaatcaacatctttattatcacacctctttttggacccaaaagaatattactcagcctgatcccccacttaatttatcagacttggttcaggcttcttccaaaaatacagtacactctcttataggacaactgaatatttttcttaattcatattatatatccattcagcaatcatggctgagcacccccaatgagtcaggtatgttgtggtagcacagaggagtcctggctgtgggagagggagggtggaaggggagacagtaaggatatggagaatgtgtgagcataatctttgaagatcagtagggacgtcaccagatggacagagaaaaagagagctttctaggcagcagtaacagctggtgttgaggcacagcacaaaaatcacgcacattctagcaactgtaagtatttttaggatccaataaaagatgaggatggagtggcgagtggggcaagatcacgagtgacctaataagccatgggatggggtatgcagtgtttaagagtgagggttctcttgcttggttttctgagtacaaatcctggctctctcatttacagtctttaggatgctgggcaatttactaaacttctataccttaattcttctcatctgtgaaagagatgatggtacctgtattatagggtaaagagatttaaatacataaaacaaaattattagcattgtgtctgacacacagtaagcactcagtaagtgttagctatttcttctgctactttgtccagtggataaaagacaatagaaggattttaaagagcagaacacacttctttatcttatatacaccattgaccacttctttcttcttgaaactgactcttgccttgatttttttaaacagctctattgagacatacttgacatgcaaagcaattcacccatttaaagcgcttgattcagtgtttttactatatttacagggttgtgcaaccattgttaaacagtctgattttagaaccttttcattctccctcaaagaaaccccatacccattagcagccattccccacttttccccaacccccacacccctggccttaggcagccactaatctactttctgtttctgtagatttgcctactctggccatttcttacaaatgaatgaacatttttaattttgatgaatctgtagtgatctgttctttctaatattgcttatgtttttggtgttataattaagatattgcctaacccagggtcacaaagatttactgctatgtttttttctaagagttttatagttttagctcttacatttaggtttgtgatccattttaagttaatttctgtgtatattgtgaggttaggatccaatttcattcttttgcatgtaggtatccagttatcccagcatcatttgttgaaaagattattctttcctgagtgaatggtcttggcacatttgttgaaaattcatttagcataaacatgaaagttaatttctgcactctaaattatatttcattgatctgtttgtttatctttatgccagtaccatactgtcttaggtactacagctcatggtaagttttgaaattgagaagtgcgagtcttcgaacattgtttttctttttcaagattgttttttgctattctgggttccttgcattatcatatgaagtctaggatcagcttgtcaatttttactaaaaagccagctgggattttgatgtggattgcattgaagctctagatcaatttggggagtattgcctcttaacaatatcaagtcttcctgatccatgaatacggatgtccttccatttatttagctcttttatttcttgcaatattgttttgtagttttcactgtacagagaactcttgttaaatttatacgtattttgttgcttttgatgatgccatacattgaattttttttaattcccttgatgttttatgatatcattttcttcatctattttcttgctcacctctctgattcatctagggatgctattctgcttgttttatgttttgcctccaagattccgtctcatctggaggctgataacttcccaaactattgcttgacttgtgtctggagctctgagaagtatatgtttacagttgtttattggactttaccacctgaatgtcacagacatctcaaattaatcttttccagactgagctcattaattacttcactcatcttattttcatctcttcttatggcctttggaaatagtactatcatctaccttgtctaaaccaaaacgtgaaactcatttcaaacttctctttcaacttgtacattctggtaggttaccagatcttctggattccacctcctagatatcactatgggagtataaattggtacaatcttctgtcaggtggtttggatcaagaactttcaaaaaatatatatattttgattcagaaaaagtgtatatcattttatttttaaaatgccacttctaggaatttatcataagataataatgagccaatgttacaagaacagggaaatggtctaataaattacatatagaatataatttagtgcaacctaaaaatggagatagatttgtgaaagtggttggtacacttaaacttttttaattgcaaaacatgattcaactttgtttaacaacagtagaaaataagttctaagagagcagggatcttgcctgatgatcctgatagacagctgaagagtataatgtgctcagtcaatatttgttagttgtattggtctctctctgctgctactatttctgtaaccaatctgtctatattttttacctgggcttttgcagacacttcctacttgttttcctcacctccaattttattctcctataatccaacttccattctgcaaccagagtagtatttccaagtgacacatcctaccatagcattgttcattgtaaaagtcctttgcttttttcccagtgcccataagataatttccagacttcttagcctggattactaaactctcataatttcacttctgtgtacttttccagctcttctcttgccattttccaagataatcaccaaatcatgccagactatccgcaattccccaaatatgaatttttctgtgtacctacatacctttggacatgctgttccttctgccaggaccatgccaaacttcctttgtttatctggcaaattccagactgtcctatgagactcagctccccagccacttcccctcgaggtatgttgaatgcctcttcttcagggcctccaacaccatttgaacttttttacaattcttaatatatatacattcctctagggctggagagttagccagggcaagcctgtctattcctttgacttcaactcatcatcttactgctgcactgacttctcctatattctacctcagggctttgcagtgttggtctgaggcctggtaccaattttccatcatctgtgatgcaattagaaaaatagggccctgtggtaaatttttcagaaagctaaatctattcacatttgggatattaaaatatgctttatttatgaagtgatattgatagtagatagtagagtatattaatgtctttagttggcaatgttctgtcagagctgtaaagttgttggaaagtttccaggcctctgaaaaccaaagatctgggaacactgctgtatctcatgagggtggcaccaagtccccaaagtcaaaagcatgtgagtcatccttggcttctccttccccatccctccacccccgccacatttagacacttagcaagtcctgccaactcaacctcctaaatatttctggaatctgtactctcctctccatccttgctgccaattccttagaacaggccttctttactttccctgtactactgcagcaacagtctccttacaggtggtcttaccacacttccccttacccatgtcatcagattgggctctttgaaaaccataaaaaatagttgcccactttccagaggaacaaagttctttgtagcatacaaagtttctctccaatggggcttcttgcggtgctcctgctcacactttctttggtttcaagtgccctttctttgccacttgcttgggtaactcttgatactctgacagttaaattgtcatttcttctacaaagttttcctccacatatggatgggttgcttcttttatcatttcttaaaattccataggtatatacataagagacagaaagatgtatgtgtatgtgtgtgtgcggatttgaataagtatatgtgtatacacttatgtgtatctgtgtataccgcagacatacatacctcagcatttacagaatagttgatactttgtctacttttcccactagactctgaataacttaagaaattttattttaccctttgatttttctatacctagcatctaatctaatgcttagaaaataacaaatatttaataaacgtttgctggttaaatgcatttgttcaatgctatcgatcagatttttactgtggaaggctcactgaccagagtaggggatgagtacaaagagtctcagggcatttgggaaacaggataaaggccctttgtagaaaactggccaagggtgttgagtgcctgagctcagggaagtggcagtggatggaaaaatatttaggtggtggaattggtggttgattgaacatgtggggaaatgaaacaatctacgattatttgaaggcttctgggtttagaaaattatttggatgggggtgtgattcaccaaggggaatgaactgtgttctagacattttgaaattgagatgttcagagtattggttgaagttgtccaagagataactgggtatggagtttggagaaagtactattttggagagagaagttggagatttaccaacctctaggtactctttgaagctgtgaccataaaggagataactgtcatctgttgctgattagattgtcatagtggtggtggtacattggggaagaagagaataggtccaggagatcttgatattgaaggtccagatcaagaaggagagaggcctgtgaaggtttctaatttaaatcttggttctgcctcttgtctctgttctatgatgcttgaacaaattattctatgaatcttagcttcttcatctgtaaaatgagagtaatagtatatactttataaggatattgaaaggattcaataagtttccatatattaaatccctgccacagtcccaggctcactgtaggggctcttaagtggtaaattcaagaaaatgttcctcaagatatgagcagtttcaaaacaaagaattttttaatggttaccccagagattacaattaacatcttcaacttataacaatccagtttgagttgatactatttcagctttaatagtatataaaacttttttctgtacagttctgtcctttctccttcatgttgttattgtcacaaattacatgttcatacgttgtgtggccattaacgtagacttataattactgtcctatgcatttgttttttaaatcatattttaaaagttacaaaccacttacctatgtagttagttacctttgccagtgttctttgtttcttcatatggctccatgttactgtctaatgttcttttatttcagcctgaaggactccctttagcatttcctgtagggcagatctattggcaaaaaactccctcagcttttgtttatctgagaatgtcttaattttgccttcatctttgaaggatggttctgccagatatagaattcttggttaacagatttcttttttcttccagcacttctttatttatttattagaaacagagtgtcactcttacatccaggctagagtgcagtggtgcagtcatagttcactgtagcctcaaacttctgggctcaaatgatctttctgtctcagcctcctgagtagctaggactacaagcatgtgccaccacgaccagttaatttaaaaaaaaaaaatcttttgtagagatgagggggttctttgtgttacccaggcaggtctcaaactcctagattcaagtggtcctcttgcctaggcctcccaaagtgttgagattacatgcatgagccaccatgcctggctgcttccagcacttccaaattgccatcccactgccttctgccctccatagtttctgatgagaagtagttgttcatcttattgcagatcccttgtgtgtgatgagttgcttctctcttgctgctttcaagattctctctttgtctttggttttcatagtttaattacaatgtgcctcattgtggatcttttggtctcatctgcatgtacttagtaaacactcaaataagtgatcataataatggtgcagaattaaatgattataatttaatggtaacagtaatgaccatgaatcatctaccagttaaacataatattgtgcttaaaaagtcaagaaaatgttcaatgcatgttaccaagaattccactaaaactttaattttaaaaaatagtttagggaattaagatgggtaagaatcaattatctaaaatattcacttacatgggacaaccagatgactaacagattattagtatatgaggtgttcctgtggttctttgcaaaagaaaacgtctgccttgaaatagataaacttgcagttacatttacaaattatctcccacagttttcattaccgttaacaccatgaaacattttccttattatctgagatacttctagaacaaagatcaaactctaaaataaaatggacttatagaaatatagcaaatcataatttaatttttataagtgtttgcacctgaacaaaacaacccaattttagatccttaagtttagaagttggtagaaataccagtttttccagcttctccaactgcagtgtgttttctaatattttaatatagtttgccattggtgatcttagaatatatttctagcatttttcttagttctcaacacaataattcccagaaattttgctctaatagatctaatttaaaaatataagatgttatattttaatttttataaggatctttatttttgaccaagctttattttggttgcttgcaccttgttacgttacaaagggtactgaattctaccatgtaggattttttttcttggtttatttaagaaacattagagtaatctgaagactttgtgagccatcgttgtttctcttttgtttcgtggtagtctgttactttgacctttttcaccaagtatcagaaaaataattttttctcatattcttttttgtagagtcactccatattgggaggggattgaaaagcacatactttaatgcggcagtaatgcatacatattattttttctcttagaacaatattttaagatttgtagagatttcaggaatctaagagaacaaaacataaacaaaaaatttatattctaagtggacaaacataaacaattctaaatacaaaagaatttatgtttttacatgtttgatttttaaaactgcatttcaggattgatgattaggatttcctcattaattcagaggaacagattgaagaaaagtacgtgagtggtaggagaaaaaaatctgaattgaaaaataggcttttatgattcttattttttaaataatttttttaattaaaaattaataggttctcacagtagaaagtttagatgagcaaatagcagaaaacaaccattccaaaatcttatcacccagaaatagccactggctacattttttttttttttttttttttttgtgatggagtctcacttactctgttgcccaggttggagtgtggtggcacaacctctgctcacggcaacctccgcctcccaggttcaagtgattctcctgcctcagcctcctgagtagctgagattacagacatgcgccaccacacccagctaatttttgtattttttgtggagagtgtttcaccatgttggccaggctgatctcgaactcctgacctcaagtgatccacccccctcagcctcccagagtgctgggattacaggggtgagccactgcacccagccacatcttgatttatctttctaccattatgtttacatatgtggaatcatactgtacacactcttttgaaacttgcatttttaaaaataatatattgtgaatgtctttccattttcaataaagatgtatcagtaccattattttaagagccacattatatatatatacatatacattatatatcatatataatgtgtatgtgtgtgtatatatacaatatatatacacacacagagccagattatttatatatatatatatatatatgtatacacacacacacacacacagagccagattattcttcagaaaggtttttatcagtttgtattcccacagtgatgtgggctcattttcataaacaagtgttgtgcagttttgtcattaaacaagtttgtttttaacccagtttgaaaggtttagtgtttcactgaggttttcatttgtgttgctttaagttactaaggtttaacattttcttctatgtttatgatcaaaagtttccttaaaaggaactaacttcagtgattgttttattagatcagtacctaatcataagtacctgagtgaattagtgctgggatgaatttactcacctattaaggatgtgattatgaaaggtttttggcttacagtgtaggtaaagcttggttggctttcttctaagacacagcagacagtcttcattacaggcggctgcctagttttggctgcttagtcatttttcctcaagagaggcccaaagctggagaacagggctttcacaggtcagaaatggacagagaactaaatgttgaaagttgtccagaatgttccacactctatctgacttaagccagagctgttcgctttgcttttaaaaatacacttaactcacttatttctgagatcagaatctctttttcaagctctgtcgggtgaattgaagtgtgccttttttctaactagtcaagggaaaaatgtaagagggtttgggatatcagcagtcttcgctttttaacatttttcctgtgaattttctgaacttctttttttcagcccaccatgtaaagtatgtattgggatcttttaatttaccaaaaacattttggctttggcattcccacaatgcctgtcagcagggtatctcatttgtcacaaagtctccccatcactgacctctgcttcactgcagctccaaatggtgtgctgcattcagaggcagaataacagagtggttagaaaatcagattctggagccagacagtctgatttcaaagcccatctccactacttactgtctttgtactttaggcaaagtattaaacctctctaccactgttgctgtccattttttgtttttaaacagctttattgagatgtaatttacataccataaaatgcacctgtgtaagacttcaggtcagtatacttactgagttgcacagctatcaccatgatctaaatttaggaaattttcatcactccaagaagaaacccagtacacattatcagtccccattcctccacactctcccactgctcattgtcccaggcaaccacaaatccactttcgatttctatagatctacctgctctgaatatttcatataaatgaaataatggaatacatagtcttttgtgactggcttctttctcttagcataatccctttaaggtttatccatgtcatagcatgtatttgttcttcatttctttctattactaaatagtattccattgtatggatataccacaccttgtttatgcattcatcagttgatggacatttgggttatttacagttttgggctatcacgaatgatgccgcagtgaatatttgtttaccttcactgcgtcatcattcagtgaacatttgtgtctatttcttcgtctctaaaatgagtaccatctcatacagttgttaagattttttaattaactagtaaatgcaatattttagtgtttgagtcttcgtttaacagcagttacaaaatctggcttactcagaatgccacgctttcctaatgacatcttgaagtatcctcacttttactttattttactttgacttttccctaagttataatttagaaaaatttcatttattcaataaatatttattgaacacctatgtatcagacatggctgtgggtgccactgagaattgaaagaaaagaataagcaaaacgcaaagaggcaccactagtttaaggctatctttagtttgctactctgtcatctctgacctgccagtagggcttgcgacttgagttcccctcaccccatcctctcaccaaaagccacaggttttggggtctctcagtccattcactcttgttaggcccttattttgtccatcatatttatgtttttggagtggctgattgaaggtaactgttaaggaaagactaaaagttcatcatgtctaggtggagacctcaagaggtaaacagtgccctgttcctgatctatagctgaggttggtgaattgttctttatactaatctagacctaatagttcctaattttctccattggcaggtcgcttctttttgtagagttggctgtgttctctttgaacttccaaatctattttgtattggaactggactcaccaaaattatcaactgattattgtttagctgcctacagaaaacagctattgtttagctgttatctttctcttgtctttggggagataatgatccacatggttagtgacttggagttcacttaattccaagtaggattttgcccctgctaccattctcttccctgcaagacaacaaatcgcattttatgatatgccttctttgtggcagctctaaagcttttttttttcccataatagcatgtagttagcataacagagtgatgctacagccttactcttttctctgcctttcattcagataaaatgcattagcagtttgaataattgtgtttgatgacgtagaagtgcctgtagtgcttgctgtatgtaggactatggaagaagctgaattctattatttaatgtccagttcaggaattgatctggaatgaggagaggggtacataggcatcccatatacccattaagccatcctaaatagcttgtttcaggcccagctagtagtacatcagttctgttgctgatcgtgtggtaggaatgtgtttccatatacatagttttactgtttgctctattttcaaaatttactatagtgcaagagtcacatcttgtaaacttgcccagtttaggggattcccattccacatgtaaaacattttttggttaacagattcagaagatattaactcctagagccacagtgccaggtctatatagatagaagctgaaactagattaatagcaactctaaagttggaaagaagataaacaatgaaactttcttatgaatactctcttaaaggctgtaggaataaaatgatttagtaaataagcaatgttgattttgccttcccttgtcagataatagcagccataaacttaacagtttaaatacaaaggatttctgtgctttagagttggtttgacatccctgtccttttccacttttcagcaacagctagtgggaaaggggttgtttaattgaaggcttcaggagaacacaccttgcacactggattcaacctttaaattaattgaaccctgtatctttgtattatttttaagttcttttttctccttgcttcctcttaccattgagttcttttctactctatgttttacattcctgtttgtgataaacttgtccatctgtcttcttccttctgtgctttcctccatccagtgtctctatggtcagatcaggaacctcaagtagggtctgagaggaagctgcctggctccttgggaaggatggattgatctggttctctgctgtcggctacttttgcccagtggacatgcgaatggaggagccatttaaggtgaatagattcccagccaagtcagagaactgggacagtcactttgaggacactgctacttcttttgtgcttgagcttcactcattgtgtctactctgtaagacgtatttgaggccagatattgacatttttaagtcatttaatcatttcaaaatatttatagatgtcttaggacaattttttgttgcaagtaataaaaacccaactcaagctggataagcaaaacactgactttagtgactcacataattaataaatccaggggtagatcaaacacactgggcccaggtgtggaaataatgtcttccggaatctcttgcccactgtcccttgttctggccctcttctgcatcccatagtaggttcactaaaatggtggcaaagacagccatcagtagctgcaggctgagactttgccagtttcataatcccagtgtagagttttactctcccagaagtcctagcaaaatttctgagactgattattatgctcctgtccacctctgaatcattcatcatcactcaatccagggttgttcacatgccatccgtgggcccctgctgttaaaaccagattgccagattctaggacaggagtagttcctcaacagaaaataagggtgtggcttccaggagaggtaaatggatggaaaggcagagaccatctgtggtttacttaataggatgtagaataaatttacttgatgtgatatataaagttgtacatagtgtttatagaatttatttggtactaatacatagccatacatcattacctgcatttttacttgtaagtcttctttcccacaactagatagtaaagcttttaaaaacaatatctgtcatatctattggaaactctaaaactgagtatagtgcctgcacatggtaggtgctggtaaatgtttatgggtgctgctgaaatcgcaatttgcttctagcagcatgcacattattgttggtggcaaatactcctggagctataccatttggtgctggttgagaataagtgcacacagagtccatatttaatgagcaaaaaagagaatacagtggcccatatccgtagtgtagggctagtgagatgtgtgaacataaatttggtgcatacaagacatagtcacagaatatgcttcatgcacttaagaggaggagattagatatttttaaaaattcttctcgattccaaatactggctctagttcaagcagaattttgttgtggcccttaggtagctgtgccagacatctctcagctcttgaactatttgatgtccaaacattgaagagaatgggggaaaaaaaagtgaccggaaaaaaatcctcatagaacttcctgtgaatgggtcaaagtttaatcacagcaaataagacagatttcccttttattgtaaccacaatagaaaggcagggcttgtgtttacaaagcatgttgtttgggagacctttgtaaattgtaatctttggaaatcccaaacctattggatgtaatcccatccattagatgaaggcaacttgcctatgcaatagttccagaagagcaagttaaattgagaacatgaacaggaagtagtcattaagaattacaatgggtaggatgcagagttaattcagagagatattttgttattagataattacatcactaggacagctggaaaactgagtgctgtgctggactgcaagccttgttctctgccctgcagctggcgggtcaggacaatagagacagcaagagaacttactttgtgggagagttaggggcttggccaacttaattgtgaaatgataacgacctatctgccttttttggattgcattttgcacagctaaactgaaggcatagccttagttaatgccaataaccagtttgcactttgactttttgaacattcacttggatcacattatgctaagctctaatggataaatatttaatggtaattttcctttcctttaaaagtcatctgagatattttgttcatattcaatacattgtgattacatttttcttatggaactgctgtcatgtaattcttgaaatggtatttttgtcaggttacagattagcaaaaatttttaaaaaaaggttttagaaagtcttaaaatattggtcaatataaggaatcatgcagttgtagctattttccagttttttggggtttttttggttttttttgttgttgttgttgttttttgtttttttgttttttttttttttttgagatggagtctcgctcattgcccaggctggatggagtgcagtggcacggtctcggctcactgcaagctctgcctctcaggttcacgccattctcctgcctcagcctcccaagtagctgggactacaggcgcctgccaccacgcccggctaatttttttgtatttttaatagagatggggtttcaccgtgttagccaggttggtctcgatctcctgacctcgtgagccgccctcctcgggctcccaaagtgctaggattacaggtgtgagccaccgcgcccagcctattttccagtttttacattcaagtgttcagacctgtctggctcttttgttttgcaagtgtaagggttctaggtagcctagccccattccttattgatttatataaatacattacagattgtttacctctagccaaataccagggattttaattcatgcttagctcagttgttgtatatgaaactcatttgttatattaaagtttctggccgggcacagtggctcacgcctgtaatcccagcactttgggaggccaaggcaggtggatcacttgaggtcaggagttcgaggccagcctggccaacatggtgaaacccatccttactaaaaatacaaaaattagccaggcatgatggtgcatgcctgtagtcccagctactcgggaggctgaggcaggagaatcacttgaacccaggaggttgcagtgagccaagattgcaccactgcactccagcctggacaacagagtgagactccatcttaaaagaaaaataagaataaaaataaagtttctgttttctctttattgcccaccaaagtgactattatttgatttggggcaattccagagggagtcattgtagacaaaaaaaagcatcataaatattatagtctagcatttctaagattaatgtttacaaccattgattcaaaatgcatttcctacccattgtgactaatataactgttaatttttagtacaatgtttactaaccattaatcagacataatttaagtcagacaaaatttcatagttttgggaagagcaatatttccccagatgtcttccatggagtactaggtctgtaggatgtggatggctagccagcactggagccaaaaaagagagtatcctacaggcacccttaggactctgatgtcccttgatgccctttgtgaatgtctgagaagtctctaatatgctccatttcctgaatgaagttaataataatggcaccttaaaaattaaaaaggattatttccttgaacctggaggagtcacttctacctaataccattttttaagaatatgcaagtatatacattaaaatttatgtgaaaatgttctgctctatggactattacacatctctttaaaattccatgttttaaaaactaccgattgaaatgagtccttttttctccaaggtttatcatttaggacaattagtagtggcttcagtgagctcacctttcgtatcttgagcatccattgaaactgaggcctggagtccagttgctgcaggtggcatcagtgagtcttaatattttgaagagagcagtataactctgaggaaagcaacttgggtgggttagatgttatttttaaattgtgtcatgcaaagagtgcttgaaaacggtttcagtgagatgaagcaacagggcatactgccagggttgttaggtaacttctaagacaacggtccagggggcagatgactttttgtttcagcagtattttaggatcactttattctccagttatgcccccgtcagaattttttctcttttggaaattactataatatcttatatatatatatatatatatatgataaactataaatgcagtaagaactggagttactaaaattactattgattccaggtagtggtaagcaatgtaattttttcactaaatatattaattataatgggaaatatttttaaagtaatgtttcagaaacacaactgaaatggtcatagtatgaaacagctctgtgtttgtatttgactttagggacatgccatttttggttcactgctcttttattttattacaaaaatacaagcaacagatataaagaaagttggggattgtggaactccattttctttttcaataggaagaaaagagtgaagttgtccaagtatgtggatttaatagcaataagctggcttaaaaaagcctgtgaatagttgtagttatcttgaattatcaaggcaaaagaactgttttgataaattttccacatattaaatccatgcatgatagcaatcatatttttagagtgtgagacttaatatgatttatggtactatctttaataaatctgttaagagtttttactttattggaataattttccagaataagtaacattaggggaaaatattaagtttaggaatggatattaaaacttaaaaaccagaatgtttagaagtagataaatgtgaggaaaaaattttcaatggattctggttaattttaatggagttgtataattcaccccaaactgcccataattaaaaagaagcttggatctggctatgaagcatgtgtagttgttggtgttctgttttttgacctgccagatttaacctaattacagtggtggggtttttttgttaagtgttttttgtttttggttttggtttttttttttcgtttcctttaaaatttagtatagattcacagagaagtccaaatgtggggtccataaagcccagaaatgcagaaggatgacatggtgaaccagcaaggcattaaaagtttaacagaggtcctaggaatacaacccaaaagggatgtgaaggacctctttaaggagaaccacaaaccagtgctcaaggaaataagagaggacataaacaaatggaaaaacattccatgctcatggacacaaagaatcaatattgtgaaaatcgccatactgcctaaagtaatttatatattcaatgctatccccatccagctaccattgactttcttcacagaattagaaaaaactactttaaatttcatatggaaccaaaaaagagtctgtatagccaagacaatcctaagcaaaaagaacaaagctggaggcatcatgctacctgactttaaactatactacaaggctacagtaaccaaaacagcatggtactggtaccaaaacaaatatatagaccaatggaacagaacagaggcctcagaaataatgccacatggctgggcacggtggctcacacctgtaatcccaacacttcaggaggccgaggtgggcaggtcacctaaggtcaggagtttgagaccagtctgaccaacatggagtaaccccgtctctactaaaaatataaaattagctgggcgtggtggcccatgcctgtaatcccagccactcgggttgggagtagtacttggctgaggcaggagaatcgcttgaacctgggaggcggaggttgtggtgagccaagatgtgccattgcactccagcctgggcaacaagagcgaaactccttcacaaaaaggaaaaaaaaacaagaaagaatgacacatatctacaaccatctgatctttgacaaacctgacaaaaacaagaaatggggaaatgataccctatttaataaatgatgttgggaaaactggctagccatatgcagaaaactgaaactggaccccttccttataccttatacaaaaagtaattcaagctggattaaagacttaaacataagacctaaaaccataaaaaccctagaaaaaaacttaggcagtaccattcaggacacaagcatgggcaaagacttcatgactaaaacaccaaaagcaacggcaacaaaagccaaaattgacaaatggaataaaattaaagagcttctgcacagcaaaagaaactatcatcagtgaacgggcaacctacagaatgggagaaaatttttgcaatctatccatctgacaaagggctaatatccagaatctacagggaacttaaaacaaatttacaagaaaaaaacaaccccatcaaaaagtggacaaaggatatgaacagacattttctcaaaagaagacatttatgaggccaacaaacatatgaaaaaaaagctcatcatcactgttcattagagaaatgcaaatcaaaaccacaatgagatgccatctcacaccagttagaatggcaatcattaaaaagtcaggaaacaacagatgctggagaggatgtggagaaacaggaatgcttttacactgttggtgggagtgtaaattagttcaaccattgtggaagacagtgtggcaattccttaaggatctagaaccagaaataccatttgatccagtgatcccattactgagtatatacccaaaggattataaatcattctactgtaaagacacatgcacacatatgtttattgcagcactgttcacaatagcaaagacttggaatcaacccaaatgcccatcaatgatagactggataaagaaaatgtggcacatatacaccatggaatactatgcactcataaaaaatgatgagttcatgtcctttgcagggacatggatgaagctggaagccatcattctcagcaaactaacacaggaacagaaaaccaaacactcatgttctcactcataagcgggagttgaacaatgagaacacatggacacagggaggggaacatcgcacaccagggcctgtcggggtgggggggttaggggagggatagcattaggagaaatacctaatgtagatgatgggttgaagggtgcagcaaaccaccatagcacgtgtatacctatgtaacaaacctgcacattctgcacatatatcccagaacttaaaatataataaaaaaaattaacggaggtaatatgtaagcaggataattgatagtcaaccctgtgcatcagttattggactctatgcacatttatagtttctttgaagaaggcatttattcaattttttttaaaaattaaagtaatatgaatagtattttattagctttttcttagtatttatattacattcttgttaagaaatgtacttacagcttgtttatgggtagtttaattcttcaaacatttggtgagaatctgttgtgctaaatagtgtactgtggttgaaacgaaaggaaattttgtcctttggcttgaatattcttttgactcctgaaggcttagtttttaaaacttaaattttgtcttattttaagatttttatggaagaaactggattcacccatccaaaacatttgttaatctgttgctttattatttaagggcaatatagtttaccaatgcaggtccccctacccctgaaaaaaaagtttaaattttacaatgttgattaacatggtattggaattttaaaaactaagaatgtatgccctttccagggaatgatttgactcagcaggatgagggctgtcttagaaataaactaaatttctccatattccatcatatttgttttcacagacatggttgtgacaccttaaattccaggaaaatcttgattacaacattcagcatctccaaaggatgctcaatctatctctagtaattctcaaactgtgagctaagaagaaacatattttgcctagacatcaagtttttgaaattatccccattggcaagttctatctaaggtcctaactaaggaaactctccaagcgttcttgtgctccaagcgcgttgctttctcattgttactatagatgttctcatgcttaaccgcacactctgagtgcccctctcctgaacttcatgttgttattaaagtatcagatctcatttgatatctttacatatgatcacaagaaatgatcaacactggccttttttttctattatgagaccaaattgagcgatatgtataaaacatacaggttacttctttgcttattgccacctacttaacctctttgttttttcttctaggttgtttgatgtgtgcacagtgtcacgaacagacagagaaaccaaactaactttagtgtttgaacatgtcgatcaagacttgaccacttacttggataaagttccagagcctggagtgcccactgaaaccataaaggtatcaagaatcatcttcatgtcttatcaggcagtcgactattatagtctgttaagcaatggctttctttccttatgaaaattgccacaattacaacttttagaattcggtatatagttaaaaaaatcaaagaaaatgttcaaagattgggatatattccagttcatcaactaagtgagatgttcaaagtacagacatatgtattctagttcattaattttagaactaagtggaaaaaaaaacctttagttctaatgcatattaaaattatttaaaaatacttagttgtagattgtcttagaccttaggaaacatagtttagtaagtatagctcagtcttcttctgatggtttattgtctatgagagacataatttgaacattattcatgagcacattgtatattatgattgtataataactccgggacaacctatgctatgtgaatctgaaatattacttgttaggccctccttctttcttcatttttcttattcataaaacgtttatagggaagcctaagtaaccagatactatgccaaactcctgggattcaaagatgattgagacatgctttctatccttagaggtcagtaaactagatgcagtatattgactggaagttcttcctacctttaagtctaatggaaaatgctgctgataaagttttgttgttatttgcattctgcttaactgaacttccccgtagatcttttagatttatacacatcatgtgcgggtcttcatgaaaacctttttgtctgtgtgaattaggtagcttaaacagactcctgccttatcattcgttgtttagaaatgagttatagaattcaccatcattctagatagaagttaatagctaaaaatagtttatcttctcaacagactaagaaatgtctttagtgatagctaaatgacgttctcagatactgactgatacatttagaatttgacatactgaatgatttattccttttgttttagattaatattgtattttttcccatctggctctcattaaagaatctggtgcttaacaatagtcccatttcttcctgagcagtttcaaggacattaaggccctccaaatgtaggtatgcctgatagttacctgttcttggccatcttctgtctgtgcacccctctttcctctggcattctattccacccctgaagctttagttctctcctttatgagtttgtcagaaaccctgtgttcagcatgcagagcagggcatagtcctttttcttatacagttttctaggcaaattggactgctcatcattctcttggtatgatctgtgattttccaccttggtggccttccttctcatgccatttcttttgctccttctcaccaggctatctacctaaatttttcaagtgccgtctcaaaagccatttgatcaactcttatagctagatgtaatctcacatgccttataacacttgttctgcatatctctacctctttatcttgttttctgcctttaattgggattttttaatgtacatatctcatgtattcagtcatcctcatgtcctgacagtgtcttacacaatgatttatacacataggtacaaagtaaataagacacattgtcaagctttctttagatgtaagtattttcaaaattatttttaaaatgactttcaaaggctttaaacatagactatcaaaaaatcattgacattttctgatacatttctaagttcaaagttatttggggagtatcttttttttaaaaaaacagacagatgaggcaaccatatattttatatcttacattaccacctacatagatcttttgagcattatattaaattatcctagtatattggaggctactgagtggaatcatttgcaaaggcatctgtgcagttaaaatgttgataagccagagtggtttactagactcaggtttgatcaggcaggagtagaaatgaattggaatggggggaatctcaagggtgagggtggaggggcaagcaggataggaaaaggaacaggcagaagggtggtcaccaaagtaagaaaggggaggagaagacagggggcagtggctgagccaggatggagctggaggcttgctagaagggggtgattgttgccagaagctcttgaacaaggtgacattaaaagttaatttttttttttttttgagctttttgtctatctccaggaaagggaatgtcacttcattccgtgttgaacagggattgtcctggaggctgttaaatttcttcagccattaggatcagcaccccttgatccaaattgtcagatacgaggtggagttgggggcaaggggctctagttattgaaggtttgtggctaatgttgtattgatgttttcatagtaaaataaaccatagtcaaatgaaatatttcaggcagttaacttacatgttagtggttaatcaaacattttttgctaacttaaaagctaattagaagactcttttatcttcattcttaatttaaaaaaaaaattctgaactatactaacctactttccttccttattaaatataaggttttttaaaaaataatttgagtgtttgtgatgctttaaggtcattgttgaaaacttgaataatcatttaaaagcataataaaaccatcaaatggatagttttaggctgaatatataactgatacaaaattatttttaatcaacactcgtatcttttgtttctgtgattgacttgtttttaagaattggaatgcagaataaacagctgctaagtaggagaatctgaattctggttaattgaaattttaaagcacacagccagagaacagaaatattttgttgttatataggctcatttatgggaagccttaataactagatcaagcaaatattgttattctgaacaacctattgggaacacagaaattgattctttatatagaatgctctgttggaataagagcttctctgactatactcgtacagatatttattgaatattcactctgtgcagggagggttctgtgctaggcagttcagggacacaaaattgaattaggcatgagaaagagaggacctgctctgaaggacctttagagtataagagaagagataaaatgcaaacacaagcctgtggtacacattctgtatggttatttaagtagtttaggggtattttcaagtcaagaacagactacttatgtataagtaagcacagtctatattgtgccaaactattttttaaaatacttaaatttaaattacttttcaaaggatccaaatcataggtattaatattgacattgtcttgcatagattaaaacgtatcatgttgttaaataattatacatatctaagatatttttatttttttttgagacggagtcacgtgtctaagatattttatttttatttatttttttttttttgagacggagtcacatatctaagatactttatttttatttatttattttatttattttttttttttgagacggagtcaccaggctggagtgcagtggcgcgatctcaactcactgcaacctccacctcccaggttcaagcgattctcctgcctcagcctcctgagtagctgggattacaggcacgggccaccacgcatggctaattttgtatttttagtagagactgggtttcaccatgttagtcaggctggtctcgaactactgacctcgagatccgcccacctcttggcctcccaaagtgctgggattacaggcatgagctaccatgcctggccagatattttaacatgaaatatatataaaatagaaaatcaaaacaagacctcatctaagatcatttaagctcaggggattttcctctacccactttcctctacccagtgttgtgttttctgtggcactgtttaccagttaacaggccactgaaactcaggatattctaatgcacattcaggacataaattgcattagttgggcagtacttggataaaactaggatgctccatggtgtcttactagatatcataggggtaacatcattttgcttatcatttcatcaacacgtttgttagaaaagagcccatgatgatcttacttttctagcttacttatatcacctaacagtttttgaagtgcacttaagtgccatttgttttcgaaaaataaaaaagacattaaaccacaccataagccataagtactaataaaggttgatagttgggtaaacttattggggaaactctaattattgcacggtgctcatgtgggactttaataaagtacattaagagtataggcctgaactgaaaattttcattgagaagttcatgagaataaaataaaatcataggtgattctttccaacatcattaaatataccttattctaaaaaaaaaaaaaaaaaaaaaaagcatacatagaaatcacattcatacttcatcttggggttttcatcacattatttaacctcttttcttgatgtcctttaggtgcatccattcttggttgacaatgacatttgcataaagcagcctgttggctgctgtcctgtgaagtcaacagatattctaattttccctcatagacttattgttgacatatctggctttcctctttctaattcaggatattatctttgggtctgtttacttgtggaggagttcagtgccatctttattaaatttttattggctcatttgagatttaatattgccttcctgggtttccatgctgagatttatgaggcaataattgacaccttaatgattgtgttattttttcttttagagtacgtgataaattcagagtatctatgcttatatagcaccttccatttatggagctttatgagaaaaaaaaacagctctcagatttttatttttctctttcatgctttcatctgccatcctatgagagagggtcagaaagaactgtaaagaaatttgctcaccatttttcttagtaatttgtaactgccacccagaataagaactgtacactgcaagatacagatggagagagactcttatgtaaaatattctcctgtacaggcttttccaaatgtaatgccctcttttactaaatcattcatttggtatttagtcttgtctgtataatacattaatctttcctaggatatgacctggcttctcaactattttataaactctttgaaaacctaaaattattctgtggacattctgtgcatgaaacatgtttgataaaaaaaaatgtttgatgcaattgtcaatatagtttcacaagtttgaggcactgaaaggtcacacaaaagaacagcagcctctaaaataggacagggttctttgagctcaagaccatatggcctcttttgatgattcaatcttggaataaaattttttttatttatgtatctttatgataaatgaattctatagagcttgagagggccagaaaagctccaggttcatgtctgtgtgggtcgttttctctgtgaattagatttcattttatcttcaattgaatgtttcttagagttttctattggttgtaatatttttagtaagagataaaacacactattaggtttattttacaaaacccagacttcagaaactgacacacactgttaatagcacctgttttttgcctctgggaaatgtctgttttcatgaataatatctgcttgcagtaaacagtggctctgatgtcagtatgggatgcccagggctgattcatctttctcagtttgacataatgcaaagtgactgactggtccctgtactgcagatgaggaaagcctctcagatcttcttctcttctcactcctaaaggaatcaagccatggcccctctcagctcctggtggtctccattttgcctgaattacgagcaggtgatttgtctcatctttgcaggacacagagcaaattaacatgaaaatatcgcttcccagaaaacaaggcaggcttgaatgccctgtcgctgctggtcattagccatctgccaccgacactcatactctgtttatcacatttgaaattcagagcagatgttgcataataaggtgatcccaaaaacaaggcaagaaattcaaagaacaaatactctaccataatgataaagatcttggaaggaaatttttttcaatctaatatcatagctgcactaattgaatagaccatgtttttaaaaacacacacacatctctcctggtatttgatgcaaactacttttcatagtaacaggaaataattttaaaaagaaagtacatttgtgaaagacacctgagaggactgttcaataaagtctctttaaagaagcaaagtcgaatgttggaataacatagttctggtttaaaagacctcatagatcagtgatgccatcttttactgtaagatgggccttaacctacagcaatttgacttaaaatagttcactcctcacagtatagtagatctttcaaggcttttaacttgcgaacgtggtttcccagtttattttctttttggcactcaagaccctgtgttttctatatcctttgttttcactgtttacccctctacaaactcccaccaccgctatcagcctcccaccttcagcatcccttgtctctccagaactctgccccagcttaccctggccttaggctctctccaacctgagtcccaagattctttcatttttagttcttctgcccttctccattaatgtagctttttacagtattggttattataatgttttacctagttgatttatgcacattgtagacccttattatgccttattcaaagtatatcacttatagtatattaactatggtgtttagagacattctgttttttttaaaaaacaggcatccaaacttttaccaggaatgtgacctatattctgtggaagacgagcttttaatatagtcttttgactccaaagaaatattttctccacagaaaccacaactttactgcccctccccactctgcacccctctgcccccacacatactgagagttttgaaatttggggtttttttttaaagactatactgctaagcaaaaattaagcagccagcctgagagtagacagggggataaatcaaagcagtgccagcagctgaccactgagtggaataggagagatgatttgaaggatggaagaatagtgagtcaatactgagtatattccaaattcagggggaaatgtagagtgagtgagctctaacaactgtgggagtttatactactaaagtcagaagcccagatctaaagtgtagagagaaataaaatcttcagtgtaacctttctaattagtaagatttcagtgtaatcttactaataatttccatttgtttccctctgctccaatcaggaacatacatattgtgctttcaagtatctttcattccaagggaaaactcagtaactcaagcaacttcttaaaggagaacatttttatgcagtctagattctgaagactctcagaaataaatccttttgcaaattcctaacccttatagtagctgaaaatatcagaagagaaagaggacagaattatgcatgtgtatgtatcctaacaaaaaatataacagctatttagtaggttttttaaaatctccaatcctataaaaagctacattaatgtaaaagagcagcagaactaaaaatgaaagaatcttgggacttaggttggagacagcctaaagccagggactaaaaggaagctggggcagagctatgcagagccaagggaacctttggtggggtacagggggttgatagtggtggtagggggataggaaatatgggtttaagaaaagctagtttctttctaaaggtactgtaagactgactcactaaataaataatgactcactaaataggcaaatgacacttagattcagctaataacagataagttagaatctctttagaaaatgcttcctcaccctaggcattgaatctgtttacaaagtccattaaaacttgcaggtagtatatacccgtttatatcaccatggcaacagatagcagagtgctcttctgcgtagaaggaaggctatttctcatctaaatttagcctgtgctaaactccttggttgcagtctctttttttggctcttcttcctctaaacatgggaacatccaaggcttcactgtcagccttcttcttttccttggctacactttctaatcaagtgatgtcatttagtccagaatcttcaaatacctattctccagcctgacgtctcccacatgctcttggtacagatagtcagctaaccatgtaaaacattgaccgagaatcctctgccaaactcaagccttccctatctgccagttgtttgagccccaagtttaggcataattcttgattttttgctttccttcacagtcttcatccaatccatcagtaagtgcttttggtgttatccccaaaagatatccccaatctgactacttctcaatatcttcattgctatagttctagtttaacccatcaaccagcttcctaactcaacacaccacttctgctcctgcccctttatggaccatcctctgtataacaaccagagggaccttattaaagcagaaataaaattatctaacttccctactgaaaacttagctccagtggtttctcatgacctgtagaataaaatcagaagtcctacatgatctagtgctccccaccccctgcctttctgatctgcctccactcttccttgggcccacggttctccagccacagtggccttctttctgttcctccagcttgcttctagctcggcatttgtccgtgctgatttttcatctgtttggaatgctccacaccctctagctcatgtcatgtcttcatcattccttctctgaccctctcagctacaactccacatctagttatagtttatcacattacaccacattatcctattttatcttcttcttcatagcacttagctgaaattatctcatttattttttatgtttgttttttaatctttcccaactagatgagactttaagtcaagactctagtccattgcactagctccagggccagcatactgcctggaacataggggatcctcagtaaacatgtgtttgtaactgtactaggtgtttatcttctaattaactcagaaatgtatgcatcaataccaccattgtacaagccaggaaatggtactttttcaaggataaaatttttaaatatttatattacagaaaaataagctgaaggtatgttgtatcttggcacattcactttgcacttgcgcattcagttctctgtggtgggccgggattctgggattatctgtgttgtagctaagaatatagcttggtttagaaatagtctaaaaccaataactgatcctaccaaaactataagatatattctccttaaaatagtactaattccaaaaatactaactgaattccagaaattgttcttccccggggtgggacgcttaaatatgttttataccaaggatggagaactaagctcagtgaagagacggatggatgtcatgaattttagaccctattctcgtatctcaggagtatatatctaaaaaataattttgtagtgatacatgtttttcattttaaaattactttccctatatcccaattgtatgctgtcttccccattcccatcacgagaactagaagcttcaaaggaataagttatttttttaaatctttgaagtactatactatatttattcatttggattttatcattcttacccagaaatttcagatgcccatatatattaagttgaaaaaaaggaccattctactagagcaattgccaacaatttgcaatattgtcattacaaaattttaaatcagtgaaaggcatacaaagtaggtatccatcagttatctgagatagtatcttattcctcattcctaagcaaggtggaaaaaattaaacaatcgtttcattgcagttaagtaagtaattactggttctagtaagtaattgttgaatgaatatgtggtttcacaaaaagttgtataatgaagccttgcaaaccccatagtgccagttatgagaatctggtgtcttcagtatgtagaataatgttgtagttactgtcattctgttcttcctcttcctcatcatcaccctctagaagcaaaattgtcctgaaagattgattcttacggtaaatcaagtgaggaggagaggttggcctgaatatggattcatatatttaattaaggacttagcatctgggcactgtgacacttggagtttagggagtaaaagagaattccttgaatgtcagaaatgacaaagtgggctgggcgcagtggtgcacacctgttatcccaacactctaggagaccaaggaggacgcatcacttgagcccaggaattcaacaatatggcaaaacatggagaaaccctgtcttgacaaaaaatacaaaaattagccaggtgttgtggtgcatacctatagtcccagctgctcaggagactgaggtgggaggattgcttgggcctgggagattcaggttgcagcgaaccatgatcacacccctgcacagcagcctgggtgacagagcacaagaccttgcctcaaaaaaaaaaaaaaagacaaataaaccttggctactaccatgtaatggttagattaattaggatgcctggaaaatggactaaacccaacaggttttttttttaaacccaacagattttgcaaaaatgagtaactatctaataaagggttgataaaggctttgtaaacactatgctttgtttctccaagtgtggtcagtgaatcaaccacctggggtgctcacttaaaatgacaatcctgccctaactgattcctcattgtcaaacatagtctcaggagggagtttctaataagtaccctctggtgacaccagacactgcagcttaagacatactcccaacccccgcagtatgtcatatgacacaagtgggaaatggaaaacatctcccttacattctgagatgactcagacatctggaatatttgcttgcctgtgcattggtaaccccagccaatcagtaggtttaggcaatctaagcccaggtgaagtcaggtgtggtgctttactaacgtcattgatatgtaggaaatttgtttaaaggcactgaagttttattccttaaaatgttctattgaaaaatacttactcattaataggagatataaattaaagagatgcttaggaataggagaattccaactaaaaatttttaagccacacaaaaatctttcctttaaaaaagtgttcatcactcattcatgatttgacctttgaaagttgctatttgtttcatatacactaatgatttaacagttctctagggtcttaaattagtaaaccattaccagacttgcaagtgtaatgggtcagaattcctactcctgttttattggtaaggaaccaaaactatattaaatttaaatatatcatagtcataggtttttagtgctgacaccaatgtggctaaacctagtactctgaggctcatatattgaaagccatgagtactcagaatctaattttcttctaattgtcattctaggcctttagcaaatttaagctagcagttttgctgatttttatattaccagtgttcactgttgtcactggccatacttgttaattttttatttcttggccaaaaccaaagaaaatatttatcattctactgtagtatagtcataccacttttagattagaatgttaaaccaaatgtagcaaagattggggactgcaaggcataaaataatgtttaggaactgcaacattaaaagataagtttactattaagcaatcagatttagatcaatctggaaatagctatcctcaatttaagatgttctaggccgggcgcggtggctcacgcctgtaatcccagcactttgggagattgaggtgggtggatcacaaggtcaagagttcaagaccagcttggccagtatggtgaaacctcgtctctactaaaaatacaaaaaaaaaattagctgggcatggtggcacatgcctgtaatctcagctgcttgggaggccgaggcaggagaattgcttgaatccgggaggcagaggttgcagtgagccgagattgtgccactgcgctacagcctgggtgacagagcgagattccatctcaaaaaaaaaaaaaaaggtgttctatgaatacggttagtatggaataaacacttgttaaaattttaatttcactaatatatcatatgttaatatttaagtctggaactgagaaattcaccattactcatagctgaagacttgaaatgtttgttgagactaagatggtataaaagctatgagtgagggccctgcttccctctgcttccttcctctaccaaaatatattccgggtcgggaggatggggttcaagaatagggaagaaataggttggtgatcacaggaagagaattggttgaatgagtcacaaaaaagaaggagagatttatttaccataaataaaccaaaaagaaagtgcttttttaaaaagcatgtgattatgctgagtgtaagtgcctgaaacattacattgctaattcttgtcccccccattatgattattactctgatcatagcaattgatcttgtaaacctcaagtcctttaatatttcaaccagaaactaaagatgagttgacttatatctttagtacaaaactatgtaaattgaaataaacaccacagaaggacataaatatcagttaagttttgtctttgacatcatcttttcttaatgttgccactatactaacagcccatgatatgcatcttatctttgctgcaaaatcctaataaaaacacttgggaacttggaaggaagtaaaacacaaattacattagagtgaattaagaaaaagagttgcattttggtatcctcccaagtggggagatttatgagagcatcacacatgaagagaaaggacttcttttttgtttcaactccaccatcactttctccacagtttcactggacttcttactttatttatcaccaagttctataattaacatatggttcatgttattgatttctcaggtttcaaagtaaaataaattgagctttcttccacatttagaatatacagtttttttaaggaactctaaacaaaggcacacattatttgtaagttggagagcagctgccagaaaacagaaaattaggaatggagtcatgagtgaaataatggagatactgttcagaggtaaccctttgtacagcaggaaattttccttagaaaagaagacagctgagtttgcttgtaaattttgctagaaacaggcctgatttagtaacatttagtgctggttaggaggctgaagacaacactttcagctttggataccaaacgagtggcctgttttatattttgtacacagtctaaatactttatagtttcaaaagatatgtgtgtaggagagagctattattaattttttaaatgatataataatatgtaaacaaatatttttcagatctggtagtagagttttctaagtgcgaaacagtagaaaatatcgcaaaggaaatgattcatgcattagactataaaaattttagactgaaaatattataaataaaactaaaaagcaaatgataaaatatttgcaaaaactatggcaaaggtttaatatccttaatatataaaaagctcttacaaaccactaagaaaaaggagattacccagtttagatatggataagaacatgaacaaatttgcaaagatgtacatatatacagaacgctggtagacatgggaaatgctcaacctcccaaataattagagaaatgaacaataaaaaaatgtaccataggggatgattaaatacattatgaaaatttatctagcaaaatgaatacatctcataggatgatttttcaaaaaatctcatattgttgaagaataattgcctaaagaaatacatatatacaatatgatcccattttgggaatgtatttcaaatacatatattaaaaaactagcatgaaattattaacagtatatatctctgtcagggtattatgggttccttataatttattgtttacaatgggttagtgccatacaacattaaaaccctttgacattcccaataattgactggttttgccctacaaaaatgacagtttcatataattcaacccaatatttttataatccaacaaaaggctgttttagcatacatcttattggggaatgccctctattacagaaaagttgaagttctcacatctgaatctttatagcccaacataagaattaacaacatagtgtcacttcctttgctcttaggcaacacaaagggacaggttttgtaaaataatcagtgtgtatacattaaaaacattcagtacatgtttactgatgatgatgatattgataaaatagcaaacattgaaggactaggaaaaatgatatgataagttttctaatgagatttattgacaccattgttatctcctttagtcttacaaacattttaccattaaatagtataattgggctatggagaaatttcacttgattgtaaatggaagcaattgctgatgagagtaaatttttaaattaatgtctgtgtacagaatacagtaaagttgcaagcctatttttactacaatgacagttactgatacagggatttctgtaacaatctctaggctttcaatacttttaaaatcctggattagcaggtacagggagattgtccgtgaatagataagatattatgaatgctgaattggtttaatgaagcagtgttagatgtctttccattttcagtttttcttgaagcaaaatatttaatttgagacttgaagtgctaacagcaatcttcattgtatgtgcatggccatacagcaacatgtttgtatataactccactgtccactcaaggacaatatacatttctttcaaattaaatgggataaaaggggaaagtgatgccaaacaaagggaatttgtgtgtatggtttttttttaagctttcttttttctttttttttttttttttttgccttaaagtctgttgttccatcctactgtggccttttgaaagtatgaaggtgaaaatagaccagtatggataacagtaaatgaaaactgctgaggacacatcacttgcagaaagataaatacccatagttttggtaatgcccctgttggatttagaaaactggccccaccacacacattttttaaaaaaaataacttttatcccagaccaaatcatttctatagtagctaaaattggtgtgttccagactcgtcctgtgagcctatatgccatcaaagcagatacacttaaggtggaggcagcaagccctgatgctaatctgaaacacaggttaaaggagagtcctatttcactaagacagaaaccactaagcttttttgcctccagccaaaataacaaagtcctagcctttggtgattgatgagcatgttgccaggggaaatggactggaaaatcatcgccttgtcttttacttgccacaggaaagccataacagagatctctattcttcttgttctgataagagacctaaggaagcatgaagaagggctaagaagcctgggtgtgtgttatattcagctgcttgctggattgccttttaaaatacaatttgtagttccctaactcacaaatagaacatggatagttggctagcctttgacaagccatgcagctttttaaccacagcttcagcaaagttttggggtataaaatcagtgtaccaaaatcgttagcattcctatacaccaccaacagacaagccaagagccaaatcaggaaggccagatcccattcacaattgccacaaaaagaacaaaatacctaggaatacagctaaccagggaggtgaaaaatctctgcaatgaaaattacaaaacactgctcaaagaaatcagagatgacacaaacaaatggaaaaacatcccatgctcatggataggaagaattgatatcattaaaatggacatactgcccaagacaatttacagaatcaatgctgttcctattaaactaccaaagacattcttcacagaactaggagaaaaactattttcaaattcatatggaatcaaaacagagcctgaatagccaaggcaatcctaagcaaaaagaacaaagctggaggcatcatgctaccgaacttcaaatgatactacagggctgcagtaaccaaagcagcacggtactggtacaaaaacagacacatagaccaatggaacagaatagagagcccagaaatgaggccacacacatatgaccatctgcccttccacaaacctgacaaaaacaagcaatggggaaaagattctctattcagtaaagggtgctggaataactggctagccatatgcagaagattgaaactataccccttctttacatcatatacaaaaatcaactcaagagggattaaagacttacatgtaaaacccaaaactataaaaaccctggaagacagcctaggcaataccatccttgacataggaatgggcaaagatttcatgtcaaagacaccaaaagcaaaaattgacaagtgagctctaattaagtttatgagctctgcacagcaaaagaaactatcacagagtaaacagacaacaccctacagattgggagaaaatatttgcaaactgtgcatctgacaaaggtataatatccagcatctgtaaggaaattaaacaaatttacaagataaaaaaattaaaaagtgggcaaaggatatgaacagacacttctcaaaagatgatatacatgtggtcaacaagcatatttaaaaaaagcttaatatcactgatcattagagaaatgcagaccaaacccacaatgagttaccatctcacaccagtcagaatggctattattaaaaagtcacaaaatagcagatgctggcaaggttgtagagaaaagggaacactatacactgttggtgggagtgtaaattagttcaaccattgtggaaatcagtgtggcggttcctcaaagagctaaaagcagaactaccattcgacccagcaatccctttactgggtgtatacccagaggaataatgaatcattctaccataaagacacatgcatgtgaatgttcattgcagcactattcataataacaaagacatggaatcaacgtaaatgcccatcagtgacagactggataaagaaaatgtggtacatatacaccatggaatactatgcagccataaaaatgaacaagatcatgtattttgcaggaacatggatagaactggaggccattatccttagcaaactgatgaaggaacagaaaaccaaatactgcatgtcctcacttgtaagtgggagctaaatgatgagaacttatgaacacaaagaagggaacaacagacactggagtctacttgagggtggaaggtaggagaagggagaggagcagaaaagataactgttcagtactgggcttaataccttggtgatgaaataatctgtacaacagactcctgtgacacaagtttacctatataaaaaatcttcacatgtacccccaaacctaaaataaaagttaaaaatcaatattacagtactttgttatcagaaagcacagatccttaaagactatattggcagtgaacttttttaaaaggctcgggttgcattatatagtatattttggaaatgtatttgtttaagagattagcatttccaattccatgacttcttcctttgtgtttttttccaggcctgtgtttcagttctgggttagaaacattttaaacctttcctaaattcagtagctctctcacaaattatatttagaaaagaaaagccccaccaaagttattcccagatcccttatccagtggaggtgggtatgcatactccgtttcttccccctctggtcttgcgcttcttgcccaattgaaatggagaattttgttaatcccatttgttattggaaagatagattgcctgtccctttaacaggatggccaaagaatgacaatcctgagcccaccactctaatgttgcattggaagagttcccctggaagtagaagcatacatcttccttctattaataccaacagtgaacctgatacaactctttaagttattgcagtctcttctcttttattctccaacaaatgagagccctgtctaacctagatctaaacctacattgttcattgactgaattccctggcttctgtgagggttccttattttcccagaaactgggtaaagccgattcacatcaactggttaaaactttgaatagaagaaaaagtgaattaaatagattcttgtttttatgagcttctccactacttcagagcagcaaaatttcactacatgccatgcccagccacaaaattgaggagcctgtttgttgtgcctttttgaaatggccttagggcttcccaaatttgttgtaaaaatcttaccaatgtaattttcccattacacctttcccccttttctccttaaacttgacttttgagttgtacacaagatcatagttaggtgagttttttgctgggtctttttttctttttttttttacaattttacatgcctctattcactcatctgtgcctaaatcagcagggcctaatctataacagagccacctttttaagtgaccgccagctgagtttgatcccttattatattaaagggagaaagtggactttgccaaggttggggcagattctccaaccttgcaaaacgttgtgggcaattaatgggcttgaacatgaggttcttttgtgtgtgtgtttgtatgtgcacttgtatgtgcaagaaagagtgaaagagatacccatgcatagaatttttaaaccgggcagctctgtggtagttagctagaggcaagagataccctgttggctcccagaccttcctggaagctgactgttggaaaagactccttggagataaatctcatgtggttcccttttgcctgaatggtatccgcaccccaacttataccttaggaggctttggaagaggaatactttttatatctaatgcactttggagattggagtcctgcagcaatttgccactcaggaaaataaactagcatattaactcccagcaaatgccacctccttggtttgaagcggtttgtaaagcattttcttcctggtttgtgcgcaccacattgtttcagctcctctcatcactgaccagctggcttgttggtgaatagagctgtgggcccctcgccatgtttcatgtgaggtcttggctgggtggcaaacaggcagcctgtagccagtgtcagcaattcaggaggaattggcacagcagtgtccccattaatttctgcttgtcacatactgtcatgcaagttacaccagagaggaaatgaccgttaaaaaaaaaaggtacccttgtggcactgggtcccctccagacgttccccgaggttaaacaagtggatacaattagccctacacagacagctgcggggaaaggaaagcctagaagtgggccccacagcaatgtgtctttcctgttagcaaggagtgtcggctatcaacatctgccatattttaacccttcaaagggaccagtaaattaaggggagctattatcccacgctctgctgatcattatcaatcataatgccttgggaaattaccacagtgctgctgccttggtggcaggttttgtcctttgggggatcgtttttatgtttttgctgagagcagagaagagtggtagggccaagagggtgaaaggaaatggactctgttaattgttggtaatttactgccacagggaaggggactagagcggcaataaactcctcctcagctcaaactgaagtagttaaaattggtgggctccagacggcttccatttccagaaagatccatcttgctgactgtcaacccttctttaccacaagctatggtgacttttagggagcacaaacaagaagagactttgggaaatgagaaccagttatagaggagaaaggcaatccaagatgagaaaagaaactctaaaatacaggcttccaaaaactgttgttttattttttaaagattgaattaagctgctgttatccaaatagagtcctgactaacctttataagcacatactgtgctttggagtggctttgtctagtgaaagtctgattaccagcacagagggatgggtgactgagatggtcctgtgtgaaattatgtttgttccaacttactcaattgaactaatcattaaaactgtttacagaaagaatgggggaaaagaatggtttcttaccatgttttaacttcaacaggttttgcgttcatttatgtagacctggaactttctcctctgaaaagagaccattttgctttgggggcataaaaatgacaggagttctgaaaatgatcaatactaatgagtacaggaaaatgagctgatgttcatctaaatgattgcaccaaagacaatgcagtgcagggaataatcatcttctgattttactgagatgcttcctgaatgttactgaggaagatgctggcaccatttaaaatatttaagtgagggatagaagcaaccattaggataattgagtggaagtaacagtgttactgtgtttattgagacttcatctcttcctgtgtggaagaagtgacaggatcaccaagcagagcctggagagattgtcagtgatgaatgttagggctgttcccatcctatgacattatctagtctgagaccctcattgtatatgttagaaaacagaaatcagaggttagggacttgtctatgatctcacaatgaagcagaggtggaacacaaggtttccattcccaggtgaactgtttatatcattccatgagctgactcagcacaggagttatgaccaatactagcagcaacaaaggggtcctcctacctcattgaaagcagggagtaggaatgaaccacaaatctgaggtagaaacggctttcttcaatacttctgccatgatgtcaggcaggaaacttgaggcaccagttttagttggccctcttagagcaagagatgccaatttcaaaaggtagtcttcttactagctgggcgtggtggtgtgcacctgtaatcccagctactcgggaggctgaggcaggagaatcgcttgaacccaggaggcagaggttgcagtgagccgaggttgcaccactgcactccagcctgggcgacagagcaagactccgtctcaaaaataaataaataaataagataatcttcttatgcaattttaagtatatctaaaaattgagaaataaaagtatttctcaaaataatgtgtagattctgagaaatttgcctcattcggtatttataatttttcaaatgttagatcacaaaggaaaatcagtaaggtacacataaatgcgagccctcatgagtatgggctcaatcactaattatgggatctctggtcttacagatgggtagactgtaaatgatttttcatctactcttgttgctgatctctgattttaggggatcatcagtaattgaattctatttgagattaaatccacttctgaacatcaggttgtgacatttattaagttattaaatcatatgcttcagtattcacaggtgaagcatataatttaataacttaataaggtcacaatttgatgttcagaagtagatttaatcaccataaagtaggttgtttctttggttaaatatgaaaatatagagaaagtaaataaattaggcttgcttcatgtttaaaaagcattattatttcagaattgtttctttggcctaatttcaggatctgtcgtataatgtcaggcttcagttgaagcagttacctgaagattgtgtagactctagaggaataccagaggattggaaataggaatagcagagaaaataccaatttagtgaacaatgatgagccaattagacaaaaaaaacattggcttgaacttcatgggaaggcaccgaatcattactaactcctgtggtattcagaataataacatcaatcatgatgaactgctttggtagtcatatgtctgtatgtaattccataaaaattctcttagttttggcattaattaatagtgactgtattttataaaatggcgtatttcattgaaaacacttacgtttaaacatgtcatctaagaacttgaaaatctttcctaacatgcattaaaatgataattactgagttctcatgggaaaaagtagtttctcattttaggtcccaaagtttcaacagcatttggtatagcatttcatttcacttgtggtcctaatgactcactgcattcttttcaccagaacttatcccctgtttactctcagagttctgtctcatgtagacacaagcctagtagtgaatcaataacatgactattttcatgaacagtggaatagttcaacctctgcaatgccattggaagacattgtctagtctgcaagtttaaggaaatttaacatttcctatacctttatatcttgattgggtttggcttttttttaaagattaaactctgagggaaacttctcaaagctgagcctaggacattctcatgcagttgggaagcagcactgtccttattttacagatggaggcagctggcataaatagctacttaatgatttgcccaagttcacacaagtatagagccaggagctagatttgtgactcttgcacaacccattagactgttttcatttcatctaagtcaccatagtagaattaaatataatttttatatctttgtcagtgctctttaatgagttaactcctacttaacataaatgttttagcatttccgtgccctctgggccattaaggtaatttatttttataattttaattattataatcctcttaagtgtataaaataaattcagaaatgaaatgaagacatatatttaattgtattattattaaaccacatggtataaatgataggattcagaaataaaagtttttcattagattttggccattcataaaatatattgttgtttgcttaacatccctaaaattattttcagagttaaggagaatatactcttatcactgcatatttactttacaaccattgaggaatacatactgtgtgctttacaaagatacagcctaatttatttgcaaaaagttaataaaactgcgtatgtgataacagtttttatgctgtttcctcacagatctctgttaattgttacctgtttatggttacttttgctgtattgttatcattgaattaggatagtctccagttaaattatcttctctccaatgaaaaaatcctgcttaaaaaaaatctgagggtatgatgtacaacttttacacatgatacatgaactttaacacaattgtgaattagagcccaacttagttcaagacaaaatgtatctcgaacacttcttttcttcttaaaatatcagcaataatctagtatccaaagtaggagattcatcatcaccttaagacttcttagcagtttttcttgtgtgacaaaatattttacacctttatttgagaacaaaggaagattatgagagaccactagaaatggaattttagcatttcgaaggaatttttatatgacgttgttcctcttggcaattcagaaagcactccaggaatttgtctagttagtgttttgtatatattagaatctgtgtctatttcctttgtaaaaaaatacgaagacctcccaagtcataacttttattatcaattcttgtaatgatcaaatatgacgtctgtacaggaaataaatcgtgtagtagtttagctggtaatccatgttctgcctcaaaacctaggaatgaatggcttattagctgttgaaaactctgtcattaagtatcattaaatcctttttttaaaaacttcctttatgccaggtaaatttttatattgcgaaaactgaattaagccaaagaaaggcttgcaaaaaccaattcagatcacactgtgactataacaagacattttcaaaaccagcattccagttgttctgtcaggtcattccatcaggtctcaaaaggtgactaggatgctgaaaaaggtttgccttccacattgtgacgtaaattcatttatttgtgttacttttgtttagaaatggcttgttacaataaggttttatcactgtgactcatagatcatgtaaagtcagcccattcccgttttactctttcttgtaattttcaaaatatggcgtagtggcaacccaaattgaaatcttgagaagctggcaaggttgatcaaagtggaatccacaaattaggattgtaaccaaaactggaggaatcatttttaacctactcaggaggccattttagagtcctgaaggtatcacttatacacaaatcagtgaaattataacatttttagagttggaaaattccttggaatatatgtagcccagcctctccccactttatgtttaaggaagtgggtcccgaagagggtggtgagttgcccaaagtcatgcagttagtactgtgctaggactgtaaccaagttcctattattctagttcggtggactttccaaaagccatataaatgtgtttttctcactcatgtagaattatttcctagaataaagacctatatttaaaacatcttattactggtttgaatgtgttactatacttgcttgtacattgctctaaaaacaatgttagtttgaactttgccctcatttgactgacctaccccagaatcagtaatgctctcttcactagaactttcattcttaacattttattctcctcaactagagcctcattccaagtacagtatatattttttctccatgaagaattgtaatcatttatgtctctgcatttcatttcagtagtgctcactatgcactatcaaagttattatcctatttccctggtaatcacttgcgtatttgtcaaataagggtgtatgttgaataaacatgtggcttttattcaatttggtaaacatttattgcataccctcacaggactaaagaaggctacaaatcagtacagcagaatgccttcaaaaacttacaggacacacccaccaagtgctgcagagcagtcagaagttccctatgagatataagtggaaaagaggttcagaggatcaaaaatgtacatgtgattataggaatgagaatttgatatgaataccctgaagaatttcaggtttggttttggacattggcatctgttttttctcagttgatcttttgtttgtttggttttggtttttggtttgtttttgtttttgtcagacagagacatttccattactcaggctagaatgcaatggtgagatcatagctcactgcagccttgaactcctgggctgaagcaatcctcccaagtagctgaaactacaggtgcacactaccacaccaagctaactttttaattttttttgtagagacagggtctcgctatgttgcccaggctaatttcaaactcctgggcctaggcaattctcctggctcagcctcccaaagtgctgggatttctttttttttttttttttttaggcagagtctccctctgttacccaggctgtagtgcagtggtgtgatctcagctcaccacaacctccgcctcccaggttcaagcaattctcctgcctcagccccccgagtagctgggattacaggcatgcgccaccacgcctggctaagttttgtatttttagtagagatggtgtttcaccatgttggtcaggctagtctcaaactcctgaccttgtgatatgcccacctcggcctcccacatgctgggattacaggtgtgagccatcgcgcccagccgtgttgggatttcaggcatgtgccaccacccctggctcacttgatcttaagttgcaaaatcacattcattaattctataggtgtggatggggaatgggagtgggatatgagtagtcatatatttgccttccatggggcctcaggaagcagtgcctcaactagatttaaggaagtactgtagtactgagaggtcttaaggccaaaagacaccatctgcttatttcattttatttattctatgttatgaaagagagtccctagcaacaagacacctggttactagccatgtgacttgagcaagtcacttgacttttctgagccctagttttcttatccataaaacaaggattaaaatatgcaagtcaaatgagttaaaatgtagaaagtattttgtagacagttcagcattctatgatataaaggatggagattcttctcttgtgtattttctagttacgtccatgtgcttttcaactgatcatagaactataccaagggtctgaccagtaataatactggcatatcaaaattgcctaaagtgatgtcagctagattttgcatggagcctttaatggcccgccaaaatgacttgatctacttggtgtccctaaaggcctttcttccttctggtttgagcgtttgttgactataaaatgccttttttgcatttcctgctccttcttgctgatgatataatagttgcttcttgaaatactattgaaaatcttcagattctctggaaagccatattctgtaacctgttatctgtaaaagttctgagtatagaacatgcagtatgccattagaacacacaataagtttagagatttaattttaagaattttccattgtgtattgaaacacttaaaaagtaaaagccctgggaataatatagtatattaccatctgcgcattttccctcaattctttcctgatggtagctgatgaaattgaaatggtaatttttagaatgttctaatatttgatgtatttaaaatacatcaccttttattggcctgctttatatgggaacaagaaagcctacctagcaaagaaatacaacctagttttatatcttatttattctgtaagtccttgtgcagcagcatgttaatgtggacacacagcttgtagataatttaaaatctagaaagggagaatgagatacatagagaaatagccaccacataaggcagtttatgacgaatacagtgtgttacaaatgacaaaagccacaggaattcagaagagggaaaaataaggactggcttcctaaagaaagtggcaatttttttagaatattgaagctgttactctgaggcatgagtgacacaagccagcagaagccagagatttgaagtcttgctcaagatttgctggtttccacttggggaaagacaccattaggctgggtacatctggagagatgagtgcaagaagccagttaagcaggagagaagtggacttgattgtggaggcactgtgtttcaaactcaaattaggcagctcttgggtgggtggctgataccattgttgtgttttcagctgattaatctggtagcagtgtgctcgtttaggagaaattacaacaggagatcagtcaaagagaatggtcctctggtttgggaatgaaataatcagggcctgtacctggagtggggcaatgatgattaattggaaggaaatgagaaattgagaagacttgacaggacttggttactcattgtccggagtaaaggaaaagcagaaataggtaagttaattatcagtttggggaaggtgattatatagtttagtcttgttgaatttggcctggaataggaaggtatatctcagggcactgcaataacttgtggctgcaacttctgagccccatgtaacctttgaggagtcatggaatctaggagaggtgccacaatactagaagtgagaaatattctgtgtttttttaaagataggaaaaagatagattctacaaaatacaatccagcaaaattgatactgattttaggttattaaaataataagttgtgagcatatagaaaaataactggttaagaagtatgaaaaaatgcccaaatctcactacaataagagaaatgaaaagtaaaatgatagtaaatatttcccccatcatattgaggcaagcaaaaaaaataaaaagttttataatgtcaggtgttggtgagactgttaagaaatggatagtctcgtacaccaactgttgggattataaattggaacagattgagtatctcttatctgaaatgcttaggaccagaactgtgttttggattttgtattttttcagattttggaatatttgtgtatatataatgagacatctttgggataggtcccaagtctaaacacaaaattatttttcatttatgctttatacacatagcctgaaggtaattttatacaatatttatacttctgtgcatgaaacaaagtttgtgttaagtacttaaacgtggaattttccacttgtgacatcatgttggcattcaagaggttttagattttggagcattttggattttggattttcagattagggatgctttgcctttaaagcattttggaggtaatctggaagtatcttttaatattaaaaatacatatgttcagcgactgagacttctcacttctcagagaaatcctggtacaagggcaaaaggaggcatgaataagaaaatttgctgtagcattaattataatggaaaaaatggaaataatctaagttcattagtagagggatggctgaatagactgctatgtatagaatactatgtgacaattaaaaagaatgacatagacctataagaaattatctttaaggcacagtgttgagttgggggaaagccattttttggactgtaggtacggtctggttggttccatttatctgaagtacatgtatatctcatataattcacagaaccaaacctggaagaatatacaacaaactgataatagggactacctctttggaagagactaagattagggtaggtgataagtttgccagatttagcaaataaaaatagtgcttagttaaattttcattcttttgctgtatattcagtgtttattggatggctggattgataaatatagtatgaagcagatttggggcccaaagtgaaaaagcagcagacttatcagcaacacaggttcctggaaatagcggctacatttaaaattttttcatggaaagttattttcaaactcaaatactctaccctcaaccttatctaatttaatctttatcatatcctgtgaagataaatattattttattaaagaggttcaaagagcgaagtaccacatttgatcagttctaagatgcccattttttcacaaatgggcctttgaaaacagaacacattttgaagtcactgttcgcaggcatcagtcctgatccagtggtgattgcctgcccacgtgcctgaaacttgcagagttactcaatggcaggcatgaaaatcctcgaggtcatagtagagttctactgctctgtcatcagtgcccttcatgggacagaagacaaaattgtgtggaaaacacagacatctaacaactctgagtagaaaaggatgtgaaagagcaggactctgaatgtgaagaaattcttggaataccttcatcaaattatttcatttcaaatttaatttttaatgtatgttcaagaatgatagataaaatccaaatgtgaagaagtctgcaagagcccttttaatgggcataattaaaacttctgaatgataagaaattgtgtcatgtcagtttgacagtcatttgtcttttttagtagtacattaagatttagattcgataaaatggacatgttaattagcttgatttaatcattccacaatttatacatttatcaaaacatcacattgcacctcatgaatatatatatagttattatttgtcaattaaaaataaaatacacaaaattacccaaggtcgcccagcgagaaaggtaagagttaggaccataaagcctataccttgagtctcttgcagtgtactatagagtgaaaggaagatgactatacactttttgtcttacttacaaactttccactcttcgtgtttcaagaaattgagaactgtccagggagttggcagtgataaaaatgttacatatttaacattacttggagaaatttggattcttccaaatgctgtaaaataataatgtgtacattcatataatagttttacttttcaaagcagttacacacatgcatattacctgattaatagtgtatgagacaaacatagtatcctcccatttaccaatgagtaaactgatgtaaatggaaattaggtaaagtactactaagaagcagcaacagatcccaaaggaaaactgaggtctctgttatggtttggctgtgtccccacccaaatctcaccttgaattgtagctcctataattcccatgtgttgtgagaaagacccgttgggagttaagtgaatcatgggggcagtttccctcatactgttctagtggtaatgagtaagtctcacgagatctgatgattttataaggggaagcccattttgcttggctttcattatctcttccctgctgccatgtaacatgtgacttttctcctcctttgccttccgccatgattgtgaggcctccccagccatgtggagctgtgagtccattaaacctcttactctttgtaagttacccagtctctgatacgtctttattagcagtgtgagaacagactaatacagtctctgtgccagtccatgaaacatctaatgattagcctgccagggaggtcctgaatagcatacctgtactgaataacttcccagatttggacaaatattggaaagacaataaattttttttttagttgcagaataagagatgtagaataaagtgggtgcactaatctcaagcatacagtttgatgatgttttactagtgtaaccatccagatcaagatacagaacattccagtcttccttatgccttccccagtctataactccctcccccagatgtaatcactacactgacttatttcatataaaaagtatgtgctttttgtgtatagcttcttttactgagcatcttgtctgtgagatgaatttttgttcctctctctgccaaaatgtttcccaagtggatagaccatttgtgtttcaccatcagtgtatgtgactgctctccatctttgtcaactcttgatatagtcagtttaaaccattgtaatgatatcttattgtgcttttaattttcaattcactgatgattaatgaggttaacctttttacaagctactggactttgggtttccccttttgtgaagtgcctgttcacatctttaacccatttttaaatattggattgtgtgtctttttctaatttagttgatggagttctttcttttttgagacagaatttcgctcttgtgtgtctttttctaattgagttgctggagttctttttttattattatttttatttatttttattttatttatttatttttttctttgagacagaatttcgcttttgtcacccaggctggagtgcaatgccatgatcttggctcatggcaacctctgcctccctggttcaagcgattctcctgcctcagcctcttgagtagctgagattacaggcacctgccaccacgcccagctaatttttgtatttttagtagatatggggtttcaccatgttggccaggctggtctcgaactcaaagtagcaggagttctttatatattgtgagtataagtcctttggcagatacatgcagtgcaaaaatctcccaggatgtagggatttgaatgggatccttcccctctctcttcaccgagaaagggcagcaaactaatggtcttatcacttggacctctcttctatctgagcacttaaaaaaatatagagagacaaaatgtttccctactgccttttagcctattttagcaattcataatatggaacacaaacatcccatacttgtacattttaagtctccagtaaaatatttttaactgcgaactctaaatatgttacagataatgaagcctcatagctaggcttttaaatattaaacactttcaatttccagcatgcattttatcttccaaaaaagtacaaaaggggtgtgtgtgtgtgtgtgtatatatatatgtatacattttatacatataaaattttaactggtaaattcagaaaaaaaagagtttacaaactttaaagaagaaaaacaatttgtttagcctaccattgtactactttgtgaatgaagagtctaaggttgtgtgtgtatgtatattttgggatgagtgtaaaaactgtattcctcttagatatatagttaaagtacaaaataaaaacaaactacattcaaatataagtgttaaagaaacaccagatagcactggtgagcctgatacctcttggcaaaccagcaagtgtcatgtctgacactctgagatgaccccaaaatctgtgctaaaaagttgcctgcttacagccttagcagataaaaaccttcagaaaacatttttgaaaggtgctgtgtgctgattctgacaaacataacagaagaacagaagcagagattggaaatattcaaggaaagaaagtacaatttctatttcaaaagaaacttcttacttagggtatttaccttggttattttgcctttaaacttttgattaagcttttcactctcaacctaagcaaagttcaagttgttctgagaggacattattgatttagttttcattctaaaatattttaaacaaactgagtaaatcttaaaaacaacccagtacttatttgtatcattgtttgtctctaaaatggttcattttattgtctgtcagcaccacttctagcttttacttttccaataattttatgctttaaatattaaaagcataaaacttattgagcacctattcttccctagaatctgtcaggaagtggcagttaagaaaaacaaaacaaaacaaaaaaccctgaataacttgtacttactatcttcgagtagctatagtctgttgaggacataaaacagtgctgtttataatttagaaagttatgtgccattacttagaaaactctgaagtactatgccgtctgtttctgtggaatatttttttaatggtccttagaggatttatttcacaaattttaccagagacttactacatttttttattttctaaagactgctggctactaacttaaaaagtagggttgattaaaagaaacattaatatatatgtataattttaactggtaaattcaggagaatccaaaaagtaaaaatcacccataatcctaccattttcaacacctgacagaggtagcaatctttaactgtagctatatctctttccaaacatttttatatatattcagactaaaattgccagatttagcaaataaaataaggacattcagttaaacttgaatttcgaagaaacaacaaatgattttttatttaaatatgtcccacatattgcatgggacacacttaaactaaaaaagtatttgttgtttatcagaaatgcaaatttaccttagtgtcctacgttttatctggccatcctaatgcaaacatagccacacatacataaacctgtacatatatctcttgttttgtcagaatagaatcaagctgtatatatcactctaagccttactcctttctctgtcgatttatctagtttacatgtcagaattacccatgttctttctaattgctgcttgatattatacagagagacacatcatcgtttatttaactattcctctaattgtggatattttagctgtcttcatttttttactctttcaagcaaaacagcactgaatgtctttgtattgactcattgtaaacttgttggttttgtagcctgaattcctagaagttgaattacaaggttgtagcatatttttaaagcagcattgggtcattcctttcatacttagtgcctgaggctggagacttgaggagttgcagaggggccacgtgtacctgggcacgaggtgaggaggagcttaggtttctgatgatatgggccttgtgtgtgttaggcacctttctggcttctcaaattcggtttcccgccttcactgttcgctccatgagacaaggcatccttgttctccagcctgccacacaagttggctcatgatacaaatgtagaatgagtaaatgaatatgaatttattcaaggggttgctgagaaaaataaatgaaataatgtatgcagagtacctgggaaaaaaataatgtatgtaaaatgcctaggatgcttctttatttttctcatcccacccccatttccagttactttcttagcatcaggaggctgtaatctagggagggtgacattacagttagagtaaagtggaataagttctgtgccagaactatgctcagagcattgtgagattatacgaggcgggcacataacctgtgcctgtaaggagaattgcccaggatgtggccaaaagttacttaaagtaagccttgaaagacaagttgaaaggagccagacagacaagatgtgtatgttggaagatgtgtgtatatcgggggataggacaatggagcaagcattccaggaaaagcaaatagcattgcaacagaacagagatataatagagcatgttaccctcagagcatagtaacagggatgtaggaacagctggaaattaatccagagatagttaggaagcagacgttaaagtgctttaggtaacaatctaagttttacctttgtcttatagtgaacagtgggggacttctgcatgactcagatttaccttttaggaatatcacttagggctaggcatggtggctcacacctgtaatcccagtgctgtgggaggccaagacagaagagttacttgagcccaggtgtttagaccagcctgggcaacatagcaagactctgtctctacaaaaataaaaataaaacattagctgagcatagtggcatgtgcctatagtcccagctactcaggaggctgaggaaggagcattgcttgtgcccaggagtttgaagctgcagtgagcttcaccactgcactccatccagcctgggcaacagagtgagatcctgtctcaaaaaaataaataaataaataccacttagtgcagtggagaaaagattaaagatgcaaaaatctaaagacaggagttctttgtgtcggaacaccattgtagtaatccaggcaagagatactgactacttggcaagggccatggagatgggagagaagggcttatttgaaaggtaatgtaggaactataattaccatgatttcgtgacttgttagatatgtgtttgggaggagagaaagaatctaaaatgtctgtcagatttctgaattgatcatttgggtggatggtggtaccattataccagataagaaatacagatggaaggacaggttttggtgggagtaaagaaactgtattattattttggaacagatggagattacagttaccagggactattctaaaaaacatagcaggaagcatgtgtacatttgcacatgcagaagtttgcacatctggagcttgggagagcagccccagctgccttatgactggggatgcctcagaatgtgactaaatgttgaagccacaaatgaatgggagatgaggggtggaggcagaatttaaaatttaagacagtcttgagaagtataattgcaaaggtaattatggaaacacaaacaaatggtgaatgtttttggtagccattatagacaatagcaaagggagcttactagagacccagagaaggcagtaccgaaagcccagatgaagttagagaccatgatgtgcaaccacttcagacttgttatgaacattttctctcagcagtcctaattgtagagatgtgcaaattgttctgagattaggccttagaggaccagtataagaaaaagtggaagccaatttttggtgcctggaaaaagaataataccaaaagctgactgggggttttaggtgggccaggaaaagtttgaaggcaagaggcgcacgtttaagaaaacaactagttcaagacattttagacaggggtatccctaaatcagagtagcactgaatacataaattgtatttgcaatgcaaaaacttggatacctgtactctattatgctgaacactaagagtttcccatctatagggatgcccatgtttccctgggcaattcctattgtaataccaattttttttttttttttcggagatggagttttgcccttgttgcccaggctggagtgcagtggccggtcttggctcactgcaacctccacctccagggttcaagcgagtctcctgcctcagcctccctagtagctgggattacaggcatgcaccaccatgcccagctaattttgtgtttttagtagagacaggattttaccatgttggtcaggctagtctcaaactcctgatctcagatgatctgcctgccatggcctcccaaagtgctgggattacagacgtgagccactgtgctggcctgtgataccaattttaacattagctggataaattcttctttgtaagagtcattagatcgttaacccagttctcagttttgccttggtgggtagctcttcagttccatttggcctgaagatcccccttcctctgcacctccatgcttttcctgactagttgtgaccacccagatcctcttcctccagcagattgaagaagttgttagtgaggagtacatggtcctccttccactggagatacattggctacctctatcataactgacttcagtttaaaaagtcagtccttgcaacaacacaaaataaaaaatgttgaagtcccacctctatggagtccccataagcagctgtgcgtgcaactctacccaaaacagataatatgcacagatgtgtttatgggaaggaggcacaaggactttcagtgtgttgttttcagtttctcaccactacaagggtttcttttctttttcaaggaggtacattgtggtaagcatgttttatgacccataataaaaacccttgtaaagaccattttttgaccaaatgaagctaagtgttcttttcagagtccttgtttgctcctctccccctctctgtattggaatgcacacagttcagcattaatggataacataaggaaataatgtcacaaattctagttcttatttgttaagttgagaaagcaaccagagttaactatgtaagaaagttcatttgtaatgtttttcccgttttggtagtagcttcagaatatatatgttgattaagtaaaatggtatatttcatgcttatagtatccggttattatcctataaaaagcacctaaggacagtttcgggaaatctcaatagtcagagaggcctacagaaaaatctgtccaggtatagggaaaaagcaacttaaaaccattttagcaagttgggtcatttacaaaatgaaacatgtaatacattcaatgaataataacagataatttctaaggacctagactttcaaaattaagaacagaccacataacatttgatttaattaaaacaacagatattttaaggattatattataagttgtgtttgttgatcttaatagagtgttagggaagatagaaggctatccacatactaactggggaaaattcagtggatctgaacttatagtattatcacagcctcatcttcatttagtggcaccagtgctgaacccattacccaaactgggaggtttacacattgtttacccaaactgggaggtttacacattatttttagttcttgtagccaccctacaagaaagtgttgtccccattttacagatgaagaaacgaaggttagatgctagcggagggaagattaaataacaggcccaagatcacacagtgtgcaacctggaaatgtagcggagctctccaaagatgggccattaaaattgaactgtgagaacaaatattaatatatcacatttgtctcttgaattgcttttccccttgctttttgtttcaatattctaatttagaccttctctatcatatgttcagaatagtatcatagcctccttacaccacctcccatccattatgtatgctaaaatgtcaataataacatgccatggttttacacatttttactacttacccactgaatataagataaaacactatagactccctgtgtccaccagcaataaatccctttgcagtgtggtcccatttagcagtgtgccctctttaggaccctgcctgctggagctatagctggtgtacaaacacgtaagcacttcctcctcctctattagtgtcctccatgacagatgcttccccacaccaaaactaataccagccttcctcccagattggcttagatgctgctccctccttggtgcttactcagtgcctagcgctcttgtgccatttgtggtccttggcacatactgacatgaagtatgtaggtacatattcttttctccctgctagagtaagagctccttgggacactctattcaggtgcttccgtgtagcatcacctgacacaatgccttacacatagtagggacttcatagttcttttgaataagtggtagcaatttattatgtgtatgaactttacaataaataaagtgcttaagcataatatcctatgtcatatatataaccataatacacataatcatatataaatatatattacataatctataatatatcttgtttaaatctttttgtggggtcattttctcaaaaatagatgtgaaaagcaaggcccacgaaagttgcaagtgacttgtcttagattatctaacttgcaagtacaaatttggatccaaagcttttagctcaaaacccagtgctctttcttttaaatcatactgccttcaaaaatggaaatttacatctcatgtctaagtgactcacttaggtttatacgtacccaaaagaaacttttttaatacttttatgcctccacttggcaagcagtcagtaaattcttagtgaataaccaataagccacaatgcaggattatggcttttttgctaaagaaagactcaggaatcagtttaatcggtgagaatgttctataactcctgtacacaaaaccaagagcaaaggtcactataattcatcttaatgcatatctatagactattgggtgattcatccaatcaagtaaaaccaaaagatttctatgtataacgtgccttgttcgattcttggagaatataaagatgcattgcattcctgttcctcaaggaatttgcaatctagctggatagcgcttggcagtttaaaaaacaaatcaaatctataatataaaataatcaaatgtctaggttctctccacagttctatgacagaggcagggcaggatttattctggtttttataagtgaaaacctgaggctccaaaaaattgggacttcatagacactggggactactagaggagcggggaagagctgaaaaactacctattggatactgtgctcactacctgggtgatggaatcatttacacccttagacatacaaaggtatgaaatatacctttataacaaacctgcacatatacccccgattctaaaataaaagttgacaaaagtaaaaaatgaaataaaaaatctgtactattacaaaaatgataagaaggaaggtggaacttgcttaatcaactgactagtggctgagttgaacggaacttagtaacactggagtaagagactgtactttgagaaactctgatatgatcatatgaaattaaagtagtattaggggatttggccaatagtccaattctgcatccaagtgaagactcaggcaaagtgatttgatctgtggaatacttctcttagagatgggagaggataaggtacttaagctagtcctaccccaagctgtggaacaatgtgctgaaatccatgtctcttgacccctgggcaagttgcttctgaaagagatggtaagataggaagcatccttcattgtttttgttcagtgtgtcagtgttcattatagtcatgggagttttatatttctaaaataatgagcccaaagtctcaacacatatgaacatgttttaatggctaaaaggtacgaatactgatttatatgccatgcctcttttgtccctatcccgtaatccaaacctgctctttctgattcccctggagttttatcgcattcctcctaaaaggagtcagtgagttctttttaagctaatggccttcatagatttcatggtcatttttagttttgtttgggccctcacttctttatgaaaactcattgagcatttattgacacccattagtacaatgtggtgggaggccaataaatctagaggaagagcaatttaagcaggaccctgccaggagttggggccatggggcagtaaatgagtaaagatggcagaaatccacagagtaccaggaggcagggccagagagctaggtgggctttggctgagggggctgaagcaggagaattatctgataggatcaggtttacacttttaagggttcagtctagacagagagtacaagatggatttgaggactgagatcagtggggaaaggctaggtaatggtatatgtgaggaaggagaaggcggaccagacccgctatagtgggagcctcagaggtgtaggaattgtatttaaaaagacacgactttactgaggagcccagaacaagacttgagtaaatgaagaaaaggaaagactcaatattgtaaaggtatctgttatccccaaatcaatttatcaatttttaaaaatcattgaaaatactaaaaggatttttggaaggtgtgggcactcaataaaatgattctgaagtcagttcataatcataacatataagaatatccaagaatgccagacacgatggtgcacacctgtagtcccagctacttggcaggctgaggtgggaaaataacttgaggccaggaatttgaggccaacctgggtaacatagaccagcctctaaaaataaataaatacatatttttattttcaaaaaatattcaggaatgttttataaagagtggaaagagaaaactttccctgcagatgttaaaatttactctaaatatttaataattaaaggagagaggtactctaaacagagccagaaacaaagagcaaaagtccagaaaataacttcaagtaatttagaacatgagaaatagtggcatttaaaattggtgggtaatttaatgactgcttaaacccttttgctaatcatagaatataaataaaaatagaaaaatatagaaccattaaaaattaagctgtagatctacattgccaatagatctacatgcaaatgagttcagtatacagcatgatgtgaaaaagacagttacaaaattgtatgcattcgcattccatttagaaaacagagactaaccatctgcatgagtattatgtagatggcaaaaatgggatgaggttaaagaagtcaaagttctgaagctaatattagctgggcatcctagtgatgttggagtcctgcaggaagacgttgagtgtggggtaaacaggatgagccatggttcctggggaatatagagagttgacagtaaatgatagtgatggcaaaggcgatattataaacattaatggaaggaggtacacacctcaaagagaaaaggataaccacctgaaagggatgattgccaacaggaaaagaatgttggtacaggccccattgggtctgtacctcaccctggggtgaatcatggtggctataaatgaaagataatgttcataacatatttaagttaatataattttaattaagttagatttgttagaataattttcagctgcaaattacagaacactcaatgaaaagtggatccagataagggcattattatatacataactacaaggctggaggcagacagccctaaagttgatgcagctattcattgatgtcatcaaagacccagactctttccctgtttacactctggccttttatgtgtacagatgatgtttcaagatggttgctacagctcggtagcattcagtataagacgtgggtgaggaatgggagatgaggaagtacagcagagagcattctactgtgcacctcttatcaaggaggaaaatgcttcctgaaactctctagccaatttgcccatacaggactgggtgtcatgttcatccctggatcaattcctagcaaaaggaaatgtgattgccttcattggcctggaccaggtcttcatggctgacaaccagcagtatcttctatatcacacaaataattatctgttctactcttgtggaaaaccagctcctctaagcattacctcatttgaagaggaaggaagtacagagtgaggggaaaattctcaaaagagggaattgagaggaagaatgtggaaagataagaaagtattttgtccaattgcagccattagaaagcttattaaaatttcttcttctgtttttgagagctgtcgcccaggctggggtgcagtggtgcaatcacggctcactgcagcctcaacctcccaggctcaagtgatcttcccacctaggcctcccgagtagctgggtccacaggcatgagccaccatgcccaactaattttttgttttttgtagagacagggtctccctgtgttgtccaggctggtctcaaactcctggtctcaagtgatcctcccacctcagccacccaaagtgctaggattacaggtgtgggccaccacacctggcctaaaatttcattatagaaaagtgtgtgttgaaatggggaaatattcacagcacattgtaaaatgtttttaaaagcctcacaaaacaatgtgtatagaatgatagccacttgggtcattacccaacaacctaggaacttgggcttcatgttttcttacttctttacccagtgctgatttttatctcctgctctgaagaaattatgtttagcattgcatatttgcagtttcagttcctgatgattttccacagtgggttaaaaatagccattatgatgaggtaatgatttattctttcatgttgttcatttaagtcattacattgttcctcaaacaccaacattttcaggcttggtggaaatgacttattatcttttttttttttatttccagttagttgagactgattctttaccttctcagcattatcatcacttccaggaatgaataaaaagtgggttctgttctcatttcagaatacatatttgattattaaaatttacatgcaatgccactttattacacttttatccagttgcctagaagcagtaaaaattagaagccagtgtttccatttagggcccatgcctttgtttctcctgaggggcctcgaggtgatgtgtgcctgactcatcatgcacagtggcaaagagacgggtactatggcattgctggactatgctttgctgtggaacaaagctcatgtgtgactcttttagcttgccagttaatggcttgctttgaattcacccattacaactttccaggtgatatggaagttttaaggaatcctcttgaaccctcctcttggtttctcagaatttgtttgtcttgttctttgtgattttggatgaagcattctttgggtcctcctgaggaccacagtgagaagtaggggagacctgtttataaacagcctttgaagctcattgttcattgctcattgcaaattgatcaatgaaagcacacgggaaccctgtcaggttttgaaatagagtagaagctgtatacatacagcaagcttgatgtggggacctgcagtgtagattctcccagaatgcagacaaaagtgggtggaatctccaaggagtgaatcaagccacttggctaacgctttaggaccttaacacgatgctgttagtcactatttcattgcttaggtagcaacaatataccacattttatgggagaaccatggttttaaaacattctgggaatagatccagcaattccacttctgagtatatatccaaaaaaattgaaagcagagtcacaaagagatcattctacacctgtgttcatagcagcaatattcacagcagccaaaaagtggaaactactgaggtgcccatctatggatcaccagataaacaaaatgtcatatatacatacaatggaatattatttaaccttaaagaggaaggaaattatgatacacaccacaacatgaatgaaccttaaaggaactatgttaactgaggcgagccactcacaaaaagacaaatccagtgtgattccacatgtatgaggtatgtagagttgtcagattcatagaaacagaaaatagaatggtggctgtcaaggactgaggggaggggtacatggggagacatgcgagagaagttatatgcaggctcaggtgacctttccctctgttgctataatcgtaaccctcaccttaattcaacatgttcttattggtttagtgttaaaaaacctttgttatatgtgatacattttagtctgtggcctcctctaacacacttcataggaaacagacaaaccactatggagagagttctgtgaaaacttgaataacaaatttgaaaagactgaggtttacagagtataaggagaaaaatagattatctttgcctacaagttggatatgtcctgtttttaatttttaaataaactgaggattatacatttttggtgctaaaactttgaggatgtgaatatatcacaagatatatccctatatccagaattgtctatttaaagttgtcattctgtgacttatgatatgacttgggtgtttttagtgtcttttggaaataatcatactttcttgtaatgagaaaataaggcccaggccaggtgcagtggctcacacctgtaattgcagcactttgggaggccaaggcggaaggattcatggctcgaggccaggaattcaagaccagcctgggcaacatagcaagaccctgtctctacaaaaagtttaaaaagtagccaggcatggtaacacacacctgtagtcccagctactcaggagtattgtttgaacctaggaattagaggttgcagtgagctatgatatgatggcaccactgcactccagcctgggtggcagagcaagaccctgcctctaaaaagaaaagaaaaagaaaagaaggccccatgatcaaccttttcccattagaaaagcctgaagtcgttttttagtttgcttgtttgtcttgattttaaataagaggattagagctctggaacacctaagagaaacaattacaagacttcaaggatttcttgtattcagaaaggtccagagtctttttaggggcattgccaagataaagccccacctaagatctctcggagccagacttcattccacaatggtgtcctgttgaaacatgcttgcgagtcgcatgttttaaaaagatagagtgagggtcccaagtgactgtttatcataagtatgactaaatgttcaaactttttataccagactgtgccgtataacataaaaagggaaacttttaaacctgcgtttaactgaaagagccttaattggtggtatctgtagtttcattgcattgcatcactagggttactgtgaaatatttgagtcatatatggtacagaataatttagattaaaatcttgagctaatttaagagtatgcctcacgatactataaactgagatagaacagatcataagcttacgtagagagtcctttgaaatgtctttgatgaaaacacttcttgtgattctgtaggaaaggtgtttttttcttacctcatttaatgttgtaatttatttatttatataatcctctggaattgggactatatcttatgattatttgggaccagagttcctgacgtagctgaatgtacttcacctttgaaattaggtattgcaataaaggttggctaaagactgagaggggttccccagtcatgcttattacaggttcacaatgcccaacaacctaactcgtggttgaattactgaaggtcatgagatgttgggcaagattttgttttttaagtcgttaactcagtgttcattggttcagaattccaattgtgtctagatattggagatttaaaagaaaagccatttgctaaacaaaaaaaaaatttaagtagcctaataaaatctaaagaatggtcattcttatgtagaaccaacttacatctataggcatcatacacatggaatcaacgttagtgcagtcatgtggattcatactgcctaacccatgctttggtatgatattaacaagcccttttaatctactctacctttaaacaaacaagaactagacctgtagtataagtgccaaagtaacacaactaaaactgaataataataattatggcatgtcccagggtgaaaaaccatgcagccattaaaaatctcattgtataaaaaaagtcatattgcagaattttattagtggcaaaatgttgataatgaattgttacatgtttttaaaagagctacaaaataatgtgtacagaataataaccacttttacttaaatatacttatacatccaaatataataaaatacgtaatttttaaaagacagactaaaaagacacaaaaaaagttatattaacagtgaagttttctctgttctccaagtagtggaattttttagtgatttttcttcttctctggattcttaaaacattttattagtttctgcattaagcatgcatctatacatcttagcaattttataattaagaaaaacatagtgtgtgttataacacaaataaaaacgatgtgcatgtttttaaatttgtatactgctaattggctgctaaagttgtttgaacactgcagcatgaaccaaacagatttattctttatactgttttaaatgagtgacacttaactgtatagaggctaaagatgatgagccaacaggacattactttaggttagtcatgctttttaaaattcagtgcttacaagttgtgtgcatgtgtttccaataaagacttatttgccaaaatgttccttgaacattttgtgctacattttcacactcctgtttattcattacaacttattggacctgcagtgcttctcaagtcttgaagggcttttcctccccaatgcagtcttctccagggttttgggaagcttagaaggtcacccctgccagttcagaatattcactcagggggatctcagaaatgattctagatcactgcataccccctctaagtgctttgttcacaccgaccttgtagcagtggtcatgttttcttttagttgtttgtgaatcagtctcccccagaaatcaggacacttatcttggcaataatcatcctaataattactgtttgtcaagtgcttaccatatgccagaaactgtacaagcacttggcatacattacttcatttagcccccttaatagtaggaaaagtaatcgctactttctccactttataaaaggaaaaactaaggctttggttttgaacaagctaaaatataaagacagaactccgaactctaaaggaagaaccaaaaccataaaccagtaaccaaatatactgttctcgatgagaggattcagtggtccggccaatgataagtgtatcctcacagccccttccagctctgaaatccatggtggtacccagtcatttttctaacccttgtattaacaaaacagctccatcctcccttgtatacaccattcttataatatttgggtcaggggagtaggtcactcttaatttccacacatttcagaggattatgacatcatggccaatgtcttagttcctaccttcagacactgtccctgagtattaaatcttgtgtatatttgtattggtcctaaaattagaaaaagatctgatattggtttatatcctgaatgatccgctcctccatactggttaataataacagtaataagcgctgccatttactgaatattaactatggtgctaagtgctttacaatgatcctatgataaagtgggctttgttactgtcccattttacagacagggaaactaagccttagagaggttaaatggcttgccttattttacgtattcatttgttcattgatttgataaaggaatacattggagatttgaatcgaggttttccagaccctagtttaaatcaagactctgttaatattctaaaacagttgattaagactgggcatggtggctcacacctgtaatcccagcactttgggaggctgaggcaggagaatagcttgagcccaagagtttgagaccagcctgggcaacatagtgagatcgcatctctgcaaaaactaaaaacattagcctagcatggtggcatgcacctgtggtcccagctacttgggaggctgaggcaggaggatctcttgagccaaggaagtcaagtctgcagggagccgtgatcacagcactgcactccagcctgggcaacagagcaagatcctgtttaaaaaaaaacaaacagttaatcagcactctcttgctagtatgactttgggctaattagtagcctacatctgtgtatcagtttcttgacctgtaaaatggtgtaatgatattatttacctaaatgttgtggtgtggattaaattatttactaagtggacaatgcttagaatagtgcttgatatatagtgagtgtttagtactaggtgctataaaataataatcaccattaataacaatattattattcactggattttaattgttgaaatggcacattaaacaatagagaagcaaaaagtgtcccctcacgacctcctccttcctctccccagcatgagccactgaaaccagtttggcagatatccttccagaatgtttcctattccatcaaaaactattttaaaattgtcctttcattaataaaatacaggttgagagtgaaattttttgcagtgttcttgaaagtgtgggagtggaaaggcaggaagggagacaattcactcattcagccaatacctgtcaaatgcctgccgcatgccaagcagccacaaaatgctaaggattcggcgtccagcatagcaaatgctcaacttccgttttgagtgtttactgattttctttttttaattttattaggatatgatgtttcagcttctccgaggtctggactttcttcattcacaccgagtagtgcatcgcgatctaaaaccacagaacattctggtgaccagcagcggacaaataaaactcgctgacttcggccttgcccgcatctatagtttccagatggctctaacctcagtggtgagtgagagagtgctgtccttttattaaacttatttttcctattttgaatgacagtctgtccctcttccatgtctctaatgttagtactgcccatgactagttggtggatagaatgtctttgcccatttttatatggcagtgggtaggcagaaagcattctgcttacagctacagtcacatccagcctgggcttgttgtggacaggatccattgcagaaatagcctgttgcatcttagccactggacaggaatcagttacaagtttccaaatgctttctgccataaccactgttttcagagctgtatgtacaatgcctagggaacacacagctcaaggtcagggaagaaagagcacgagcaacgttgacctgtctgcagcatcatggttttgagaaacagagtgcctacacaggtttgttaatgcactcatctgaagctatggtgccagctgtaaagaagaaatcaaattcacagtgaacttggatgatgcatgaacgtagagcaccgccatgccaggtgaaggctcatataaccctgaatagaaagagcgaacccaacggccctgttttggcaaaaaataacagttatgataccctgtttctttttgccattcagctgcaaaaccataatagctattgacattggttagcttctatttctccatatagttcattatttctcagatggatttttgtgaaattctgcaccccaaatacaaaaagagcagcctggaaataggtattaatacccttctctttgaaagacctgttttgcatacagtaaattcatgccttacgtacagtaaattaaataaataatatatagcaaattaagtcttaagaaaaagaattttaaaaaagaaaatatctttgtatattcaaagaaataaaaaaaaataatccgtattgtccatctttagcctcaaagtggttctcacatcagggacagcatggccctgttgttaagtaatgattggcaacatctttggtcattctgcacagcaaaaaattgtttccctaaatttcagtaatactacagctgataagtagaaattcaagagaggagttagaaattctctgagacagataacttgccttaggaaaaaatccaatttataaaagtgttccccaccccctgcccccagtcaaaataggggtgctaccacctagacacgtaagaccagttactttccaaacattatagacttttcctagggcatcagaacttttgatgcagaggattccttggaaaatgttgccattgttagaagataaatcctactcatttcctctttgcccagcatacaccattgctttagaggagaaatggcacgagttgatgtttaaaagataggcctcagctttgagcacggtcaagcaagcccttgtattcttatgtaatcacaccagaaagggctgagtctgtgtatttccccagtgggaagggtgaggtaggctttgagtttccctaggaagttgttgcgcatgttgttttggggccctggggagaagcttgaataggctttgtgatccagagagtcatcaggggagtagatggaaggaacttgtctccttgggtacgttaattgaaggaaggataagctgtaactgagatggacgcttttattttaatccccccaaatgggcactaataaccataaataaaaacaggaaacccagttggtttgtgtttgattttttttttttttttttgcttattaaatttgagcttgtgcgtaacatcaattaacattccattcttgctgaaagttgatatgttcaaacaggaaaatgtagacaaattatttcatagaggaaaaggagaaaggcagtcataaatacacaatttttcagtatctagtttatactgcatgctttatatttcctatagtgacataagtaaaacatgttagcagctgagaaggattctaaaacaaaaatcagactttattggaaagagtgacggttggaatttaatggtaataataaagggtatgttcctacagggtactgcattttaaaatttccccactcttttgtatttttctatttaaaggaaatacccatttaatatagtaatgcgtcgatttatatacacatggtgacataaaaacttggaatcatagttttttagactgaactggtatgtatttttagtgtctcttgaagagaaaaagactacactcctcttcctggaaatacacattttttagtgggttatgtcatacaggaactgagaatcaacttaatttgtggaatgttaaaggaattacaagttaactgattcaaaactgacatcttaaaactatgagaaatgctagtattttacttaccttgcaaagcctgactccagaggtaccctttctagtatccccttcagaaattaatttctttttcctctctgtttccagagtaatattttgggtttttttgtttgtttttgtttttgagacagagtttcactctgttgcccaggctggagggcagtggccctatctcagctcactgcaacctctgccctccgagttcaagcgattctcgtgtctcagcctcccaagtagctgggattacaggccaccccaggctaatttttgtatttttagtagaggcagggttttgccatgttggccaggctggttttgaactcctgacctcaagtaatccgtcctcctcagcctcccaaagtgctgggattacaggcataagccactgtgcccagcctataatactgttttctgtcttgtttttagttatttgggaattttatttatcaggccataagttcctcgaaggcagatgctcatcttattcagccctaacacacagtgccttgtttattttgataggcactcaggaaatatttttcagtgaataaattgacaaatgctgacttgcagatataagcagttgagtcataacaggaatagagaaggagctatgttatacatttaatggtctcatttgatgtgtgtcaatattcctcatagctacctggtaatattaagctgaaggacttactccatataccttaaaatggctgagtccattttgcaccctagtcctgattgatttattggcagcacatatctgtgttcaaaatcatgaaagctattaatacatgctgtagctcaatctcaagttaggagtgaaaagttgacgcaaacccaagttcacagtctgtgtattgtttttatcataatcctttctactgcctcaggaacaaattacatatatgaattgaacttcctgtcctgaacagaaagctgtagagatagaggaatgtagcattattgtaattttacttatttgaagactttctttagccccttgtgttttgttattaaagcaagttttagaagaggagtcatattcttctaagataattaacatcctctaaatgaaagaatgggtgaattactagacaacttttactatctatgttaatatatatatatttacataataaatgatatttctatttgaacaattataaaagcttgtattattagcttctttctgaaaacttcaaaatgttcttacatatagaactttgagggagcagttaacagtatttattttcattttaagttcatgatcacctgacagatcctgaagtactacttctccttaatttctgagccagtatgctctatgccagtattcaagacaaggcatcttttggattaattgagaaattagttgttctagacaggtaagctttccaggcatcttaaggtataaccctttatattatgatctttattattttatttttctagtgaaaacaagtttcttgttaagaaacacgagtttcataagtagaatatacttcatatgttggcctttggtagaaattaatttaggacagtagcctggaccatagttgtagctgtaggtggtatgcaacatcgggctgaatgacttatcttgtcctcatctgataaattgaggactaatcaaagagttaaatgtcttttgcctaactttgccaggctgcctccaacatgacattctggtgtctttatggggtattgggttcttgctgctcaatatagtgtcttgtatgcacatgtacccatacagagtattatacctttttctttaaaggttgtagaattaagatgtggatggtaacagtgtttgccttggtcctaggcaagaggggcccctgacctggatctcatgctttagagaagcctacactggccctactccagccttgtctcccttcatggagcacacaacccagggtgccaaggaagcatgtctcttgagacctccacccctgccccataccgcacacaggacattgcaattccctgactaaatgggaagggcatgggctcatccttcctcctaatagggattttgccacttgtgtgttcactcctaagcctaggggcagctgtttgcagcatatgggcagagcttggacttgcagactggagtgtccgtaagcatgtgtatgaggccccttgtggttcaaagaaggagttggaaatgtgaagagaagtggggcctgttatatttaacacctggcatgggttatttttatcagaaaagtttctctgaaaccatgaaaaattaacttctctgacctctattgaactattacatttgttctcattggaaaaccaatgagaacaggttacagggaagttctttccattgtacatagctgataggtaaaaatcatgacatgtgaagttatataatgtctctggcaaaagtgtttcaagaatatacacctgttcggtacaatgactgttgtgactagctgaaactatatttagagtcactctgaagtcaacatttctaagtccttctcatgtgaaatgtagtgcatggtgcaacttatttttgtgaagataagggaaaaagagaccagccactcagccagcaatttcagtcctacctcactgtgcacccgggtctgacatgtcttagagcagagccaggaacatcatcagcagccctggtgagggctctgacagtcatgaagcactgtgaccagcaagctcaggaagggagcagtcttgtcttcccatttatgatgcaaaatctttaattttttttctaaacctaatcatacagcttggagggtgatattgttgccattggatttggtgctcttggaactctttatcaaccatttcattttgaaaagtggggaaactgccattcaaacaggcagtgtgaccagcttaagtctgaatttaccaaatagattgtaaatggcttggagaattctaatgtttatattctggctctggcccactatccccactcctcttttctccataccaaaaattcagtacccaagagggtatcaaactgtgttctgtggaactctcagattctacaaagggtatttagaggttccacaaatgtttaggagtccatttttaaagaatattttttaagtcttgttaaaataataaaaccaaaaacagacaactagctcatgccacattttgacacagtgaggaacactgggtcatgaactggtgcctcctggttttctttttttatgtagacctcaataaaacttttgccacattgtgcacctgaatgtcttataaaagtatcattgcttaggaaaaatgaagcattctcttgattcagtcctatctgtgtcctctcccttaaaatcacccaagtccataattgcaacagcacattcattgtgctgctctcagtgtacatgggaatactgtaaggaccacccaaggcaatgccagtattgatgtttttataccacaggtgattgccaacacccaggcagttagagccagccactccccaggacagccatcataaagccatccgtgggtagagagaagtgtaccctaaaatgaggtcattctttttggtacctcagtatctttgtatttttggggcctttatacaatcatttaatgctattcatgaagttagcatttttccttcaaatgcctgtgccaaacacacctgtatagtttagagaaacattcctctttgtaccataatggaagagtgggagtatgttcccatctttttagtgacttaataaaattctcactaagtgaattatattctctttctccaagaatctttttttccatattaccttcactaataaaagatatacatgttctgaaaacaccctttattccatagaaattacaaaaagacaacaagtaaatgttaaacatgagaagacttttattcgacagctgtacaaagtacaaaacttaattttggaaatttttttttaaatctgtaactgataagattcccaatattgctttatttgagatcattaacttatttaataccagaagtattacaaaaattgccagggaaagcatcaggaagaatagctaatgaatactggacttgatacccaggtgatgggatggtctgtgtagctgaccaccatggcacacgtttacctatgtaacaaacctgtacatcctgcacatgtaccctggaacttaaagttgaagaaaaaaaaattacttacatccccttcctgtgcctctgatgatattccttccttactctgacctcagtgttgatagcatttagtaacactaacggaacctcgtggattcagaaactttgataagcctaggggagaaaatcaatgaaatggagttgtggctttcagtcaacaaataattactgatcactttctatgtgcagacgctgtcagtgaagctgagggatgatggtgaatggaaatggacaaggtcagagagcttacaagcgagatggagagatagatctgaatcagatagtcacacaaagaaatgtctagttagaaacagagataaatgcaataaaggaaagggatatggttttatgaggccatatgataaggctcaagaacctgcctaggctaagggccagggaagccctccctccttacccaggtcaaaatgtgggatgcttaaagaggtcaccagcatcctcctgttgaacgcgcctggatgtgggccctgtgaatgtgcgcgtcatgcaattcgtgcttggggtgtgtgtgtgtgtttggaataactcattccacggcacccagttggcaccaccaagtgacaaagtgaagcaggaccagagatcggagaacaatgtcatcttttacaggagaaaataaattgtttatgcttgtttcctcttcgtgcgtgttgtatttactatggagacctggcagggtttgtgcctcggcttgggcagccgagtagctcccacagaagcctccaaaagctgccagtgcatactgaataaatcaaaccaagaacattacatgagtataatggaaaaaacccaaagccccgtcgcctcggcacctcagcgaaagtgcaggacacacctctgaagcaggaagggctcctgtgactccttcccctctcaacatcttgccatgacacaaccaggtctgttttgttaaaacatccagttgccagtacatatttcatagttaacaatggagggtttgtgccggtttcgttttcactttcaccagtgagggaagtggaacacaatgggggcagtgcacagagctgggaacaggacacgttttctttaggattcccagggctgggtacatggaaaatgccagagccaaaacaaacatgaaaacccatccagattctccactgcgcgttctcagtggtaataaaacacatttgagttaccatctgataggttagctctgcctccacggtgaaggcaaatatcgatgaccactgtgagaatttctgccatgtagaaagagaatgtattccatactgcacagaaagctgctgttggtgcatgtgcatgcatgtggctatctaattgcaccaagtggatttgcgaagtgaatcaaatgactgattcccttgtttataaaagatagtcattcatttgactcacctaattctagctccttcataagtggtcactgttgcgaattagttctggacaaaaacagttcaactgtaatgctactgcctggaggatgttttactcggagaaagagccagaagttccttgcttttttcctacatttgttcagccagcatctatcagggtatgatacagagaatctggttgtctgtctttctttctttctttttcttttctttctttctttttcttttcttttctttcttttctttctttctttctttttctttctttcttctttcctttcccttcctttcttccttccctccctccctcccttccttccttccttcctttttcctttcctttccccttctccttcccctttccctttcctttcccctttcctttccttgaccaggtcttgctgtgtcgtccaggctagagtgcaatggcacagtcatagcttagtgcaggctccaactcctgggctcaagccatcctcctgcctcagcctcccaagtagtaggactacaggttcacaccaccacgcccagctacgttctttttttttttaagagatgggggtctcattatgttgcccaggctgatctcaaattcctcaagcaatcctcttgtctcagcctcccaaagtgctgagattacagacatgagctaccatgcctgggcctgtttttcatacggacaccctatatgatgccattcaaaatctcaaaagcctgaggccaaactggatataaagactaagcattgtcttaagattaatgagaccatatgcttcagaaagtttttcaagtaaagggcttctcagggatccagaagatgaaaaaacattttgcctcctacatttaacatttttgggaatatgcctctgtgctagtttaggggcttctctgaagagttctatttaatgagataattccatctcccctaaatttgcttaactcaacgcaagtgttatattcatactcataggagtatgagacatggtccttggaattgaatataaagcaacatttcaataatttggatttttgtgtcctctttaattctttggacacgtgagctgcttgtattttagagctgtcactgcttccttttaaggaaaggagaggtggcaatattttgcttaggctttgataatatcatagtgtaagtttctgagtcaagataatgtttctcaaattctgtaacattggccatatccatttttattcactcagtccaaataatgtattttagcatttcctacagtgccttccttgcacgaggtgggcacttgagtacatggtgaatgaatgaatgaatccttacgattctccagtgcctagagaatgaactgtaactctacagcatggcatacaaagttttttgaagctcagctccaacctacctttctgtctttccatcgcttctacccaaagtggtaagcacataacataagcacatattctttatcagtttttcactattctttgaacttaattgctttcacaactccctgcttttacaaatgaatcaatgaatggatttcctactctgcattctccatgttgctgcttgtgtcattgcatcatcaattataagcatccaaaaaaatttttttaatttgttttagacacaactttcaactaatcttcccaattgcctgcgtcactccttgataataacttgagctctgagggagtaacatttacactttgaatgtgtgtctgggcagccattcataaccttcagataattattgtgcttcatccctctttatttgagatcacaaaccttgccagatctcctgacttgtgcacttagatgttctgtatgttatgcttttattttaaagctaagatcccttgggatctttggagaaaccatagtgtcccaagaaggggttgaaaatctctgcattgcagtttcccttagtcattttatctagtccatttgggtccttgagaagattaaatttatgttcctgttatctgtgtaggtctctccaaaagttgagctcagacttttatacaattactttgtagtgccggattttctgatgcatttattgactttattgctaatcttcccaatgcatttctaaatgatagtctttggctgctgaaccattcctcttattgctcctgctttctgctttccccctctctagggattgaaacccagggtgagtgacattgttgcacccagcatctatctacaaggatactgatgatttttaaatccttcataaatttgaatgttgaactttactgttggctgtggaggaataatctaccttcaaatctcagggaaacatccaaaagagaaaaggggaaagcgtaggagaatttactttagcgctgctcatatatttattttgaaggctggcagaatctaaaaatggggctgtaaatttaacagctcaaccataaaaaccccaaaataagggagaaaaagctctactacttcaggtttggatactgatataaagttacaagattcattttcctcttctgtcttaaattctttttaaaaaatttctagcactgtccttccctttcttttttcccatttcgatttttaataattacttttttaaatgttaccaatgctttgaaatgtacggaagtgttttataaatacatggctggcatatttcagttgatagatttcatggtgacgttaaatactatctgcaccttatgtaacgctggatgatttcagtgaggtagggactgcacatggtatcagttcttgtgggaaaatatgcttcagtggcttactggcactggttttggaatgtggcatttaaaagtacctttttacagtgggaaagaattctgtcaagaataaacagtctgaccttgttaaatgggccaaagtctgtctgtaacctagttccagaaaactagcttttactagtttagaaaaagcagattagaaaaagaaaaaaaaaaactgtaaaacttttataaagtaaagcatttaaaagctactatcaagaatgtgaaataaattcctaaaatgatggtcttcacatatattcatgagaatgtccttacctgtctataaaatcccatttttgcagaatggatgaaagatcaagactacagttagtcagaaaaggagattttctttttcctggaaagacaagactggcatgtagaagggagctgtgggaacagccatacaacatggaccactgtgggaaacaagcccgtttggggaggtgaaggagtaaaaattcccagtgactccccattgcccacacactcaagtctgtatactctgagctccggaatgcagcagtcaactgttcctaacctttctctccattcttgctttcccacccacaccaaacccatctccacacaccctatgatcttgctatccagacctttttgctccttcttgaaaaatcatgccattagattttatgcttccgtgtcactaaacattctctctgcttagattgcctttcccattcccagcctaacaatctcctactcattcttcaagactcagatgccatctctgaagtctgcccaactccccaggataaagttaagtacctaccctcccgtgcacttttgatttgcctgtaatatagtagttctcatatggtagtatccccatttgtttgacttctgtcttctatttttaaaagattaacattgcaaaatagccatttcagcacttcaggtaacaacacacaggcacatggtagctgctcagtgagtgtttatagagtatatgtgggtggtaaaataggaggtttctgagtagaggaggtagaggaggactgaggttgggaagggatgctgttctttaaatattgacttccctgaaaggtgccattgtggtttgtatctgcatccatcttgaaatttaaacaccaagaattaaacttattttgttagtcactttcattgctaaaatcttgtgtttatatttagaagatattctggaaaaccaaagttactgcattttacacaaatgcatgactagtcagctggttggatattgtcaagagtgcacaagatctcagtgatactagttctttttttttttttttttttttactttttttaaattttgaggacttaaaacaaattgacttggtatttaaagttatatttcttcagctttcagtacagagcaacagagtaaatggaagcttaatcagtgatactcattctaatcataaccacttttaatgttaaatgactaatttatcaatattaatttaagtcagggaacatttttaatggagttgtaatagaaaccaaatcttgggttcaaaaaaccaatatagctttaataaaactgcataaatgttttaaaaatcaaatatgtaaaatcaagtaatttgcatatgggctttggcaaagtttttcaaaagctgcctatgcatttaaaatatgatttactagattaagatgcattttaaaagactttacaggtttatgtatattatgtaaaactacttatactgtctggccactgtagtttttacttgatatacattcaaaaatattgtattaggaaaagccacagatagcccattgtgaattgtaaagtgttaatgtcaaccgggcgcagtggctcacacctgtaatcctagcactttgggaggctgaagcaggcagatcatgaggtcaggagttcgagagcagcctggccaatatggtgaaaccccgtctctactgaaaaaatacaaaaattagccaggtgtggtggcgcattcctgtagtcccagctacaggctggggcaggagaatcgcttgaacccaggaggcggaggttgcagtgagccaagatcactccagcctgggcaacagagtgagactccatctcaaataaataaatacatacatacatacatacatacatacatacatacatacatacataggattaatgtctaaagaagagagaaactcacatgttcttatacccaaactgtccactgtcatgccttttattggcaagtagatgttaaaaatgtagcacaatatttaagattttgacaagattgaatagtccatttaaagtaagaaaagctttcaagagtgacctcagcaattttacacaagttgaaataaaatcttgtctttatcttttctttgtatttattgttctatctttatttctataacgacttcttggttttaggatgtggggctgaaaaactgcatttaaaggtcatgttgctgctactatatgcacagtacaatttgtattttccatcagcttatcatttgtaatttttgtactcctgtttttaaaggcatcaaattttttcaatagtcgattgtagttctcaagtattgttagtcccataatattttagaaaaataagatattcatcaattgctttatttttaattcacatgcatttactcagtaattttgtttttagaaatttggtcttagtagacaattttttagagagaaatagccccatttataagatagagttcaccaaatccagtggcattttttgcaggttcttccacattccctttgtagcatttgtatatgcgagtccccgctcccttaaactctcatggttctttttttttttttgggacggagtcttgctctttcacccagaccagactgcagtggcgctctctcggctcactgcaagctctgcctcccgggttcacagcattctcctgcctcagcctcctgagtaggaggctaattttttgtatttttagtagagacaagggttcaccgtgttagccaagatggtctcgatctcctgacctcgtgatctgcccgcctcagcctcccaaagtgtcacggttccttcttcagtttttttgtctgcattctttgttcattgctaaaattattttaaaatttgaacattccaccagtgtggtggttaacgcatgtaattccaccactttgggaggctgaggcgggcagattgcttgcacccaggagtttgagaccaacctgggcaacatgataaaaccttgtctctacaaaaaataaaaaaattagccaggcatggtggtatgtgcctgtagtcccagctacttgggaggctgaggtgggaagatcgcttgagcccaggaggtagaggttgcagtgagctgagagatcatgccactgcactccagcctgggtgacagatagacactctatcttaaaaaaaaaaaaaaaaaaaaaaaaaaaaaaatttgaccattccaggtaggtaaaaaaatgaaaagggaaaatcctcaatgatccttccttccagaaaaaaagccactattaacagtttgttaaatgaacttttatattttttgctacttgtatacaaccctcagtatgggtgtgcatgagggtggatgtggatgtgcctataatagtatacatacaggttttctgtttgtttgggatttcttgtttacttgtttccatttatttatcctaggcattttgtccatatctaacatatattagcctgttattctttttcttactttcactgtgtaaatttacataatatttttacccagtctcccaggatgaacacttgggtggtttctcattttttggctgcagtgaacatctttgggcttatgtttttttcactgaaatactaatttcttttaggataattatttaagaaatggtactaccaggacaaaggacaaagaatgcacattcaaaaatttgataatgccaaattgttctccaaaagggtttcagctcctactcctgcactccttaactgaatgtgagagagctcactgctttgtctctcctgagtgcctctggccattgcctttgctggcgctttctgctcttcctgtcctctaataaagcatccagcatgttctgacttcagccctttctgtgtctgactcaggtccatggctgtaactttcatctccgtgcagaggtgtccaagtcatccgtctgcccgggtctcctctgagtatcagccctcatctctgcttttccccacctctccatctggtgttccatggcagtagaaacagatcataacaaaaagatcactcatcagcttctcctttcctaggcaattctgctttggtctcctttgtttaacttcattactggtaatcaccaaagctagaatcttcagatttttttctggacccatttatagcatcatatatttagttacaagtacaaaatatccaatcaaagtgtcttgaataataataacgtttaaatctgatataagaagtctggagataggtaattctgcaattggtgctgttgcttgatggtatcatcttggttccgataaccgaatattgggaaaataccattccttcttctttggttagttgagagtgtcatccctcagggcctcaagatggctgccacaacttcaaaagcattatatcacatacaacagtattctaagcagtaggtgaggaagcaggggccaaaaagggttttattgtctctttaatcagggaagacaatcttttccaaaagctcttttcaaacttccactttaggtttcatcactcataattgaatcccgtacctacccattgaccaatcagtctgtagataagcatattgctacccaaaagaaaatcaggttatgctagccaggaaagcaggggatggctgttgggtgaacaacgaatgtacaggcccttcattagtctagagatacacccccaccaaggcagcagggccactgtataggtaggaacatctgctgttggtttctttcagaggcgcactgatatattcaccaatctctaataaaatgttttataaagcacagtgcatttttccttacgtgctccacatatgttgaaagcagaaagctttagagtttcatggaaatgttgattagactaagaatgattgcttaccacacccaccaggactatgattccttagattccttaataatagcaatcagcaaacactttttgagtatgagccatctatcagcaatcagcaggtaacattcttctcaggcaaattcaggaagctaaggattgcttttaaaaacagtgaggcaataagaaaaattatgttaaactaagaacttttaaaaagatgtgaatttcattaatattatttacgtaatttatattacataaatagtatgtttgttattaatatattcatatgattaaaagtaatattcagtatttggatgcataaataaaatacatatatgtatatatgtgtatgtttttttagttacatatatgtatatgtaaatctgaagttgcctctacaactcttacctagccagataaaccctggtgaatctaggagacaagcattgttagatctaggagagtcagggaaggcttctcaggggagctaatttttgaggcaggcttacaagtgaggaggagtttgcctggcaaagcacagggaaaggtgtgttctaggtatggggttgagaaacatcagctcatgttcacacacacaacggcaaagcagcaagaagtatgtgggttgttgagcagagtgctttaaaaccttttttaccctaaaaaaaagcagtctactacaatgtgatgagtggattggtagggaggatttggtgtgaattaagaaattgatggcagggaaaccagcgtggaggctgttttaagaaagatgtgtgacgaggggctacgtgagagcaagaatgagatgggacagaaactggaggctgttaaatgtagatccggggaaaacatgttcatgtcaaaatctgatatgaaatttactttatgagataaataagaaataaaaatatatttatttaaatcaaataagtgtctctggtcataattgccttcatactgtactgttgtggatgtgtcctgacacatgctcagaacatagtagccactactgatgtaatcactactatttttactggcagtggtattgaatatgtatagtaatttctcctggtatgattaacattttcattcaaaacggaacaaattgtataatgaagaatctctatatgacatctcactagtagttgtataaatcagaaattttctagtggtttaatgtttatcccaattgtaattcagatgaatctatcatgaaatgacttttttttcttttacaaacagagccttttaaaaaatatatttctttttatcaggacttaaatgatagatgttttactttattgggcctaaagtgccagtgacatggttatgttctaattaattagccacctatctttctgtttctcctttttcctccacataatccagattttgctaaagttggcaaattgtatacctcacttgtggtcgttatatgactaaaccctaatgagggttatgtaatgtaaacagccacaaaataccataatttacttttttccttagacaacaagcaccttgagggaagaaacgggcgtcacatagattatgctcaccaaatagcaattggtaatgatgatgcactttgaagctgtttatgtctattataaaagtaatatatactcattatagtcaaatttgtgtggtcttggtttatctccattctccattcttggttcacctcatccattcatttctctaaaatggtaacacagattagtttctcaatttcaaaagtcagataatcaaactggggtttcaaagaaagttgtaaattagtaaagaaaagcgtcaaattttttttcagccctttttcgatttttctctccttggggctaattaccttcattcacccgtcttccctcactattcctaaagaataacaagtttagaaattagatattggatataatccagtaagagtctgttcagtttgaggattttttaaacaactaaatatgcctaaaaatttcatcatcaccactgtgtgtcttcctccatctgctcatctgctgcccataatatcatacacttgataatggctgtttctcttaagagaataatgtcatgttcttgaggccagagattgttaagttggaagagtctgggaagacagcagaatttaaaacattatatacctagcattctttctaatactacatttatttatcttgtgagagagaaagagactgtgagtgtgtgtgtgcgcatgcacgcacgttttctatatctcatcaggtatttgtgaataaatagttcacacccttccaagagaataagtcctttcttttctttaaacagtgactccattgatgttgttttagaatttcttcccttgtttctcacttccttcttggcaacattgtttctgaagtcttgaattgattcaagtgttcctggaatattactttttctctcctaccattttcaaatataggcaaagagataatttttttgaaaaacattgcttccttcaaaaagcagtataacggctattatacacagtataataccacagtacatggttaaagggacgtattctggaaccagatcttttatacaaagttattttgcaacttaacaagctgtgtgaccttaaataagttctttagcctctctgtatcctgggtttcttctctgctaaaatagagaaaatgacagtacctatcttaataggattgttgtgggaattaaatgagttaatacatgaaaaagtgaagtcctataattaaattatgtaatagtaatactcatctttgaacctgaatatgaagacaggtaaagaaatgaatataaaccaatgaaaccattttattactgttaatcagttacttagaaatcacttttactaaagtttagattactaacatcttagggagaccattctctcttttttcattattatttctcaaaagagagagtgtttctggtattcctgaaatgattatgctgaagaaatctttccattatcagttatttaaacaatgttgaagtctggggaaaaataaaatgtattttttccaaggctacacacgtatctattcttcgaatacaggaaattgaatgcacaaatccagacagttgcagaattttcactgagaatctaagaatgaatcagtgtgttattgtgaatggactgtataggcagtattaattgctttgctttcaggcaccatatctcagtgtgagatctcagagtcccagaaatccagtggtgtttcttcagtctttgttccttgcttactttcaaccactaggcaagtagttgaggatggcacagaaaaattgagttgtggccctggagcacagaccttcatggttgtgcttttcttctttaccacccacaggacaaattctacaaagacaagaaaattgtttttcacgaaggacattttgtgtatttaatctctatagagtggaaggcagatgactggaaagtaacagctcattaattatgaaagtaaatttctttccctactgtagtcaaaattagcttttttaaaaagacagggtctcactgttttgtccaagctggaatgcagtggtacaaacacagctcactgtgcagtctcagcctcctgggctcaaggccatcctcccactttggcctcccaaagttctgggattacaggtgtgagccaccacgctggccaaaatgagcattttaatgttatttctgtactgagccattttgtattccaccgatcacttcctcttgggaataggtggtagttaatattcagaaaggttcatttcccaaataggttagattattctccagtgaataagtgactcattgtactatggattaggaattaatgtcacagataacatacacttctttcacatagtctgcttaagatgtgtcatataagaactctttcagctattaacctttcaagaaagttaaaagaaattcctgaggctttcagcccagcccttgtataacctgcactgtcttgttttgttttacaaagccatgcaggaatgccccccattcagaaaaggagttggtacctagactaataactgagtagcacattcaacctgcaattctggaaaatttgtatttagcatttcatacaattgcttattctctaatttagtctttaagaacatttgtcttaatattgctcttatctatctagtgcccaattcaggattcagttaagccacagtaccatctccaaagaaaacgtaccctggcttttttcagattcaaggtaaaggtgtggtttggccacataagtagtgttgtgtagaaacataattcaggagcttctgcaacatgacctgactgggatccacctttctttggatgcttcctgctctgaatgcccacagcacttcttaagccacccaattcatcctttacatgaaacctttcactctctacttaggtttcatgtgatttccaagtttttttaatgctgctcaaagctctttgagaccaggaacaatgatttgtgtttgctaagcatgccttagcatggacccaaaacgtaggagaaggttggttacttggtgaacaactacttgttatatgcttcctctcttggtgcctgaaggacatcgtagtaaaaatactttggatattctggatattttgttactattttgtgtatatatggaattctaagtacacagtatactaatgaggtaaagaaattttcacagaagcaaaaaccaagagagtttaccactaccaagaattttctaaaggatgtacttcaaaaagaaagaaaataatctcaaaaggaatgcccgagatgcaagaaagaatgtcgagtacatagattggtaaaaatgtccaaacagattcttaatcacagtaaatgtaaatggacaaaactcaccagttcgatggcaaagaatgttagattagatttttaaaatatttctctaaaaccaagtctttgctttttcaagaaacacctaaaactgatcctctgttgaagggaacataaaatgatactctactttagaaaataatttggtattaactatacagtttaacatgcttataccatgaaaccctgcaattccatgccttaagttacataccttagagaaattcctgcacatgtgtaccaagagtcatattcaggaatactctgcagcattgtttgtaataccaacactccaaacaacccaactgttcatatacaaaggaatgattaaattgacactggtatattcccacaatagaattacacagcagtgaaaatttaaaaatgaatgagctatagctacaggcaataacatggatgaatattagcaataatattgaggggaataaaacaaaaatgaagaaagttataaagcatatggaatatgtataaagcaaatctaaatattatttaggtatatttatagattaacattttttaaggaaggaaatgaaaaacatgagacttaggatagtggttgcctgtgggggtaaagagaagtaaagaagcaagggaatagaattagaaatacagaagaacaaaagagagaggagggctctgagcacccaagtagctatcacatcattaaagccttatgtctacctcttgagttcttatttagatccatactcttatttaaaatttcttcaagttttgctatagtttctgctggccagtcactgagctgagagtgtagaaattaatgatatatataaaatctcccctcattcttgtcaggaaggtgtatgataaacaaattaatatattagataaaatctctggggcccagcagtgcaatagagtgcgatacaccgggaatctattttagagggggagggtggtcaaagaaggtcttttgcgtaggagatagggacagagcatcctaagattcaggagagcattctagtcacagggagcagtgaattcagaggccccaaggtaggagggagtttggtctgtccaaggaaagcaagaaggtcagtgcagctgaggcagagtaagtaggaaggagagaggtcagggctgagatcagggaggtagtctgaggcccctctgtgggggacctgataaatgtgtttgaattcattttgaagtgtaataggtccatattagaagcagaaactagaaaaggagttaggctgataaacatagggatcataacagcaggaaaaaggcaattgataataagacacaagcaagaaaaaattcaagtgattaaaataatacacttgcagagcttacaaagagaaatgtaagtaatccaggaaatctagttacatctaagtcttcattcatcttaccagataaatgaaatgttaaaattttagttgcttgcatacataacacacagatattcttttatataacacattcatgtcataaaacatgtgatgtttatctagagaattgagaatacttgttttgtgctttacttaaccataggtcatattataatgattaatgaggtcatttgaaatgtatttttacctatcttgagatttgcagtatgtgtatgaaacatgtcatatcattagttatgcagtataaaaagagaatttttaaaaatatgtcattgcttatgactaaaattatgatcagaagtggatttatctgtgtctaatgagttttaagcttcagagctcctcactttcagctcccatcgcataccaaggttatgggagaggctctagcaatatggtcatctggtgtttttttttttaattgtggaggtgagctattttaaatgcagctgattaaccttccacctcacccatcacagttctcgtgtcaggtggcaatggagtgaccatgggcatttttgagatctggctaaggggatgttgagttcatttgggttttataagctctatatggggttcactggttacatatacatcagtgggtctcgattagggatgattttatcccccaggggacactcatcgatgcctggagacattttgggttgttacaatatgggggagagggatgttgctactgacatccagtggatggaagcctagggataccattaaacatcctacaatacacaggacagccccctgcagtagagaattgcctggctccaaatgccaaaagtgcccagattgagaaaccccttaacatagttatgcctggctacccccgtgtagaaatggcctccaggaattcacttccaccagcactgtgctgacttacctgggattcagaggtcatttcacaatatgaccatgtcctatggtctctggcaccaaagtctgtgggtagtggaggagaaacaaggtttgaaacatactgagccaaaggctagtctgaggagaattcttcaaggcaacagacatgtaccttgaaagcaaatgtttctattctcatcaatgcctagttaagatggaagttttttcataataagaaaatatatttgaggctgaccatggtagctcatgcctgtaatcccagcacattagggggccgaggcaggtggatcatctgagctcaggagttcaagaccagcctggccaacatggcgaaatcccgtctttaccaaaaatacaaaaattagctgggcatggtggtacacacctgtaatcccagctactcgggaggctaagacaggacaatcacttgaacccaggaggcagaggttgaagtgagccgagatcatgccactgcactccagcctgggcgacagagtaagactctgtctcaaaaaaaaaaaaaaaaaaaaaaaaaaaaaaagaatatacttgataatgcaacatatttaatgatagaaataaccatgcaatttttcttctataaggaaagaatcagccttataagaatcagccaaaatagattttatcaatattctatttgattatggctaaaacctgtagcactaccaccaacagtgatcacatgtgaagtgacatgttttctgcatcacagctgttgataaaaataatctttgatcaaccatgttatcttcctgtagaaaatatttcaaaaattgctgtcagatgaaagacagtcaacgagtatgtgctcaaaaataacacagggcaagtgagtttcctagtggaggtgtccgtttattaatcaaaatattgtgattttatttctgcattttgtggtatttgtcagctttttaaaagtgtgtgaggtgctcgcttcggcagcacatgtactaaaattagaacgatacagagaagattagcatggcccctgcgcaaggatgacacgcaaattcgtgaagcattccatattttttttggctgggcgcggtggctcacacctgtaatcccagcactttgggaggcccaggcgggcggatcacaaggttaggagatcgagaccgtcctggctaacacggtgaaatcctgtctctactaaaaatacaaaaaattagccgggtgtggttgcaggcgcctgtagtcccagctactcgggaggctgaggcaggagaatggcctgaacccgggaggcggagcttgcagtgagtggagatcgcaccactacactccagcctgggcgacagagcgagactccgtctcaaaaaaaaaaaaaagtgtgtaagctttagacttcacaaaccagagattgcccctgttaatgataatattgtttgtattttaatcaagtgaataaacctttgaatgtgaattccatcagtgcatctctacaacatatacttgcaaattaatctatatttttctgtgctcatcttcacttctgagtctgtagccttggagtcagtgctcttctaatctcactacctgggcgcttgatcccatccactttgatcctctccggatcctggttccatcatgtctttgctgcccccatgccttcaagcacagtctgtacccactattttccaaagaagccttaaaggggccagaggttctgggcagagttagaggcaagtgggaaaggcatggtaggcagagagagcagcttcagttgtctctgtcgtctgcctcttttcttctgtaactaaggacttcactctggatgtcattaacccttcaattttgtgcaggcagccttctgctgccatcatgttaccgcagtggatattctaaagacctcaccttgtttggcatcttcgggtacatgcatgcttctctattcgttatttcttgtaaatatccaccttgacttctgtgacatcgtggtatcctgcttttccttccacgtctctcactcctctccactgattgcccacctctgccttcctcaaaggtcctgccctatggcacatagcctgtacatgctatctccttcaacagtctcctccgctgtggaggtaatcctggaggcagggaactcatgtatgtccaactcggtccactcccttgagccccagacccaaatatctttctgaatatcatcctaagtagcaagccttccagtcattcccttctgggtccctattcaggctgatggcctcaccatctacctggccacccaggccagaaacctgggacttatcctagattcagttaatctttctttctccttcatttgactcgtttaaagttattcttcctgcctttcctctcctactgctgtggttttatacatcttcctcccagagcatctggatcattgcagccttttcattgagatccctgccttcaggatcatctccaatttcaatcctacacagttaccagaatgcaaatgtagaataatgcatatctgacatacacgccctgcataaaaccctttagtacctccccttctcctcaggataaagtcctagctctgtcaagtaacacttggggtcctgttatctggtccatgcagtttcatactcctcaacttttgctcatgttgctctctctaccagtcatgcccttgcccctcctcgctgaagcctctaacactagatacccctatcctgcaccccgcctcacccctgtggagttgatgtgtatataacatttgctgatagctaaagtttatagagccaggcacctgcagagtactttatgtaccttatccatataattctccagttgccctattaagcaggtactatgattctccatcttgcaggtgaggaaacagaggcatggagaggttaagctatttagccaaggtgatgtagctcataaaagaggagacaggatttgaatccaggcttttaaattatttacgtctacctcgcacagagcttgtgcaattggtaagttacatgtctgcctcctctgctcagctgtgagcttttgagaacagatatgatgacttcatcatctgtgtgtcatctttgcaactgagatccaatgcttgtcacctagtaggcacatttgtatatgtatgaatgaatgaattaattgttgatgtgacattgtaaatgtctcataaatctcatgagaagtgctactaagaatatgtgagagtagtacagatatatctgtatttcacccaccatgtgtattgtccatgaggacatgaaataagtaaaaatgatgttactgcctttgaggagaatttggtttagtagaaaaatgtaaatagttgaaagaacttaaatatggagcttttagaagccattctgattcctgttaccaagaggcattattagtatttatagaaatcaacttatctttttaaaggttcatcatgtgctaatagctaacagcatcagcagtttaattattgacttaatcgaggtctagagtagaggacttcctagtactttgggaactcctggccacttttcatgtcagccttgctttaaaagggatcctaaaatgtgaaagctttctgtctctctgatagtgaactaagttattagttaaaatttatcagcccagttgaagttggcaagatgattcatcttacatacatcaaattcatgcaaaaggaagatatcagttactattttaaatgcaaaaataatatgcttaaaatatagttatgggcatactgtggtttctggaattgtcctcctggagaatcattgagacatggtctctgatgttctttataatagtagcatgcttatttcataagccagagcccatataggaaaaagccttttttccaccatgcaaaggcttataactgaatgagaaaaaaataaattaattacatgaatattaagaggttacttatctattataacattgggccacaagttgactaattaaaaggaatgcaggttggaaagctgccacaaatctgctcctttcatttagagggccacaggctgaagccagtgattgtgcgtgacagactctgggaacaatggtgcagtgcacagaccgtccagatgaagcatgctcgtctgaattacaccgacgacagggtggcctacaggcaaacaaaatggttaaacaatacataatcaagtttttatttggtatttcctgcaaggctgtaccagttgccagggagcgtactgtattttttcttcggctgtattaattgttgaccatagctggcagaaccccaaacagggacagataagggggaaaatggcatctggacattaaagcctcaagtgtactgggggaaaaaaaagcacaaaaaattacagcatatatcaggaattttccagctaacgatgtgcggatgtggtagcgcgagggaaaaagagccaaactgagcttgctttgttcgctaagagaggcccccctgtaacattccttttagctgtgcatattttggcttcatttgtacagttttaactttatactgtgtgtggaggagttcagttgtaactggtggtgcctaataattctattgcaataattaaagttcatggagagctgttaggttattagttcatagaagctgcttcagaaaacggagtctaagctgaaaactttttaagtgacatgtcattactgtaaaagatggcaacaattattttctttgatttcacagcagttttttttttaagacaagattcatttatggagacaaataagaaacaacatcttaaaagctttgggtaggagtgaggggcccagactgggaatgatgagaatatggatcctgtagcctgtgaataaaacattttccaactggcttgtaaaacatgaaaatttgtgatagcataatttcatctgctacttttagattccatttaaaatgtgaaattaatatataaatgttagtaaatctattgcagaaaccaagtattgcagcttcttcacctctgatagaagtcatatgtgacttttaattcagtaatacgatgaaaaatctccaactgaacacagcctccttcttaaaagattgacatgccttggagtccccaataaaatagtaattgcaatgtacaccaattggttagagctgtgaaatatgtttcccgggggcttctctgcagtggtagagggctgtctgcctgcatggttgtcatactcagtggttacttgcagactctggagttagacctgggtttggattgtatctctgacaagtggctagttgtgggactactgtagttattaacatgtttgaatatcagtatcttacctaaaatatgggtaaaaaattatgtgcctatctcacaagtttttatgtttaagtaacataaaatgtgtgaagtccttagtgaagtgccaggcgtacggaagactcttgataaacttcgactgtttttctttggctatgtcttctctgttgtgcagctctggggtttctttgagcttctcaaaacattccttctagtcagtttctgcattagagtaaaatatatttacttaatcaccattgacttccacaatagataacaaggaacaggttgtttggtctgtaatgaaagccaggccgatagttatgattactattaagcattcttcgagaagctgaaatgttattaactgtcttccgaagcacttattaagagccaattattagtcctgaaaaacagttctctcaaatattcctaagatgacttccagctatagtatacatgtactttgtgacattatagatggctgcctggtaacgtagaggccaggcttcatctccaaatgtgaagagaaaattctctctctcattcctgtctcatatttgattggatgattttagtaagacttaatgacttttttgcgaatcggttaaattttctggtgtatgttgcttttcattttcttctccagaaatcttaatcctcttgaagacaggaaatgtgttaggagttcatagactctgaatattagaattgcacaattcatgaccccaggattccatatgctgtccattcaataaaggggtgacactgtccatgatgatcaatgtttagatgacaaacatctttaaatccacaaaatttctcatagaccaaagcgtttgttctagtccctgacatatcgaaccagttttttcaaagtaaatcatttgatctggtccctgacatatcaaaccagttttttcaaagtaaatcttgtgtcctgaaaacattttgaggccttaaataataccactcttgaatatcatcatttgagtaacttagtaaagactattaaaaaaatacacatatatggtaagattttgtaggatcttcttagcattaagaataaaagattattaattctttccccgtgaaacaacaacatataataataagctaaatgtggtcagctttgatttcataacgggaaaactcccttttcatttttacaattggtgttttctcttcagctgctttttaagttggcctgttagcaatttagcctgtctttaattttaagcaccattcttctagtcaggagatcccaataggaagcccactcttgtagcctcgcctctcattggctagctgggaaaagagcatttctgcataaattggatgcttccttctcccctggagaccaaatatgctcatgtttcacaatcccctggtttataaccttgagtccattgcctaaagctggaaactttcactttgtacaacagagcacactccgaaacccagatccaataccgctgacatgtccgtgggtctgacagcagattgaatacatgcttctttcttaatccagtgtttctgagctgctccaactgaaatcagaaaccgatgtgcgtgagagaggtgtccttcaaagaaaggtatttcctttgtgcagctccagtgcacacagaatccaaggggttaacgtgagagctgctttgaaaacagaggcgaaggtcactggcggcaacagcaaagacttttaaagcctgccgtcctgagcctttcagcctgccttccccacccaggggattgtaaacattggctcccagccacctcgtcccaaagcacaaaacttctctgtgctttcagcatatacatttatgcttttttatggaagttgaagcagaggcgcattattgctgtgagcccagagaacatgtctctgttcaatgaaaggggaggaatcctgtcctgccagaatgtgaaagcatgcagatacgcttatttagcggggcttcacatggaacttagccgctgctcttagtctgactttctcaagtcaaaagaatgtgtagaatgctgtcacttaatcagaacccagaagagctcttttatctgccatttgtttgtaacttgcaatattgtccttatctctttgtcctttagcttgatccagtgccctcagatatgagaactggaaacatgaaagcacttattaccttgagcattgcttcttgatttttgttggtttttttctttctttctttctttcttttttttttttttacctcagggtcccttaatcaccaacaaagaagctatgagactttttccccctaatttctgccttagtcctaggatcatatttgtttggtaatatttaaaagaaaccaagatgatttgtatatttacactgccatttatacctggttctttaaaagtctattattgacataactttgtatcattataactttcactgatcatttgcatgaaacagaatggaatttccagagatatcatgtgtagcttaaatttctccctcccaaactttttaatatgtcgtaggaggttaatatccttctgtctataagtaatttcagtcatttgagatcatctttttctctttggtaatttctaaagacacgaaccagagatatatttcaataggtaggaacagaaaaattatatcccatgtcattcctttttgctgtggtctttttatatatatataattttctatttcagagacagacatgtcttctgaaatggccactctgagcatattttgtaataaatttggatgcttacctaatgaagcgcaatcactacacatttctgtttgaacaatgatgcttgattctgaaaagaacacgagacagacaacagcctctcccatgttacatgacatgcagacatgattgttctctagcctgtagctacattgataagtgatatgtggctttgccttttgccactcaggctaaataactcttaaaggttcttcacaggctcttctggaattccaattttgctttatggaatcacaaattatattgagtaattattaatgttctttcagttttcctcttggttaaagtttgatttctgtaaatgtcaagtttctgtgaacagcatcactgacctggatgtattggtacacagtgcaatgttcagatggtgtcactgagcatgtagaatttatttattctaattataggattctggagttggaaagactttagaaataatcaaatgtgacttcttgattttgtagttgagaaactagggcctaacaatataaaattacttttttgcaaagtaataaatatacaaaggttatttataactaatatccagaggtatatctggatataaatatttatttaaaactaatatccagagtatatctggaacaaaaactcagatttcaaaatctcaatcaaggactctttcccttagtccatctagtcacataccccctatactgtgtggtgttcacagatgactaaagatgagactaataaatggccgatatttagatcatcttcagcaagtagatgaccacataaatgattatgaacagacgttttgtacactgagcatgaggcaacatggggtcttggtctttacttattcccaagggtacctggtaactgacatttcaaccattcagcttatcaacttgccatactccaatttcactataaacttctcacaatctgtaaaatcccccttttctcttgcctatttaatgtgtaacagtgacttcacatgacaacagtgaactctacatcaaagctgacaatatgaccaaagctattcacagaggctaattcatagcactaactgcttttatgactggaaaagaaagattgactgtaaatgtaaaagccttcaatccaagtagcacaaaagaaaaagaattcttttcaacaagcatcgattgtatttacatattactcattatgaaaaattaaaacatgttaaagtatataatgatgaattaattagaatatacctgtataaactaggatgcaggaaaagtttaaagcataaatgaataaattagaaaacagataataaaatggaaaaataaacctaccagttggtcctgagagtcaccttctagatcacgccagcccactttgctactaggtaatagagcttttgaaagaacttgtggcatatgagacaggatcacatagggctgggagggagtgctgatcagggtttctctgtgaactcagcccatatccagttattctcaagcctaggcacccccatttctttctctacttgtatctctttctcttaacccaggtaagaaaaacaaatacctcctatttatacatgttataggttcacaggtaaacaaaagacagggaaaatagtaacctgcaaaaaagagagtttgggcctgtgcaaaacagacattcctattaataattttccactatgcagattatgtttatagtttgtttggtaggtgaaccaaatatggtaaaaataccaactgagaagggtacaagaagtaccccgtgaagagcaaagatgaaaaaatattgtggatgtaccagagatgaaagtgagtaaaaatacttggttttcattcagaaaatttttctctctcaattttttcttctacacgaggaaaatcaaagaaaggcttagtcctgtgtagttctgttaaaaaatgaatttattgtaatattcacaaggaatttgtgttcctaaggtagttgtttttgttttttgttttttatttttgagacacagtcttactccataattcaggctggagtgcagtggcatgatgatcacggctcactacagcctcgacttcacaggctcaggtgattttcccacctcagcctccagagtagccgggaccacgggcacgcaccaccacacccagctaattttttgtatttttagtagaggcagggttttgccatgttgcccaggctggtctcgaactcctgggctcaagcagtctgcccacctcggcctcccaaagtgctggattacaggcatgagccgctgtgcccagcccaagataattttcatactcttcataggtagcagtttcatagccttagaaattcaggcagcaaggtactgtgattggtgtatatggacttatctttggagtaaaacaggcactcatcagatagtagctcttgctaattagcacatggactattgaaattccttcctgttaatgccaatcagtcagattttgctacagaacacattttacagaactttctttctttctttcttttttttttgagacggagtttcactcttgttcaggctggagtgcaatggtgtgatctcgactcaccacaacctctgcctcctgggttcaagcaattctcctgcctcagcctcccaaataactgggattacaggcatgtgccaccatgcctggctaattttgtattttaatagagatggagtttccccatgttggtcaggctggttttgaactcctgacttcagatgatccgcccacctcggcctcccaaagtgctgggattaccagcgtgagccaccgcgcccagcctacagggctttcatatgggaaagttaatacttttcagtcctgtgggtctctttaaagcaataagatggcatccttcagtttactcagtggttgctcttgcttttacgcttacatttaatgagttttaaaagtacagttaaagtacttccctgtatttgacatctgtgtctcagtactcaaattttcttttttatcaaaggcattctttacatctgaagtcttacatttctccatatatacttcagtcttttctttgaagaggtttactccctctgctggctctaactgtgaaatgaaagcacgtgtaatctatatagttctgattaccaatctgagggattgcttgcatatgatggtattgccttagacttttttctaaaatgtaaaattaaacttttgtttggctccctctgattctgaataataaaattgcccaaaaatctaagaaatattttatattccttttgagaacaatatgaaattctatgaaactaacagtgatttgataattaagaaattctggcatgcacatttacaatatgtaataggtgctcaataaatattagtttcttgattgcagtcatatttttattgtacatagacattgtgtgtgtacttcattgtaggagcaataaatcacccattctgtttaatgaagtcatctgtgtttctgtagcactttctcaatgccttattatacttccagccacacagtattacagttatttctttttacatttgcctagcttgactatgaactcttccaggacagacatgatatgttatttgtctttatagtctcagcttctgtcttggtaggttgattgcccagtaattattgatgaacttcaacattatactacaataaatgtcttctcatttgctgtacagacagccagaaagtataagtaattagaatttgttctgcactctacttttatcgtgaaaaagtaattgaaagtaaataagatatttattcagaaaagccactacctgaatgtgagcatatctgaactaataaaaatagtatagttaatacagatatatagcaagatgtcctcaccatctacatctgtaataatatatagtggtaattgactcccataatggttataccaaagccctgaaggattcttaacttttactttcatttttaatgcaaaaccaggttttcatatattttgcttgcttaaagcaagatatactagctcttatttttcttactaaattacatgcatacatatatttcaaattttattttagattatttgtgctcaaccccatacgttgtcatagagtagtgcttttcaactcgttttccaaggatcactaattctgtagaatgttaatagatgttatgtgagggggagaaagtcattcagctttgtaaatgctgaattaaatatttctttttgaacaaagctggaggcatcatgctacccaacttcaaactatactacagggctacggtaaccaaaacatcatggcactggtacaaaaacagacacatagaccaatggaacagaatagagagcccagaaataaaaccgcacacctacaactgtctgatttttaacaaacctaacaaaaacaaacaataaggaaaggattccctattcaataaacagtgctgggataactggctagccatatgcagaagattgaaactggaccccttccttatatacaaaaattatctcaaggtgaattaaagacttaaatgtaaaacccaaaactataaaaacccacaaagacaacctaggcaatacctttcaggacataggcacaggcaaagatttcatgacaaagactccaaaagcaattgcaacagaagcaaaaatggacaaacggaagttaactaaactaaagagcttctgcacagcaaaagaaactatcatgtttcttttgagtaaacagcctacagaatgggagaaaatttttgcaaactgtgcatccaacaaaggtctaatatggagcatctataagaaacatacaaatttacaaggaaaaaaaacgataaaaaagtgggcaaatgacatgaacagacacttttcaaaagaagacgtacatgcagccaacaatcacgaaaaaaagctcaacatcactgatcattagagaaatgcaaatcaaaaccacaagagatattatctcacaccatcagattgctattattaaaaagtcaaaaataacagatgctggtgaggttgtggagaaaaaggaatgcttatacattgttggtgggagtgtaaattagttcagcctttgtagaagacagtgtggcaattcctcaaagacctaaagacagaagtaccattcaatccagcaatcccattgctgggtatatacccaaaggaatataaatcattctattataaagacacatgcacgtgcatgttcattgcagcactattcacaatagcaaagaatcattttctttatcattcatgtatttctttatgggtatttggaatcaacccaaatgaccatcagtgatagactggataaagaaaatgtggtacatatacaccatggaatactatgcagctataaaataaatgagatcatgtcctttgctgggacatggctggagctggaggccattacccttagcaaactaacacaggaacagaaaaccaaatactgcatgttctcacttacaagtagtagctaaacgatgagaacatgtggacacatagaagggaacaacatacactggggcctattggagggtggagggtgcgaagaaggaaaggatcaggaaaaataatggatattaagcttaacacctgagtgatgaaataatcagtacaatgaacccctgtgacgcacgtttacctgtaaagcctatgagccttgtaagggcaagaaccataccctagaattcactggcactgagtgttggccaccaagtagcactctgcaaatgtttgttgacttaaaaaaaataattcctacactaattcagagtttctaaactacaaggaaaaaatggcagcatgtgtacactgattattgtccttcagcctccctccgccaaaatagttgctgtggttccccatttttaaattctgtgcgtgggtgaatgggaagactcacaacaaatggaaatgtgactgcgtgacctctttagagggaatgtggtttgccccttaactaagctacagggctataaactgacaaatatggttctatgtttagtgtataatgatgtttcagaattatgtccatagaagaaatctagtaaaaactactatccaacagcttctaaaatgtttacattattaatgttcaaacaaacatttcagaatactaagttcagttctttttcaatgcctaaattgtctaagaactctgtgtgtgtgtgtgtgtgtgtgtgtgtgtgtgtgtgtgtgtgtgtgtgtgtgatgtatatgtagtctatacacctcaagaggaggacaaacagatgcttaaagagttgggagtttgctaagtccgacatagaagggacaaaagtcagaaaaaaagcctaatattttacagttgtcttgaactactgagtcacacaatagtttaagacaatttaaaatgttagtcacaaatgacagacactatttattctgtcattaccaagaaagtccagttagtgctttaataaatccagattatattatccttttagaatacaaattattcagtcaaaagtatagaaagtaccactacacactaattcgaatggttgggaatatcaactgttggccaagatgcggagaaactgtaactctcatacatttctggtgggagtgtaaaatggttcaaccacttggaaaactggtagtatctactaaacgtttgcctactccctgtatatacccaagagaaatgcatgcctgtatccaacaagagacatgtacaaaaatgttcaaagcagaatgtttattttactatatccaaaaactagaaataaccatcaacagaaaaaattgctaaacaaactctggcataatgatgcaatggaatactacacagcaatgaaagggagaaaactatatactgataactacaacagcatacacagtttttacatattatcttgagcaaaagaagcaaaacacatgattcctttatatgaaattcaaggagcagcaacattaatctatggttatataaataggggtgcaggaatggtattgctaggaaaaatacaagaggaccttctgtggtgatggtgatgtaagtattctatatgttggtctgagtggtgtttatataggtgtgtacatgtgtaaagatacatcgaacatgttaagatttgtgtacacctcagtataaatagataaataaatgccttaggcaattatacatgtatatgaaccaatgccaacagaggccaaaattattctttacaagaaatcttttttaagctattatgtataaattttattctattgccgtagttgttaatctagaacacttttcataccttcagaattacacaaacacatggattttttcctccttgttttgatttgctgctttggacagagttcattttttggagtttgggggcaaatttggaagaacttctttatcagaaaagatacttttcttggtcatacatttaacaaatagtcattgaatgcttgccgtgtgtcagatattgcactaagcattggggatccaaagattagctagtaaaccccagtccctgccactgtagcattcaattttatgggggtaacagagatggaagcagattcttctggtcacaccagatgtcagcaagggctgtaagagaggtgtactgcaggagtgtggagtaggaatctgcttcgtctctcagaatattctggaagactttcacagagggtatcacgaggccctgcttctatttttgccatatgtcagagttctcttttaagtatctacaatagtgatttaaaagtacttttcttcacaatctatacttccaacaaaggactaatatccagaatctacaaggaactcaaacaaaatcagcaagaaaaaaaccacaaacattcctttgaaaaagtgggctaaggacatgaatagacagttctccaaagaagatatacaaatggccaacaaatatatgaaaaaatgtccaacatcactaattatcagggaaatgcaaatcaaaaccacaatgcaatactgccttactcctgcaagaatggccataataaaaaaaaaaatggatgttggcacaggtgtggtgaaaagggaacacttttacactgttggtgggaatgtaaactagtacatcactatagaaaacagtgtggagattccttaaagaactaaaagtagatctatcattggatctagcaatcccattcctgggtatctacccaaaggaaaataagttgtacgaaaaaaatacttgcacatgcatgttatagcagcacagttcacaattgcaaaaatatggaaccagcccagatgcccatcagtcaacaagtggataaagaaaatgtggtatatatatatttcattatatatataatgaaatactactcagccataaaaagagcaaaataatggcatttgcagcaacctggatggaattggagacgattattctaagtgaagtaactcaggaacgttaaaccaaacatggtatgttctcactcataagcaatgaggatgcaaaggcataagaatgatacagtggactttggggattcagggaaggggcgggaggagggtgagagataaaagactacacattgggtacagtgtacactactcaagtgatgggtgcaccaaaatcagaaatcaccgctaaagaacttactcatgtacaaaaataaataaatacataaatgagaaaaaagtactttcagttactaaaagatagttaaaatatgtaatacatgtttttcttagatatcactgtgatcacttctgtgattccaacaaatttagtttaaagatctcagttggctttattgcaattctagaaatgggcaacaccacattctgtaaaatagagtaagtgttccagttagtcaaacaaaggagagtggctttatagacagaaaaggggcagaagaaagcagaaacaaaagaacggaaagcagcttggtcatttcaaagttacgtccatgtaagggacagggagacagaacaatagataactgcttaacatcaggttacttcaagttactctattgtaaagattaaaacagagggaacttcattgtcatgctgatttaagatagaaactggcctgtttgggaaattaggctgtctttctcttttgacttctctgtctctcctgatttacccagttttggtttggtgagcataagtgactccattttaacttttagtccagtctgttggggcctagtgcaggagtttagtgcaaaataatggtatgctataatttttgtggaatatttcttaggccattttgaaagccctaacagtttccaggataaaagaagctacctgccacaggtttctagaaagcagtaacattctttgaaatgtttataaatggaaatatagcgtttctttgaattagttctgagttagaagccaagttttactcaaactcagagggttacttttcctttcaagtagtgtttgcatgcagcaaccacactgcccccaacacgcatgcagcatgagtccctgagtctaggtgagaagccttccgctggtttttatgttcacacatgtatctctcctgacagcggatatacctagaaatactctgtaagtccttggtattagtgtggttcttcctagaaactgagacaattttaagaaaagcattgtggctcattaagagcaaatgaatgtatatattctgtaattatttaatcaacagaactatattccctttcaatgatcctttctttcatctctgctcatagaagagatatgaaatgaattttagattttgaggacatttaaaattcagtaagtacagcaaaactgtgttataaaagaaagaggaaattaaataaagggctaggacacatattacatattagacctttttttttagcaactttgaaatcagatggtaaaatctagataatgtcgtcgagtccatacaattgcactgtgttcaaaaccaaagaattcttatgtcaagtaatatgattttttttaatgttgcttagtgactgtgttagaaaatggtgggtcatagtatttaggttccctaaattgtgtattttccttctctcctatttccacagctctagtcttctgtgcattttgtttttttgtaaacaagaaggcaccctttttacactacatctgcataaatgggtgaggggtgattttgaggaagagcctgacatgggcagctggtgagatggtggtctcatttgcagagatagaatacaaaaggagaaaatgttagggaggaagggtgatgcctggtcttcagggaagggatctagggaacagcatagacatgcctgtgcacacagtgcccgacttctggctcctgtgcagaacattgtgggtaggcaaaccttccctaccctccatccaggacccagtcatttgcacatccatgaccctgatccctcaactggcagctatcttggtgaaatcccttggggtcccattatcttagaaaaacaacttcttttgtttttgtcagcttttctggtaaactgcattactatggaaatgttgactattctggaaatacaaacttttttattgtaattaggcttaagaccaaaaaagaaaagacctgaggtcatttagactccacagtgaggagaatgaacctgagttcaataagacctgcttcagatcctggttctgccattggctcttctgtgattctcagcttccttatctgtaaaaatagagtcgttgatactcgcctcacaccattaaactgaagattatataagacaacagataaagttaattcagcgcagtacattacatcttctgtgctttacaaatgtttcctttctctccttccgtagccccctacttatttacactcaaaataaaaatgaaaagttttagagaagagaaaacattacaaggccccacagtaatccattctggtatttaacagttcttattgtcagaaaatacttccttctgtctaacacaaattcctaatgctgcaatctaagtccttctctcagatgtgtcctccttttctgtttgcagttttaatcttgctaaatgaacagcatgaaacaccctaatcttcagaagcatattttctttatgtctttcctttaatagcttaaagcacaaaatatagtggggaccccccccccaccacagtcctctgtagactataaattcatttctggtagcctggattactgggaaatgttgtggctggttttattttcctgcatgcatctcgatgacccatttcagatgggagtgtttgaggaggagagcgtactgcagaatgagctgaatgagctataccttcatgactgcttccacctgacaatctgcaaatcctccccatttaaggaaggcagtgctcatggaattttaaaatgttgaagaatgtgtgtgcctgaacttggattttaaaactatgcttccatttccctcatcacttgcactaaccatataacctgctagtactcatttagtaggtttgcttgcaacctgtgtcaaaaggagcatagtaaccaatgagaaagaaggcacggaccttagaggcatttgactgtttccatagcaaggaaaaacccaatttttaaattcttttacaaatctgagtaataatgtggcctctcaaagcaaatagatttccttaagagttaaaacaacttctaagaggaaacaatgagccctgcagcctgccatatcctgtgttcagaataattttcatttctacttatctgtgaaggttgaaggaatgtctgcaaatatttgcttggtttctatggtgaaagcagagggagatcaaatgtatgattgtttagtgtcaaaatcaaaactatactatactgtacttctacaaagagaatgagtttgttactttaaacataatagacgtttaataagtggtaactattttaagtttcacgagttcaagaggaaatttaaacagtgcagcctgaaggaaaacataggcccttcaggcattttaaaacttcattttacaaaaataaaatggtccttgcactttattaaaaagtcatctgttgactaaagatcatgttggtggactctcagaatgcctggtgtggacatggggacacaactatggcctataaaatttatactataatagaaacactctgtcctgccctgtgttatccctccttatcctgtaactctccattctgctgtcttctggctacccatacatttgttggaacatatgtttattttatgcttgctttatacaacactctgcgagggactgggattaaaagtccacttagaaatactctctaccctcaaagggctggctttgggcctagtagaccgtaaggatacaatgattgagatgcaatgtaagtgctgcaatcatttatgcttgcggaggactaggcagggcaaggttcacaggaattaagaatggggttgtgaagagggcattccagagaagggcctatgggaagaccacatgaggcacgacatagcacacatgtttaaagaacctcacggtctctgacaagttaaagaaagccttcatctgaagggggaacagacaatgaaggcagagagtgggtgggaaccagattatgagagcattggaggtaaattagagttgagcttgaccctgaaatctccagagaatggatgaaggattttaagcaggagagtggtgagcacagcttcagatgcagtaaagaagacagagtggcagggggcatgttggcaggaaaagaccacagaggaagctatttggaccatccaggagaggacatgctctcgatggaattgtcgggatctgatggtggcttcattgaaagtcaagagaagtagggaaactgggtaggtagcgattttgcttacagagagaagaaatataggaaaagcaagtttcagaggaatgacaatgcatgcattttgaatttgagatactggtagcagcactaagtagtgatgtccgggagacagttggatttgtgggtcagagactgcagagttctgaatacagcatggattggagcgggggtggggacaggcacatggagtgctccacaaggattgtgcttcatgtaagaaaagtgactgcctgaggatgtcgccttagattaagcaataatttaaaagagacaaaggcaggaggaacactaggacaggaccgtagcattctgcacttaaattgctacacagacaccacccctccctccaacccagttgtacttcagccaactcatttaactcattgctttcctaatttgcgaccacactgtccaggactaacatggtacctcacagagtagacattcacatgatgaattgactggaagcttactttgacctaaaggcttgctgtctaggccttttgtaggtagatctgcttagacatagataaaatgggggagaggtgtacgactcagtaagaaatggcaagtgccactgatatcacaaaaggtcagaaacctggatccctgaattctacctttgctggtccttcagtgagtcattttcatccctcccctgacacgagtacacagcccccctgtttactgagtggctctcttcccccaagatgcctttcctctctacttggagggaacacccattcagctcattttccctgtgcctttcattgccctgtgagtcttcttacacaatctctgaagctaatcaggtagtgctcttccctccacaggatcatttcctctgttaaagatacatgattactcaaagatattaagttattatgggacagtattgtcctcatattctccagtctaggtgattgcctctatccatcttcagcactgccactgggagtttcctgtggttattgatgtatctagctatcagataattactgagcaccttccatgcatgacactgtaaatgtattgtggccaagaaatggaaaagctataatgcaagatagaaagggtcaagtactatagaagtgcagtggaagctcagagaagagccattacttccagctgggagatcaggaaaggctttgtggatgaagcaatatgtgagtgaggcttgaaagatgggtaggatctggacctgcagagactcagagaaagagaatcccagagagagaatcagagaaccacaccagcaatagcaggtgatgggacatccacatatctaaagggagccagtggccccatgtgagccaaggcagctgtagatgtgaggaaatacagcccttctgctggtaatggatgcatcagagcagaggtgaggacaaagttattggcacagcgctccctgctgtgagactctcatctttgtattgacctcagacatttttttgccatatgtcaaaacatctccttctagcccttagattacaaatgggtgaatttgagatgactccattattattttatgggtatttaatgctttttttttttttttttttttttttttctgagatggaatttcactcttgttggcccaggctggagcgcaatggtgtgatctcggctcaccgcaacctccacctcctgagttccagcgattctcctgcctcagcctcctgaatagctgggattacaggcatgcaccaccatgcccgactaattttgtatttttagtagagacggggtttcaccatgttggtcaggctggtctcgaactcccaacctcaggtcatccgccctcctcagcctcccaaagtgctgggattacaggtgtgagccaccacacctggccagtatttaattcttaatagtttccataaccagttaaggtgttataatgagaagactgtgcttggcagaattagaattccaattctttataatattcttcatttaaatatgtaattttgaagaactaaattatggccgggcacgatggctcacacctgtaatcccagcactttaggaggccaaggagggcggatcacttgaggtcaggagttcgagaccagtctgggcaacatggcgaaactctgtctctaaaaatacaaaaaattagccgggcatggtggtgcacgcctgtaatcccaactactggggaagctgaggcaggagaatcacttgaacccgggagaccgaggttgcagtgagccgagatcacaccactgcactccagcttgggctatagagtgacactctgtctcgaaaaaaaaaagaagtaaattttgcacctctgtgaaaagtcagtgaaattatcactagttttgattttcacttcacacaaccatactagttttctatagggagaaaaacatatgtattagaaagttttatattgctctgatgcaaataaacagattagagcacagtttagaaaaccttcactttgacaaaataaagattctgaagtatttcaaagattatatttatattcctgataaaccattatctatgtttgtatttgagacatgttgttgaagtgggcccgagaaggagaatatcaccacactggaacactccataagtaattactaaaccaaaggacagcaaagatatttaacgataacgttgttgggtccataaagtatatatgtttttttaaatcttcattgccattgccatatcatttagggagtcttaaaatgttaacagaggacaccttatagattacccagtccaaacatcttctttaacagatgagaaaactgaaacttggagaagaagttgccacccacgctggtttctccatctataaacaggatgtatcagccagggtcccaacaggaaatagatggcacactcaaactcaagtagttcaaggatttcttgacacaggcatgatttgcagagatgtgggcttaggggaactcaggggatggtgctatgacctgagtcttactcgcagtcagttcattaccattcccaggccctagaagaagaggggaagcagttactggaatccaggaggaagaaagcaagtagagcaggcttcctgagatggacattgactttgtggtggcaacacagtcagttctagacagctttgctgggaggaaaatcaaagagttgaggatcctgacctcatgcttctccttctctctgaattcctgccgagacttcccattggccaaagccagtaagaaactggaggcatatggcagatacaggtccatttctagggcagagactatctggggcaacaaaaagaagacatccagcacagtgttcataccatgcttttctgccattgtggccatataatgaggatgaatcagataacatctaattttttcaagaccttggtgaaagggtacatgataaaagattgttaaatataacatcaagtgagagcggtttactctgaaatgtattttaagtcagagttggccttggctgtactttttcttatactattattgaacaggttcaaaaaaatgtgaatagagatcaaagcagtttaaacagatacatccacttgtgtaaatatccttgaactcccccctgccttccgctccccctcctgttgccacatccattcagcacctctagaggctgttaatacatgtaatgattgtaataaacatggtatttgctttggttccagctggctccaatcaccaaactctgtccataattcctattgtctttgcttactagacaactgcattgttaccattagtagcgacttttgttacggatttctaaatgttgatctttatatattgcactcattgttttcctcaacatgttttaaaatttaaatttaccattatattttctttttaaggatatttagaattattaaacagaacttctggtagaattgattatattgttgagaactttcacgagctaaaaccttgaaacaattttattgatattattcattctttataaagctttcaaataaaaataagcttctgctcatgcatgacttaaactggttttaagttcagcagtcttccatcagaagtttttagaggcacagaagtataataatgtctaagcaaagggaatttatattttactgtcaggaaaatttgttgcaatttgttctcaaaaacttggatccagatttagttgcagtagatattttaaatcctatgaaattacagaagttgtcataatttgagataattaaaatttcagtgacttaatgtagggactgaaagactgtggttcagaaattatagaacagccaagtaaattaacaaattaaaactggggatgctctcttgatatatagaataatattacataaaccaggaaacaactattagaaaatgctattcttttatatctattgcaaaatatagtagtttgttttccttttttttgagacagtcttgcttttcacccagactaaagggatacaatctcactgcaacctccacctcccaggttcaagcaattctcctgcctcagcctccctattagcagggattacaggcgtgtgccaccacacctggctaattttttttatttttagtagagacagggtttcgccatgctgcccaagctggtcttgaactcctgacctcaagtgatccgcctgcttcagcctcccaaagtgctgggattacaggcatgagccaccacgcctggcccagtagtttgttatttttaaatgtaggcccaggtcattgatggggttattttattagagaattaactagaaatgtaagtcttgaacaatttatactttcttttggaattgaattcctcaaagattgaaccaaaaatgatgtctctttagacagatgttgatagtttaaaatagagtgtaagcataaagttagtctaatttcactctcacttggttacaatgatttacacagactagagcaaaatcttaaggataaaaacgagatatctaaattttagctttcattgaacttattaaatgtgaagtgatgagtagatgtcatatcatatagagaactggaaagtaatggaaacgcttttctttcttttttttttttttttgagacggagtctctctgtcgcccaggctggagtgcagtggcgcgatctcagctcactgcaagctccgcctcccgggttcacgccattctcctgcctcaggctccccagtagctgggactacaagcgcccaccagagttgtaaattttgcaactctgtgaaaagtcagtgaaattatcactagttttgattttcacttcacaaaaccatactagttttctttagggagaaaaacatatgtattagaaagttttgtattgctctgatgcaaataaacagattagagcacagtttagaaaaccttcactttgacaaaataaagattctgaagtatttcaaagattatatttatattccttataaaccattatctatgtttgcatttgagatactgggggaaggaaaacagaaactcaactctcttttagagtttgacaaatgaagtatagaaaaatataagtaaggatttatataagacaaacccttatcaataaagaactttacaaagacagtacttccattacactcccagaacaaaaaccaagtatatacatcattttaaagaaaacaacaataaatcctaccaagtagaaattgtacagatcatagtctctgttgtaattcaataaaagtagaaattcaaccattcaaagatagccataaataacctgaccatatggacatcttaaaacacttttctaaattaaagataaattacatagtatttaaagatgagcaaaaatgagaaaagtttatctacaaatatgtagttagcattttattattaattaaaatggaaaagaaatgagctaaattttaactcaaaaaaaaactcaacaacaacaaagaaattaggagaaaattttaaaagataaaaatagaaatcaacaaattataaaataaaacaataatcctcccaaaatggaaataaaattatgtcagtttttttatataaataatatggctaaacttctgacaaacctgacagatataaagagaaaacaaaaatttacaacattaagaaaaagaaaatcagtataaccaaggaaacagatgaaattaaaatgattataagaaatactatgttcaaatttaagtcaatacatttttaaatctagattaagaatgttcgtaggaaaatcctttatcattacgaaaattggcttctaaagaggttgaaagctgagcagactaattaccaagaagaaattcaaaagaccgttaagacacactgctaacaaagatccagacagctctatgagcgagattgtttgaccctcaagaaactgattattcttctgttgtttgtactattccagaatataataaagattggaagcttgaatatccctgataacaaaacatgaaaaattaacacaaaaaagaaaactacagatcagcctcatttatgaatataagtcaatatcctgaatagatactagcaaatagaatttcagagtgtcttaaaagaataatacacaatcagaaatgatttattccaagaaggcaaggatgctacaatattgggaaatctgttaatgtaactaatacgtcattaataaaacaaaggcaaatgattatatggtcattattaatagacattttaaaaagcatttgataaaaattcattctacattttgagtggtaactaaattttaaaaggaatagagggaatttccctaacatatcaatattgttattatgattttgactgtctatacatttatttatcataataggtataactgactgaagtattgaaaatgaagacagtcagccttactaaagttttttaggatgggtaatcaatcagaaaccagtttcttgctgagcacagtggctcacacctgtaatcccagcattttgggaggctgaggtgggcagatcacctgaggccaggagttcatgaccagcctggccaacatggtgaaaccctatctctacaaaaaatacaaaaatattagccaggtgtggtggcgtgtgcctgtagtcccagctacctgggaggctgagacacgagactcgcttcagcctggaaggtggacattgcagtgagccaagatcgcaccattgcattccagtctgggcaacagagcaagaccctgtctaaaaagaaaaaagaaagaaataatattttccttagaacagcttaaaataaggctgtattcagattaaacttttctttttatgttgctagactttattttgaattgaggtagaaagataagtgtgtgccttcatgatatctgtgtatttctgtcaaccactcaagtggaaccttacagacagtttgcacctgcagttttgtttacagtgtgtcagggaagcaaagaagtgttcctccagctagaaatattaataaagcagaaacaagtaatgtaactaaaactagaccccagtattggacactcttcttagcaaaaacaataccttcccttttggaaatgactggtcattgaattttgcccagttatctttctaggaatgattgccttaaaaggattaatttgataggtgtataagcccttattgttgtgtttacagtactgtgataggcatttacagatataaacatagattaaggcagggccatgtcctcaggaacaaaccatattatgagctatgttacaaggtatgattttcagatagcagctggtgctgcaacagggtggtgctggcatctaggctaggccttgtagaataggtgaaatttacatatgtggagaggagaaagaagagttgcccaggctaggaaaatgatataaacaaaagcatggagacaagagcgatgggatatgcttgcataatctagtggtgttcaaacatagccaagggtgaggattagttgaagaactcaaaaaaaaaaaaaaagaagaaagggggaggcgcagtggctcatgcctgtaatcttatcactttgggaggctgaggcaggcagattgcctgagctcaggagttcgagaccagcctgagcaacatggtgaaaccccgtctctactaaaatacaaaaaaaattagccgggtgtggtggcgtgcgcctgtagtcccagctactcaggaggctgaggcaggagaattgcttgaacccgggaggcggaggttgcagtgagctgagatcatgccactgcactccagcctgggcaacagagcaagactccatctcaaaaagaaaaaaaaaaaggaaggaacaaaagaggaaaactccaacccaaaaagttcagcccacagaaagtctaattcagtggcacaagataagacctatacacctaagtttttctaaaaccccatggggattttgatgaacaggcagggttaaaaaccagtggtgcagtatagatgtgactaggatataaaggctatggaagttctatgggaggtgatgcattgatggaaaatactctgggaggtgatgcattgatagaaagatatgttggggccaaatggtaacttgagtaacattgtttcagtattgtcagttttgtgttttgttttttatttctattatatcacaaccatccctccattagatatcaaccagtattacttaaacaaaacttgacccatgtgtgaattcaaagcaaaatatgttagatgagatatagagggggaacctgtcaagaatctttttccaatttgatgttgccatataatcatctaaagacttaaaacggtcattttattatcactcataatcttgtcagttgaccggactcagctggcagttctgctctgtgtgacattgtctgggactgcagttatatgggaggtcagttggcttgaatgtccaagatggctcattcgcaggctttcagctgagagctcaactggggctgtcaaccagggcatcttcatgggcttctcacagcatgacagctgggttccaagaggtagcatctcaagagaaaaggcctaggctcaggcttcttatgacctaacattggtagtctcagacattacgtctaccatattctgtaggtcaagtaagtcactaaggccaactcagattcaatggaagatgaataaaatccatcccttgatacgagcaacagtgtgtgcaaataaggagagaaggaaattgatggcagccgccatttattgagacttgctactgcaatcttagcacaccaagtaatatagcatcaaaatatataaagcagaattttagaaaatttagatagacatccataataatacaactagacaaaacaataaggataaaagggatctgaataatataaaattctgacgtaatagatttatattctgaattccttatctgacaataaagaatgcacctcccagggtatccatagactatctgccccttcccccacaaaaggaatcacttgaaccccccctatgtactcaaatctgcagccttaacatgatatgctttcttcagccctcaacctggcaggaaaaattgttgtgtttgtttcatctattactatacgctgctctgtattaaatgagtttcttgtctttttggaatcccttcctctgcttggctttttcacacatcatatgaacaattgggttacacattctctcttaagttcttccccactttttacttgttttctgaaaagagcatcatggagaggggttttactttgattccccaagctgtcacggtaagagcagttttgacatgtcctgggtgttgtgtagacttcagggacaccatccagcagccctggcaccatcttcatatatgtgtgtgtgtgtgtgtgtgtgtgtgtgtgtgtgtgtgtgtgtgtgtgtgtgtatgtgtctgtgtgtgtgtgtgtgtatgtgtatatatatatatatatatatatatatgtacagcttttggggtacaagtggttttgggttacatggatgaattgtatagtgatgaagtctgagattttagtgcccccatcacccaggtagtgtacattttacccagtatgtagttttttctccttcacccctttctctaccctccccctttctgagtctccaaagtccattacaccactctgtatgccatcatcttctaatctgccaataatgctggcctggggattgagctgtaattgttgccatcacctgttttccatgtattattttttaaaggcccttaaagggggggagaaaaaaaacggtttctaagtttaaaaaaaatttttttggtctttgctttctgaaactcatgttattatgccatcctagttagacatagagttggaggtgggaacccagtttgtggggatgatgtaatttcctggcctgtcagtgatgagtcctatttacctattgcttctagcgcagtgtccttatatgatttataggagttctttctgaactacatcttgtcattaaaccaccaggtttagtcaggagtctaagccaacagccaccttctcagtaacacttggatccgcttgccattgcaggtcgtcacgctgtggtacagagcacccgaagtcttgctccagtccagctacgccacccccgtggatctctggagtgttggctgcatatttgcagaaatgtttcgtagaaagtaagaaatacattttgtttcactctgctttccttgaaaagagactgtggatctttgtgaatttgagtggcagcatggcatttctatcattaggggtcatgatggccagatccatctaccccaggctaccacttgcaagcctgtcctgaaaccgccttctcagtgcttacagtgttgttttatatgactgtagcttgcagcttctggaaactctgcctgggaaggaataccccactgttcttataagttacattgttttactggtgatgataggacatggtgaaaataacacatattttcgcatttttttagtgaagaaatatctcaaagtggactttatccataggaggagaaccaaggctgttaagtgtatgaaaacttttttgatggaattttgatagtgagaatagttgaaaaaaacaatatttaggctgaaaaagaataggcagtggggatgtcagtgctacttcagagcactttaaatgctgccgtgtacaggagagattagatatattcaggtactatagaggacagaaacaagaccaaggatacagaaattacaaaaagaaagatttttgttaaaaggggtagaaatctaatgattagacagttatctgaagagtggattggggtttgtgagaatagtgagttttcattgtgtgtctaagaagaggctggacctccacacattggtgatgtttcagtagcatttatagggttggtgcgtaggctagatgccctctaagttccctctaagagagcatgtgattcgtttgtttgattttcaggtcacaagaaatagccaaataatataataaagatctgccaggaaaataatccatatctgggtactaagttcagcctagtctaaattaaacagagaacctaatcataatctaatcttttttttcttttctatttttatttccatgggaaaaggtaagttaggaaacagtatattcccattgtatctttaaaatgtagctccatggtagctcacaaggaaaagaagtggtcagccattgcttgcttgttgtttggttggttttaaccaaacaaagttttgtgcatgtaacaaatttttggaactgttgctagtactcagcaaattcatctgtggctcataggataggagatcatcacaaggagatcagagtaaacagatgtttaatgcagccataccatgtgccaagtatagtgtcaaacctcttcttttatgctacctttcttagtcctaccaataagaacaaactgagatggagtggtacatttatttgtctaacattaggcagctaagaagtagcaggggtatgagtccaaaggaagcttgcaagttctattctggtgttgcttttttcccaaggagcggggagaaaaagtaatactgaaatcagctgcagtgtttgccaaacaggctaaattagtgattttgaaagtatggtccctgaaccaggaacctcagcatcaccaggcaccttgctggaaatgcaaattctcaggccccaccccagacctattggttcagaagttcttgggctgggagccagcaacctgtgtttcaacaagtcctccgatcctaatacagcctccaggataagaacccctgggttggatgacagtatgaccagggatgggcagtctttaaaagtctggctcccaggcctctcccttgagattctgattcattactgggctggggccaggaattcttatttttaaaagtaccttcagcgattcttttcatccaacaagtgtagaagacattgggttaaaggcttatggttagaaccaagaataatttactgtcaatagagcagagtaggagttaagacagtcattctacttcatcgcaggaataactcggtacagccaagagttgattacagaaatgcttattggaattatctttatgtgtctagaatagtctcaactgtaaagacagagtccttcaacaattacagacttgaatactagtcatgattgatgctaaaagtcaatttttttaagatgttaaaagaaagataaaattttatatatgtagaattaagtattcactactaaggaatttgctgtataggcaatctccatttgtggaacaaattttattttaaaatgttaaaagcattttccactgaagtgataagtggtcactggattccaagcctagcttgcagaatcctctacgacctggaacatatacaaaacacccattgtgctaattcatcaaaattttttcttctgtgggaaaattcattctatgttccaatccaagactagaggaatacttatctctccatctcagcattgggactgagaagtaggactcaaatattggaggctcaggggagggttcctttgatgatagtggcagcagtctgcttcagtttgctggaaaagtgagacattgggtagagatcctttggcacttcaaatgtgcacataagaaagtaccctttctccagaagccttgcacaaaaatagtaatttgagaaataattgcttgaaggaggaagcagtatcagaaaccaggttcatatgcctttaaggctgaaaggagagtgaatcaaggccaatcataccatccctcctagggtggctaccctgtgtccttggtatttcctatgataccccccagatatccatgtgtcatgcttcttacttatgccagatgagttctggggtccatcaccagcttgacctggttctgacttgactcctgattcagtattgacccagttgagacttcacaagccataggctcttaaagcagactcattcattgctttaggctaatcctaaatcagggaatcctagcatcttttattttttgtagagatgggggtctcactgtgctgccctggttgtcttgaacttctaaactctgggtacccacttgatgctaaggcagtagttaccaaattttgtcctttctttatcaccttcattgtttttgccatattcttatgagactggtactattatttacgtaggttttttttactactctctgtcagtttacttttttatttagcctcatcctaaacaaaagtacagtcatgtgttgcttaacgacagggttatgttctgagaaatgcattgttagacagttttgtcattttgcgaacattgtcgaatgtacttacataaatctagatggtgtagcctactacacacctaggttatatggtatagcttattgctcttaggctgccaatctgtatgacatattatcatactgactaccataggcaattgtaacacaatggtaagtatttgtgtatctaaacatagaaaagatacagtagaaatatggtataaaaaataaaaaatgatttacctatatagaatgcttatcatgaataaggcttgcaggactggaagttgctctgggtgagtcagtgagtgagtggtgagtgaattgaaggcctaggatgttactgtacactgctgtagactttataaacactgtacacttaggctacactaaatttatctaaaaatatttttctttcttcaataataacaaccttggcttactgtaacatttttacttcataaactttttaaattttttggccgggtgcagtggctcacgcctgtaatgccagcactttgggaggctgaagcaggtggattgcttgagctctggagttcgagaccagcctgggtaacatggcgaaaccctgtctctacaaaaaagacaaaaattaaccagacatggtggtgtgtgcctgtagttccagttacttggaagactgagttgggaggatcactggagcccaagagaggcagaggttgcagtgagccaagatcacaccactgcactccagcctgggcaacagaaggaggccctgtctcaaaaaaaaaaaaaaactttttaaattttttaactttttgattcttttgtaatgacacatcttaaaacacaagcaagccagatgcagtggctcactgtaacccaacactttgggaaaccagggcaggaggatcacttgagtttagaagttcaagaccaaccagggcaacatagtgagacccccatctctgcaaaaaataaaaaattagctgaacatggtagcacacatctgtagtactagctactccggaggctgaagtgggaggatcactggagcccaggagttcaagatgacagtgagctaggatcatgccactacaccctagcctagataaccttgtgtctaaaaaaaataaataaataaacacaaaaacattatacatctatacaaaatcttttctttatatcctcattctataagcttttttatttttaaattttttatttttttactttttaaacttttttgttaaaaactaagaaacacacagattagcccagacctacacagaatcaggatggtcaatatcactgtcttgcctgtccacttcttgtcccactaggagggcttcaggggcaataacatgcatggaactgtcatcccctgtgataacaatgccttcttctaggatacctcgtgaagggcctggctgagactgttgtacagttaacttctttttataagtagtagtacactctaaaataatgataaaagtataatatagtaaatacataaaccagcaacagagtcttgtattagcaaatattatgtactgtatataattatatgtgctatactttaatatgactggcagcgcaataggtttgtttacaccagcatcaccacagacatgtgaagtgagtaatgcactgcactacaataacgttaagatggctaggagataggaatcattcagcttcattataatcttttaggaccaccctcacatatgtggttcattcattgttgaccaaaacgttattatgagggtcatggctgtgtataaaaatcagagatttgaccggttatttatttgtctgatacacattagaataaatatataaccactaaaactattcagaaagttcatgcatgtttatcccctaaatcatctcacatgtcaccaacagtaatatgtcacatgttggaaaccctataacaagtgttccattcagtccacaattaacttatggagtgactgttgtatgccaggcccacttctagaggggtgacttaaatcctagtagagaaaaaatccattgcctgcacaattagttaattaaccagaggtgggataaatgctgtgaagaagtgtagagtactgtgagtgggtataatgacaagtctgtttttggagagggaagatttctcagtggaaggccagcagttgggattaaccttctttagaggtcgcatcctagttgtttatttaaaatctttgaggaatagtcatttatgtgtcagcgaggctcaccatcctccataacctagggagaagaaaagaagcaaagggagttaccatttgtcatgtgacaggcccatgccttggcagttgggggttgggggcaccttcatgtgcattatctgcttaaacccctattctgaagacttctttccagagcttacagataatgaactagaccttccacaaggagggtgaataacttgcccatgggcatacaacaatcaaatgacagagccaagaccccatgtctgcctgactcgatcgcctttgatttttctactctgctgggtttctgccattgctgttgtttgacctactaggccatatttttttctgtaatgatttgtgtattactgtgatgtagcagcaatgatattttagagtggtcaagaagcaaatcacacatgtatttaatagctttgatttagaatctgtcctgtattggaaaggttggccaattctctgtcatattattaagaggtgcatgtcttttgttcaaaaatgaaatacctaggaaatataaactcagtaaagagagtcatagggcagatggttgacaaagagccagagagtttaaatatcatctgtcactgttatctgggtttaataactgcccacactggcccacagaagtattctacaaaatgggtaagagctacatttttttatctttctcctttaattcttcatccagagtaacccatccttactccacattgaattgtattttaatactaaaaaaaaattgttataaatttggttagtggccaactagtcagcttaaaggatgagattggatggatggatggatggatggatggatggatggatggatgattggatggttgtgatagattgatttttaactatacagcaaaataaattcacagtattaactccccaggtatctattggttgccttgtaatcctagttagaactgtctgtagtttgaaagttatggggttttccaggttacagcaaagtcacataaaatgcacatttagaaaataaaacatgcggccaggcgtggtgactcacacctgtaatcccagcactttgggagcccaaggtgggtggatcacgaggtcaggagatcaagaccatcctggctaatacagtgaaaacccgtctctattaaaaatacaaaaaattagctgagcgtggtggcatgctcctgtagtcccacctactcgggaggctgaggcaggagaatcgcttgaacccaggaggtggaggttgcagtgagctgagatcgtgccactgcactccagcctgggtgacagagtgagactcagtctcaaaaaaaaaaaaaggaagaaaaaagaaaataaaacatgtttctttgaatacgaagattgtggcaagcagatagtaattcttagaagttctgagttgccagctctgccaatccatagctaagaaatgccaaatgccaccaggaagaatataacaaatagagtcactgttagaaggaaacaaacaaggcttcctgatttgtcatatattgcctcttgtctggtggcctctctaggcttgtcgtcattgatttctatgaattaaacaccagtagctgagaaactgacagtgaaactgtcctttgtgggtcagtggtcagtgagcaaatgtctttaaaatgtcactgactaccttgccaattttcccattggttactgtgttggtgcctccccatagttgagcaccctccctagtgacatccaggaaatgaggtccttcacaagctgacctgaacaccagggtgccagaaggcacgccctagcctgtgagaagaaacccatcatttcaggttaggtcgaaacacgtgcatggaaaccagggcactttagactttcagatttcttaccttttgttggatattttcctagactctgtttttgttttttttttcttcctttaaagaaccagccaaatgggaagatctctttttttttattttatttttttgaggcagagtctcgctctgtcacccaggctggagtgcagtggcacgatcttggctcactgcaagttccgcctcccgggttcacaccattctcctgcctcagcctcctgagtagctgggactacaggcgcctgcccccgtgcccggctaattttttgtatttttagtagagacggggtttcaccgtggtcttgatctcctgacctcctgatccgcccgcctcggcctcccaaagtgttgggattacaggcgtgagccaccgtgcctggctgggaagatctctttaaaaagcatttttatgagtgaggaaatatccaagatggtacccaggaaaaggtccaattttggttgagtaatgcaaacaaggtagttctaagtaagaacaaattaatactttggtaatgttattaatattgattttttaaattcttttttttttttggagacagagtctcgctctgttgcccaggctggagtgcagtggtgcaatctcggctcactgcaacctccgcctcctgggttcaagcaattctcctgcctcagcctcctgagtagctgggactacaggcacatgccgccacgcccagctaattttttgtattttagtagatacggggtttcgctgttgttgcctaggctggtctcgaaatcctgagctcaggagttcaccttggcctcccaaagtactaagattacaggcatgaggcaccgtgcctggcctgattttttaaattcttgatgtgtactttaacatgaatttgaaaaatatatttgttttcatgacatatattgagaagccaccaccagacctggcctttccctgtggcggcatctcttggtcctccaccttcccactccagggcacctccattctcatatcctaggtctgcctgttctgtgatctttaccacaaaccagattttatctgcttagtcttcttctaaccattctatcacatatcatataccactctaccattctttcttccctcttacttcccaagccattgcttccctcttactaacaactgctggtttattacttcttcccatgttcccatccctgttcttagcccccaatacctcccctcgctgactctctacttctgttactcctttcaaatctgactcttggaatccttgtcacataggaagaagttcctttcttccccaaacttttactcacaatcttcttcaaggtaactaaaacccggcctttttctgtaggtgctctatcccctcaagaagggaattgcagtgtttttagctatctgcttcttgggggcacagttccgccaaagcctcccaacttctctttgcaatcctcttacactcctgtctccccagtcctaatggcatgacctggagattttcaggacccatgattttccagcaaagagtcactacagagtaagagtaaatgttactgacagaagtgttttgcaaatacgtggagacagagcagtttgagggtcttgattgactcagcagctgcatcactcagcttgcactctccctgtcccccagcctatacacaagcatttagtgacccccgtgagaattaatgttttcttctcccttctcatgacattgtacattagggacttcatcatccaaatgttccaccactgaaaagaaagctctacttagagacagaaataagagcaactagagcacacgtgcttgtttaacacttgcatctaggcttttggtgggcatgtttcctcccctccagctcccctcctttggtctgagacccacttccatgctaggattcacttctcttcccatccccacgatccttaagccccaacctacttccacacccccaacccaacattcagccccatctccagttaattaagatgagtgaagccctcgaagtgagttccttttctctttcagttcaaaaatttctctttatcttcaccttctccttccttccctccagtttctgagaaggatgcattctccctgcttacaaggcaaatctccctcaacccttgctcttgttcctaccctgcttctaggttctcacttcatccatcatccctttctgacttgcctcgtaagagtcaaatcatgcccttgtctctccattctggaaaagattctcattcccctttgtattcccctagtctttctccttcccttcatgcccagacttcttgaaagaatagtgtctctacatgtagcctccacttcttcttcacttgctcatttcttcatcccttcccatcataaaaataatagataacatttattgcacacttactgtgagccacgctctgtacagttgacccttgaacaacataggtttgaactacacaggtccacttatatacagattattttcagtaaaagttacagcaagtgtgcctgactctcctatctccctttccaccacctccagctcttccaactctgccacccatgagacaacaagactcacccctcttcttcccctttaccctcagcctattcaatgtgaagatgagaaagatgaaaacccttatgatgatccacttcctcttaatgaatagtaaatatattttctcattctcatgattttcttaataacatttcctttctctgcttactttattataagaatacagggtataatacatacaacataccaaatatgtgttaatcagctgtttgctattggtaaggtttccagtcaatactcggccattagtagttaagtcttaggggagtcaaaagttatacatggacttttgactgcacagggggtcagcacctttaacccccatgttgttcgagggtcagctatatttggtgctttaaaatacacaatttcattttaatctcagaataactttataaggggcactgttgtcatccctatttgacaggtaagaaaactgaggcccaagaagaggctttgaaccaggattatttgacttcagagtcctcctgacacttaagctgctatattagaggttgatggtgacctcctcatcattgcatccaggagcctcctctccattctcatttcatttgatgtctgcagcatttgaatcttgtggccactcactccgtgaaagcctccctgtcctcactgttggtaaaaagcacacttctgggtgcctctgcccatatcccctttgctggctcttcatctcccttctcccaaacctaggtgtttacaaagaattctatctagataagatatagatgaccctcagatgggctccagggccaaactgcagtttcttaatggactgactcttccaccaaccacctcacagataccctttcttcactgaacccatctaaccagcttctcttaccttccctttttctgttaatggaaccctcatcccgcagccccccagctgggtcctcagagtcaccctggaatcatcttcatccttctgtatccaagtcctgtggattctgtctccatggggcccctccaatctggcccatttccatcatgacctgcatctcattaattgaggctgcctttaacagtcacccagtaacctgccaatctgtctccctgtttcctgcccattcatgtatttatgataaattaatattcttattatcactgtttttcaaaatcttgctaagactggtgtaggatccttggctctcaagaccttttgaaagaaggctccaactctattctggccattgcatatattattctccaagatgtcactattagtgaaagagacctaccttttggccccaaaacatgcctcaaagtttttctccttagaacccttgctcttctcttgtcctgggtgcccagctgcctctgtcatctttcaaaggtaaatctagaagctgcttctttaacgaagaggcctgaagcactgtactgtgcttacagtagccccatagcattgtgtctgtacctatgtcagagcactttcctgagccactatctttccatgcacacaagttgtccaccataggtgcagcaatgatgtcatgcagagcacggtgttgtttcttaggaaccagacatctaagaatgggttccagccctacccctaccagctttgccactgaaggcaaaccatcaacctctggaacttagcgtctttacctataaaatggagaggctgaaataccacatccatggaattcaaactgtgcttcagagttcttagattcccttcctatgcatagtccagagatttctcggcccttcttgttcccacactcagctttaatcagagtatcttgctttcatcttttttctatattgggcttctgagatttaaaaagaccctaaaacactggaatggatgatgtccaagattcactccaactctgatattctttgagaaagccatatcttggtcatttctgaaactcttactatgtctaatatgactaatgttaatatggaagtataaaatgtgagtattgtctttcctgtactcccctccaaactcccaaagatatccccctggatatacttccacttcttccttattatgaattcaaaagtgtgtgtgtgtgtggtgtgtgtgtgtgtgtgtgtgtgtgtgtcatgcctacttctctaccctgctattcctttttctgaacatttgcattgccatgtggaatatctataaaagtataaaccagctctgtctgggagaaatgtaatgagagccacaaatgtatttttgaattttctagtagctgcattttaagaggtagaaagaaacaagtcgaattacttttaataatatattttttttaccacagtacatccaaaatgttatcatttcaacatgtaatgaatataaatatatggatgaatgagatatttttacattctttctttttactaactgttcaaactccaatgtgtattttacacttacagcacatctcagttcagacttttttcagcacatttcaagtgctcagtagccacatgtactgattggacaatgcaggtctaagtcatcaaataaaaggataaattaaagaagaaacagagacaacttgccatttattgggaagaggggagaaaataagtcagtgcccttctcattgaagtctcattcttctgtgtcccacattgtcttcttttctggttgtgtaggggctatagatgttggggcccttgcatgtaaaaccagccaagctgatattgatgcagctgcctggccttcttctcctgaattaatggtgcttgagctcaaacttgcaagtataaagtgtttatcgacactagtggatcatcctcaatatgtccttactttaaaaaatgcttgcacctggggagcctcattgtctctgtgatctttcactccacgtgacactttaagaaacaaaaattgctgtacgaaggatcaaagtaggagatttccatgcctgttagttttatttaattttaaaaaaatttaaacgaaaaagtaaaataacatagtctggttgtaaaaacacctaatgttaatacagaagtataaaatgtgaacattgtctttcctgtacttctccaaaactcccaaagatagtcccctcgatatacttccagatcttccttgttacaaatgagagagagagagagagagagagagaaagagagagagtttataaatgctaaaatacataggtacacatgtacatatgtaaatttttctcacagaaatgggcttacccgatactcttctgtacattgcttattcgctttattttatcataatatgtcagtacctagagatttaactcatttttaaacagattaataactgtcagttcatttatttcataatttaatttcttcttgatggacatttaggggttttttggtcaaaaaatacaaacaatatttactgcaaacagtgttgcagtaaaatctttgtgcttattttatggagcattcgtccaggtatttctgtacagtaaattccagaagtgaaattacagggtcaaatgacatgcaaattttttaaattgtgctagctaaaccaaattaccctgcaaaaagtttcaactaaactctgtttttagcttgaggtgggaggtaggattgagattctcaaagatgaagaaaggttgtcaagagtaaagcaagaaaagaactcttatgtaagccttgctaccttttctaccactacattaaaacaatatcaagtggaggttggccatggtgccttacatctgtaatcccagcactttggaaggccaaaacaggagaatcacttgagctcaggagttcgagaccagtctgggcaacatggtgagaccctgtctgtacgaaaaataaaatttaaaaaaatcatctgggcatagtgatgtgctcctgtactcccagctactcagaggctgaagcaggaggatcacttgagcctgggagatggagactgcagtgagctatgattacacgactgcattccaggctaggcaacagagtgagactgtgtcaaaaatattaagtggaaaacataagtgaatatggtaattttataaaacttttgttaagtttggtttgatgcataagagacatctttcaactgtaaaattcactgtgggtttcctttttatcagttgggtagtgatagggaaggaatcaacctcattttgtcagttaaaaaaaaattatctcagatcacatcccaagcagtttttcagaccagtttttttccagtgcacaggcagttcaaagattattctacagaatttcagaagtgcctaggcttgaagaataatgtatattgagttatgatattccttccaggcagaatttaggtgcttcatgtcatttttccttcttagtcaccagtgctcatgcatcattactttggatgccttctaggtctactccttggaataactctagaagcttttccatcagctgcttacaataggaaaataatcaaactagtagtttcaagtctacctggtcataaagtctcaggtctacctggtcacatctttcagccattgagtcagatgaaaatattcagcttgaggtccagaagccacccacttttgattataaaacacagagacagtcactattttatacattgaaagccaattctttttttttttaagagaaaaacatacacatttatttaatatgttttatgtgacatgggagccttcagaaatgaagacccaaagaaacagagacaactgtgcatttttatggacagtcatgcagaagtgtggccggaagaccaagggtatgatctaatggtaataaactgggggaaacctggcaaggcctgcttgttcaggtgcattctgtgtccccgggtcttcagagataagaatgctcctatcctccaggtgtagggtgggcacctctggaatgaaagttttatggccaactctaaaggaaaattgtgtcctggatggaaagtcagttcttaccagtctaatctttagtcagtggcaaacttaccatctcatttttctcatgagcaggaggtacttcatagccctacaaaataaaaagaaccacacctgcacaaaattattctagctggggcttggacctccaatctgagttgagtctggccttggtaactcctttaaagtgtggtgtaacatttacatttgttttattgtgtttatgcaaatttactagacaataataaatatagtaaataacttcaggtaaatgtagattgctgagattttattgtatgcctacataatttcccaccaaacacaaccaaggcgctaaattacaacaaatagtaagatgtgtcaaaagattctactaggtcttgtactaaaatgatagggggtagtgacaaaccaagtaactccatacgggcccttgctgtggagtggtctgtggctgtctgatacccttgctcttttgttttgcgctgagcatctacctcccatctggtgttcctatggtggctgaaggagctggtgtctgataagacccagcacttggtttaactgagaaacattgggtatattcttacagaaataaaagatattacctagcttcttttatcccctcccttcatcttctttctcttcttccctccctccacgctcctgttctcctccttctcttccttctctttccctctctccctttgtccttctctccctcccactttaaccataggaaatatagagcattccgcatggtctttcgcctttaaccttctctggaaatacatgatagaattgggtttgtgatttattgctccagttttgcttgccaaattaaatttacaggtattagaatgtactcatagataggattgtttaagagttgttggctgcttaggagcgtgtgtgtatgtgcaaatgcacatacatgcacttttataacaggaaaaagaaaggtgtgacagacagctgcagacatatggattgtacttacttgctaattgaaacattgcaagggacaattcaagatggcagatttctagtggagattagattttaccatgaactgaactggatactaccagctcttctcttatcactggcacagagtttgctggacattcccagtctaaaacttgggaggagatccaatactttgaaagttgggcaacaagagcgtgccaaatgtgtttgcactgtgttgcccaaccatttaattgtaataatttgacatgctaatatttcaatattcagaagtaatttggaagccaattgctttatctgttttgcttatcagagtcatattgaattctctaggcatcagcatgcaataaacttgttttcaaaggcactctgttaggtggcatacagccctgattaaaaacagcactgaacttagacatgtttcatttttttctctaacctagtaccttttttacagattgcatattaacagcttatttttgcatttacctctgtaaaccctcaatcaaaatttatttaaaatattgggagcttttagtttaaagtgatacctactggcccctcaaaacatccagcattaaaaaactaagactggcagtgaaataattatcaaaattataggaagaattttcatttagccagaactgaattgaaaaatccatttggtggccaggtgcaatggctcacacctataatcccagcactttgagagaccaaggtggacagatcacttgagtccaggagtttgagacaagcctaggcaacatagggagactctgtctctacaaaaaaaaaaaaaaaaatgatccaggcatggtggcacgtgcctgtagtcccaccttgggaggctgaggtaggagaatagcttgagcctgggagattgaggctgcagtgagccatgattgtgccattgcaacccagcctgggtgacaggcttttttctgtctcagaaaaatatacatatatatatccatttggtgacacaggtttgttatgtgcacctggaaataggtagatctttattcccctccctcaagtccccttgtttcagaaacacaaggttgacttcggttcagaaaatggccagctcttcccactacctttcctgttgagagctccatagtgctgttgtcttacctactccacagtattacatcttttgctctctcgggtaagacgcttcaaataccagaaaacacatacatgcaaaaaggaactaggggtctggaggtgagaagaatgggatatttagtaagtggggacagagacataagagtaatattagaagaaacatggtagatataaacatctaagctactcagagaccattaaatatttacagaataagttcaaagtaatgtctacattgcattgactacaaattgtctggttagattgctcctcttagaaaatgaaaaacaactatctaaaagaaaaaatgattgtaacttttgaaaaaatactactagatagggtaaagtaacacttcccaaaagactcaaaaaaccaaagaaaaaaattctgaaagtgattagctaaatcagaagaaaatttctaaaagtcagtagactgagaagaatgctagaagacatactctctaaaacagaaaaaaaaaaagccacaagaattgaacactctaaaatgtgaaaacagcaatctgagatggagagaccaatgataagtggaattgtaaggaaactgagtatatagcacagttaaaatctgataggaagcagtaaaacatagaattaatactgtaggaaatggaaccattgacataaaggatgatattggaagttctcacaaaatactgagaaaaaaggaaaaaagatttataaaatggtgagaaactgacaaacatgaaggataaagaatagaaatctggcctaagaaattgatgatcttgaggccgggtgcagtggcttacacctgtgatcccagcattttggaggtcaaggcagggggattgcttaagcccaggagtttgaaaccagcctggacaacacggtgagaccctgtctctaaatacgaaaagagaaaggaaattgatggtcttaaaatgcagtaataaaagccataattaaagaaacatgttcctaaactgaggaaaaacttgagtacacaaattaaaagatcctgtaatatttgggggaaaatcattaaaaagagacattagtacttgagatgctcagggctgtgaatacagaaaactcattctggatccactaaagaataaaaaacttgttgactcacataaacggtgattccagagataggtgagcatcagggttggcttaatccagaagctgcagctccatttctctaacattcccttttctatgtcttggcatcttcaaaggctgttttcattcattggcaaagcggttacagtagttccaggtttcacatctgccctgcaggatactcagataaagagtacgttcttctgtgtcaggatttcaaacaggagccctgagatgcattcttagggctgcttgtgatgtgggcctgcagtggaaccagtgactgagaccggaacaaaggaatttgcttatcagatagatggtagattgaagaacatcagtgttgtgctacaaggtgaaaggggagacaatccatggaattcactccaaagattgacgtggagcacatttggaaaaatgtttgaattgcagggagaaagaaaagaacctacaaggataaaatacgtttctattaaagctatacacaaaggaaagaaaatcaagctggcctcagacttctctcttgttgaaccaaagccagaggagaatagggaaaattctacaactttgttgggggctaagtctataacccaagaactttattttcagctaagttgtcttaatgtgtgaaggcaacacaaagtttagtgatgcaaggattcagtttctatttgtatatttgttaaatacccattgggcatttacctgagctgagaaggatatcaaaatccatacatcaagaacaggatgccatactatgaaaggactggtatgaaagggttgccctgtagtgatactgtcacagaaccaacatccagctcttcacagaagctctgagaactatgacttcagcagacctcacctgtttgtactggccgtgttaatgaccctataggaatgtggttgggttagtatatttttcacaacagcgtctggatgaggtttaaaagcaaataatttcattatgaattattagttcttattatgagactagccctgtaattggacctcagaaattcccccctgaaaagcttcaggcagagtgtaccatcagatttaaaagtctaattaagtatgactaaaattatgtttcattttaccctacctttgactagaaagaaatggtctctaaagacctaaaaaataaatatatgaaaggctattcaaagtgaaaaaccaaagatgaaatggaaagggagatgaatgagataagaaagaattataaagacgtaaaatggagtagctaaattacagtccccttaaggcagacagcaaataacaaaattgacactttaggagaattgagaaagtgatgcaaaggcaaatagggttaaactctcaggtgggtgatgtgttccttctgatatcatgtcttgcatttttcccaattttcttaacatgcatttctctacttgaagatgatctatattaatacaaaaagtgaaattaatcaaaatgttcagtatttgtggaactgcttaataaataacaatctatcaatacgttatgaaatgttgaaattcaaaagtatttgtgctgtagtgttcctccctataagtgagcgtgttgactctcattcatgttattggattacatttccaatattcagtgttataaatattactgcatcccttacccattgttaaaatattgatgtgcttccagacccattggtaaagagcccctccttggagtgccccagctccctggatgcccctgcccctctccaagatcccagggcctccctaagattccaccactagagagttaacagctgacaccagtgttcttccatgtcaaaaaaaaaaaaaaaagttttttagtattatttcaggttatagaaatgcattcctgggagtagacatttgctgttattcctgtattctctttaagccccctgaagtcactctgtttctggcagtggtttcttccagctaccacttgcacaaatgctggtctagagcaattcattatgctccttataatatcaaagaccttctactcctagtccctaactcacttctgatctttatcctgtttcttggaccttaaaggcttctggaaatgggtaaaatttagaatttaatgtcagtgaaattcttcttttggttttgttgttgttgttgtttgttgttttggggcagatttagcattatcattcacccctgttagccatcttggcacagaaatgttcacctgaagtggtacccagaatggtcccctaatatatctacaccctaaacactatgaatttgttacattacatagcagaagggattttgcggatgtaattaaggttatgaaccttaccatagggagattattctggattatctgagggggcccaacctaatcacatgagtcctttaaaaacagaactagcctcgcaccgtggcttacgcctgtaatcccaacactttgggaggccgtggcaggaggatcccctgaagtcaggagatcgagaccagcctggccaacatggtaaaaccccatctctactaaaaatacaaaaattggctgggtgtggtggcgcatgcctgtagtcccagctactcgggaggctgaggcaggagaatcacttgaacctgggaggcagaggttgcagtgagccgagattgcaccattgcactccagcctggcaacagagcgagactccgtctaaaaaaaaaaaaagagagagaattttctcaggctagaagcaaaagagatgtgagagagagactccaagtatgagaaggatcaaacatgctttgctggctctgagacgtagcagccacattaggaaccagagagagacctctaggaacaatgggcagcccccagctgtcaactggcaaggagacagggacctcagtcttacaaccacatcagactgaattcagccaacaatcacgtatgagattggaagcagatttagccccagaacttccagaatggaacacagctctgccgacaccttgatgtcagctttgtacaactctaacagagaaccagctgagccatgccatacttggacttttgacctacagagctgtgagatgatacatgagtgttgtttttttaagccactaaattggtggtaatttgttacaacagcaatagaaattaatatgccaacatgtaaaataacagcaacaacaaaaaaaaacaacaaaagatcgtggaataaacaataaacattgcagaaaacacagttctgaatgcctgttgtcgcgctctggctgagaatgtctacacagtaatgagcaccaaatctgaaggccaaaagcactcagtaggagctttattctctgcactccactcacaacatacaaaaaggattggggttttagggggaaacatgagtgtgtatgtatctgtgtatcatttttggtaagaaaaatattttagagatgaaccattttaacaaagtggccttgttgtagtgctgtaattaaaagagggtgggtgtattgtttgtagcttcttgtttgtttacttaaagtcagtattgcatatagtaacaaattggtgagaagaagaaactatacaaaggggagattgttttggcaatggtacatgctgtcctatttgtattttacttcttctggtacaattgtaaagcttagacaagcttttcaagatgtgttagcacaaggtctggttgttatttatggttcctaagctctgaaggctacttacctaggctcaacccaactagaaggtaaagtgaattgctttgtggtatgaattacactggtaatgtggaagtttgctgacatatgctgtaattccaaaggtagttaagcacaggagttgatgttggagccagactgtctgggtttaaatcctagctcttccacttactagctgtatagccttggccaagtgacagaaccacccgtgcctcagtttccttttctgtgaacatggataataaaactacctctctcatggtttattgtgagaattttagaatataaagtgctcaaaatggcattgtagcacatcaattggaagcaataaatgttagctataactatgattgttatccttgccttaaacatgaaaatattcatgaaattggggcattcgggctccttggacacaagaaacaattaatcccaaggatccccccaggtgaagatggcccaaccacctgtatgagagaagcaaaccaggacatccagtcacctgttaggcccttctgtccccacttcactggtgtttttaacttcaaattagtgaggctttatagataatgttggcattatagcagtccttgccataaaaatcttcattttttaacaattgacaaacgcatttctcaatctgctgtttcatggaatagtgtttcatgagataataatgggcatgctgtgaaatgatcggtcaatactaaaaatttgggaaacacgagcttaaaggtttctgtgactcagggcttatcacagccctcattattaatgtaaattttgaatttccaaagatatatacatatagtgcatagctcctcaaatatatttgaccgtgagacttttttttttcaagatatgcctcttaaaatttcctggaagtgttcttcacatccagcttgggaaacaactgccctaaaataggagcatattttaccattattatttaacatttatgaattaagatgattatgaattgtagcttgttgtaaaggagatttttatacttacatatcccaaatgtatatgtttatgtatgtgtatccatagtaaaaactaaaactagataaagcagtgaagagtctatttctcactttgtagattaaaaatggtccttgttaggtcaaattaatgatttttcccagtagttcttctctgacacagataatgagatcatcttatagatggtcacttggcaaacactcggtcatccaatacgtattgaactgggcattctaggtttgtcatccatcactttagtgaggccttttataaaataatttgtagtttcagccagcaccatttattgagatggtaagttctataaggttagtatcctgtatgtgaagaaattcctttctattgacataaacttacctctctcaaacatcagggattcatcccttcacttgatattcaagactggtgaatacaaccaagtttacttttgttgattttatatacttcagccttatcctctacccctttggtctttgtctttctcaactaaaaagtccccattttttggtttgtcacttgactcatgtcaagacctgcgaaggatgtgagatttttcccctatttgcaggttaacaaattagtctaccacagtttcatgaatgctggcaaaagacacaagactcttgggttagagacaaagcctagtttattactcacagcaatagcagtagctacagtatcagcatttgcaccagattcccaattcccataggaaaataagaaggggggcagatgacacctgcaagcacgcacgaacacacttacacacacacatacccacacacacacacgggttgtgttacaaaaacgaatccccaacatgaatcttttataatggtcagttaagtcggccttacctttgccccagcagaagctattatcatgtttaagagcaaacaaacctgctcatgctatagagggagacactatcatcttccaaagcagtttacttgaaaatctaatccagcacaaatgcagttagtgtctctacttgcaagatgtgcagaaatacaaagggcccatgcagaattgtctcccaacagggaacagctgtcccctgcgtccactacaccactgttccttcctctgagacctttcaagtttcattatacacacatcaaggtctgtagccaaacctgcaatatttagatgaaaatatattggtgcatttatttcttactatagaacttaaactccacagggcaaggatctttgctttgtttacttggatatcccagaggcagagaactatatccagcacatagtcagcattcaataaagattcgttgaatgagtatatgaatttcctgtattcttatttggatccataagtttattggctttgctgtgcagaagcagcagttatatcggtcccttcaagaaactgcctgcagagattcctggagtcatctgcctggagcattgcccactcacctcctcaactcacctcctggctgctccacgtcattcttccaatctcatcttaaatgttatttccttaaagaaacctttcctgacccagagtaaaatcagtaccttcgggtattcactctcacaacaccttgacttttttccttcatagcacttagcacagtttgcacttatatttattttagtgttttctggcttaaaacctgtttgccctatcactcatgaaactataaaccagaccctctctattttactcaccactgtataactagtacctaacagagcatggcataaagtggctactaagtaaatgaataatgaataaatgaatgaacatactgcagcctgtaggtcagagcccatcactctgtgagtagctctggcataaaatgggccaaatgcatcgtttgctccttgcctttttcaaaacagttttcccatgtttctcttcagtcacttagtctcaagatttttcttcagtagagtttagtcatttttttattttatattcccagaaagcacttaattttaaattcagaggttttatgtcattttactaatcaaaacagtataaacatattaagtcaatactggtcctagcattattcctttggtagttctaatgtttacacttaatatatttaactcagttgcataataaggaaatgaaacttacagaagaatcccatgggattcttctctcaattaatgaatgagcaaatattctttgaaaacctaccaggtgctggccaggcgcagtggctcatgcctgtaatcctagcactttgggaggccaaggtgggcagattacctgaaattgggagtttaagaccagcctggccaacatggtgaaacgctatctctactaaaaacacaaaaatttgccagatgtgatggcaggcacctgtaatcccagctactcgggaggctgaggcaggagaatcgcttgaacctgggagggagaggttgcagtgagccgagatcgcgccactgcactctggcctgggtgacacagcaagactccatctcaaaaaaaaaaaagaaaaagaaaaagaaaaaagaaaacctaccaggtgcttacaatcattctgggcactgtggaagatagcaaaaacctgaagactgagcctgaaggaggttataacttacatgagcaaataaaaatgtgcatgatgtgttagcatgtaataattagcaaacagtatcagaccaggcatatgtaagtgctgagccacatggtacagatttttaaaactgttaagagcttagaaaagtcagatattaccctgaactagaataataggggcttcctgaagttagtcctgagctggattttgaagatgtttgattggatatttaacaagaacttcattaggcaagccacaaaaatagcagtgcattcattctcagaaaagcaagacctggctgtactggaaggtataagttgggaaatagtgtcgtgtatgcacaatcaccgttggattatatgaatcacacagtctttatgactccttttccattcaattcaataccatacagagataaagccacacctttggacaaatacagccggggtgtgagccgccaaaagatggagccttactaaggagtatccacgaagtaaataaactccgaaggaaagacttggaaggtcatccaacatactcataaattccagctattgccaaagatgaaagggaagtgagagccatgaggaacaataggaaggagtgcccctgccccctcttaactgcctgtttacaggaggggaggagcagcagtgctgcccagatggcagagccaaagttagaatgaagcttcttcctcaccctaagacctctttaggaaatcctgtttgtgacggtggcttcactgtgaagtcatcaggagccccctccccgggttgcaggagcacacttctggattgaaccatggtttctaatgctgcttggaaatcttattatcatgtgcactcagcaagatagaaactgcatatcaggtgaagcttgggtcagactttattttgcaagcatttacttatctttcttgtacgatggaaatgctggcaacacaatagcttaaaaacaagataagcctcatcttttttcctgtgtgggtatgttagggaatgatggttttgatggcctttaaaaagcaggaaagggcaaagccctgtgatgccatttctttggcatttcattacttcattaagagaattatcctaaaagcctgggagctgtaatacggcttaaaaactgatgagagctgagtgaaaacaccatagactccaaaccaaattaaccagaaggttcatcccaaagagacccgcttttatattcgcacctggggtgtgtacttttccttctgccactcaagagcttttgcgtgtgggggtgaacaatttgctttccatgccaaacccgatgaaatgggatttgtcttccctctcagacaggtggccaagctgtaacagagagggctctgcctggctgcttgcctctttggacatgcagcactgtcagtgcagcgccaggccccatatctgaccctgtggcctcacaatctggaggcccacattggcagcctggggtggtgacagcttcggtcagttgttgtggagttccactggcagacaaagaagagtaggcgagtgtgctgatccaggttccttctgtatgatagaagaaacctctaaggtcctggtaatgtgtgaaccagtggaatacctgctccaataattaaagtatgagctttccttcctctttttcagggtggaccaggccttgggaaaggaattttggccttcccagactgtacacattacttaatgtgtccttctacacttattacatgcatcaggagcagatttcacaagccttcttcctatgagactaggttagtcactagggttaattattcagtagttaaaggaaatattgtgatggagggaaaaatagatttccagaagccagggagtagagggcctcagaacatcaaattgctccatgaagagagtacacagccatttttatttcagtctttgaacatgagatagtaatcgtgatttgaattctctaaacctcaaaaatattcccttcttagctgtaaatagccacttgtcccaaccccatatatccatggggagcttctgttctcccagagaaaatgcagttaattatagcaaagaaagggaccctaggtctccccttcctgccttaagagtaatctccagtatctctactcatgagataataaaatgtatcattttcagaaatttgaagaaggtaggtcaggactcaccagtgctgtttcaaaagccttttggttgtgagtgccacatctgaccactgcacagatagcactgagaaagaaaattggacccagttctctgcttttgccttccattctccctgtaagggtccacgtgaacagcaagtttggcctggtttccttaggtccctctgggcccatttcttttctttcatcatctttcctaaagctgatatgacaattccatggggaagaaacaaatagtacacttggatgaactttgcgaaacacaaagacctttcctcttatccctgattctaaagggatttttctgtatttaataagtaaataaatgagaacagttttagactgaatagtaagtgtcccatttatatcatatttgtgatgttttgaacagggtgaaggaaaccattcgtgataaagcacatggattaaaaatcgtggttgacttgtttaacagaacccaagtcataaagctcccttgaagagtactcaaaaattctagctacaaccaaagatgaaaagaaagtgaatagacctcagcaggcctgcctcctctgtttcatcctttaggttaaatgtcacctccttaaagaggctttttctattattctccaccagcatatcttattttcttcataacacttaccacttatttaatgattttctttctccctaaactgtaagcctcacaagggcagggaccacgtcagtcttatttctgtgttccctacactcagcatagtgataagcacatcacagactccaaatgtgctgaatgagtgaatgagctgctgaagcgtgctataatggcaaacctgttccaagttcttcatggacttacagactcctctggatcacctctttcttttcttagaaccaactgaagaatactacttggtctcaacatcaggcttaccagtgttattcccattagttcatttgtattttttaaaacccgggatttggccgggcgtggtggctcaagcctgtaatcccaacactttgggaggccaaggcaagcagatcacttgagtccaggagttcgagaccatcctgggcaacatggccaaaccctgtctctacaaaaaattagtcaggtgtggtggtacatgcctatagtcccagctaccttggaggctgaagtgggaggatcacctgagctcaggaggtcaaggctgcattgagctgtgatcacacaactgtattccagctttggtgacagaggtagaccctgtctcaaaaaaaaaaaaaaaaattcttttttcagcctgagtctcaagtccactagcagttccgtagtcatagccaaacgatgcgatgtagtgaagtggtcatgagagccagctttggagcatctagttgtctctatcacttcttagctcaatgatgatgagttatcattaaccatccctcaacctcagtttcctcaattgtaaaatgaggatattaatatatatcccccacatagcattgatctgaggttaaacagtatgtataaagcacttcacttttgtctttttgcattgtacatgttcagtgaaacttagccactgaacttcctgttcataatgttaaattaccttggtgtatcacttttctagaacaggataaaggatggcttcttctcagaggtaacagaagacattagaagaattcagaatcaaaaaagtccaaggacctggagtactgggattctagacagaacctcaagcgtggggtacacagcatgaactgaggtcacagtgggctgggcggcatggccaaatgactcaatagtgaagtgatgactaatcattgtagtgctccttatatctctccccctatatcccaccacagtcaccacaaaggccagagctggtcctagagtctggcaaaaggctgagcatgaaagtgagtttaaggaaacccatctaataagattaaagaaactatgcagggctctggggtcaaggcgtggggtcagctgactcctccacaaggaggagttgggggctcctacttggtcttcccttgttttccatagttcctcacagaatccagagggcagtccccaaggctctcagagtcttactctgagccacaggaagaagtaccttacgccagctcacaggggaactccaaacagtcagcaggaagaaactcagtcactcagatgaaaatgatggtgtctcaccattcttctatgcagttttctaaggggcaagacagagacatttggctgtgagacattaattaatcgaacagaatgtactttaactgttacctttcttatctaaggctgtgtggccggctcactggttttagtcaagtaaagagcaatgacttatgcatttaatgatctcactagacataatttcctttcatattggtttgtaagacaggtgctatcctctcccatctcaggtggagctcagaaggcccatttgttctaatattcctgaaccatgtaggatcagcaatctggactgttttttaaaaatcttataaaaatctgtataatgtatgcatcttatgtaagattattttttaaatagtatgtattatgttctttcatttaacaaaaatatacatggttgttgtagagcttttaaaatacgagtaaagagtataagtctatagtatcttgttataccagaaagtaagaaaatgctcaaaaaatatgggaacataccagaaaggcacagaatttagcttgaaggagccactggacaaatataaaacaatttgggcatcaaaatacataattatagtaaaggattataacctcctgaataaaattaaaatccatgagtccatgctgatataaataaagtgggagaaaagagagctttgtcttacagtagactgacaatcaataataacagagtgaatgatggagttagaaaatcatcaatggatgatgctaaaactactgagtggaaatttcatcaagagatttacgtagtgtcaaaatggctctttacaagatacttactttaaaaataaaaataggaaaagaaagaggaaagaaaaataaaccataaaccagtgaccaagagatgaccattactaatggtttaatagttatctttcaactgtttttcctatgcattataacattttaattttcttgtaaaattagatcatgcttttttgtaatctgcttttcttatataaaaatatatctggatcttatttatttgtatttaaatattccctggtacatagtaggcatgtagtaaatattggttgagtgaatgaaatttgcaagactttaaggaaagctgtgatgcacattggtgtaagtaaagtttttttcattctcatgattattcctttaggactaactcccggaagtggaatagtgatacaaagcatattcaaaaccctgagccctttgatacgtggagccaaattgccctccagaaagatttttctactttattttccctccaggggtgtattaaatgaatgtcattcaatacatttttaaggaggaagattgggattaaatgtgtgtgaaatacccagagtagacccagaagtcgtcagtcagaaagtaatagtcatccaaattcttttccctgtatctgtaggttagattctgtcaggaccaaaagctgggattagtaagagttgtcaaagccttcagtcatagaaaatggagtttttgttgatacgggaagctccaagttgggatagactcttattttcattaagccagtcatataccgtataatgtgctataccatccttcttttgtatctattgaaaaatcctatcagctgcactggacctgaagtctactatgtcaaagtaaatgataaagagaaaaacctggttcctgtttatgataggctagcattgaacatcactgttatcaacacagaacctccatgagggcccccttccatttgcactttgatgctggctacttagcacacttaacaccagctgtttccagtgccgttgccaaaggtgggcagagcaaggtgcaggatacatatacgttccatgggcagctgagcggcgtgctctcttgtgctagccagtgcctgtggcaacccttccctcctgacttcagcctccccactagttgcagccaggtggtgtattatctcctgatctatatatacattaaacatattattaaggagaacccagaagaagatatttagagagatagatacccttggattcaaaagatgagcaatcagaaaaattataccataatttgaatttgcttatattttcctttttggctttcactggctagcatgttctcaagtgatgacagttgggctgattgagagccgttagtcaaatccagtaacagtattaatctgtggttggaaatgactgttaaagtaagtgccaggctattcagttgtggtttttattccagcttccaatggtgccaggcttccagcaggaggaatagaggctgtggtaaaggaaaccgttggcaaatgaaagaaaccagaaactgtcactacccataacaacgaaacaacaaaaaaatttacagaaaaggaaggggagacaaaggaaattgtttaaagtggttgaagcctgtacagtctgatgtgatcattaggcgtgagggtgccgcagcatggtggtgcctaagacactgactccaattttccagtgagaacaggaaggctttaagcaccaaagccatgctgtccagtaatactgctgagcaagaaagcttttcttgaaggaagagaatagcgtttaattgagactatttttgtcagtctcctaacatgctcctcagaccactaatatgcaaaagaacctaaggatctggtcaccaagttacgtcaaaagagtttaccccatagtcctttttactgccttttgcagaacaaacgtttaataatgtcgctattgttcattggttatcaagaaataactcattgtaactcagaagtgcttagcaaagaatctatctcatatgtactttctttatttcaagaactttaaggaggcaggttttctacgtgtgttcaccaaagcgccaagattttttttaatattttgagaaaatattttcagtaaatctgtattcattgaatgaaatattaagtggatccataaagaagcagatgatataagtcccaggataacatcaggagaatctgaacacagtgtagctgaagcatttcatcaccccccaacaagaaaattgctattttgccaactattctaccacattgcagtgtttctaagatctacatttttttcacatttatttctaaaaatcaaaatgtgaattgcagtcaactggtgacatcttagatctgatgagatatggtggttctcctggaaaagcaaaagttagtaattttcagcatatcattggcatccaatgtttaactctgggggggtcaaaagacatcttcaagcactagtgaagaagacatatttaatttgaggacatttttattataatttagtaggtaagtgatgttccttcaaggcattcaaggaacccactctggaatagactaaagagactctgagtcagttagtgttgcccacgagggtcacagccggtcaatggcagacctggactgaggttcctgcccagtctggagggtcaacacagggtgtgttgtcctgctacctgtcagagcaggcacaaagcaagactcagtgaggcagaccccgatttgctctgaagcatccttctatctgggcattggcagaactcccaaatgagtgggtaaaggtaccaaaaaagttcagcctcaaatgagtgggtcagtaagacatgagacagtgaaacgttgttcaattgtgggacatgggattggcttggcagagtcactctgctccatgctcagcctgcagcctcctccctggtatcaaggccttcctacttccaggttcatcttttgaaatacatcatttattttcaaaatatactgatgttaataaaaataatgccaaagatatactaaaagtttattttctatatcttttggaaaatttataaatttccatataaagaaaatgaaaatgtcttttaaattttttagcatgcaaaaccacagtaatccaaagtatacattagttatgagctaaaattataccatctgaaggtgcattttatgagcaatgcatacaatgtctattaacaaattataccaacatgttatttgtaatacgttaaatacttttactcataatgctttgtaagctttaaagggccctacttaattagatgggataaatgaacacagcacaaactttcatttttttttaatgcctttcagcaagtgatcaaattttgaaatttatctcagcgttctcttttttcctgcttccccaaaacatggtaatcaccttgtatgtataccattggccttgtcgttggctgttattgcatagtagatgttgagtttttaaatttgatatttgatcttgacttaacctaagtctcagtttctccctttgaaatgaggataatgatatttacttagcagagtgttattaggagtaaatgagacaacatatgtgaaacaaagcaaagcagcccctttcctgtaataagtgttcagtaaattgaatttattattattattagctgttgatgttgaagaaaagttatttactcaacactttttaggtcacactggtttttatctacttaatttcttaaaaataatgatcttaaggtgaaattctcttacatatttccttaaaattcattcaggatttttatctagccaaaagtgatcagaagttattttatagtttgaaagaatctgaatttcattttcaaggaaaatgtgtccctcagttacaatgccaagactacgagtgatgatcaagaagtctaactggtcagtaattaaactttatattggaagtagacatttatttgcttaatattccaaaatctgactaaattgttttctaaattcaaaaggagtttttgagtaaaacagtcagttgctatttaacccgtaggtctgtaaaacctggcagccctctgtggccacatagtcttaagtacagtatagaagaaatacctcccaaggcttttgttttatgtctacatattcatctctttctaaaaccgtaagtgtagcaacatgtggctgcatttttaacaacttttattgcactttcatattaaaaagcaatataccagcaaaatttttgaagttttcatttaggaaaatacaatcgggctgggcgcagtggttcacacacctaaatcccagcactttgggaggccgaggtgggcagatcacctgaggtcaggagttcgagaccagcctggctaacatggcaaaaccccatctccactaaaaatacaaaaattagtcagcatggtggcgcatgcctgtaatcccagctacttgggaggctgaggcaggagaatcgcttgaacccaggaggcagaagttgcagtgagccaagattgcgccactgcactccagcctgggcactccgtctcaggggaagaagaaaacatatttcataaatattttatcttttttaacatatatttttaccaaaatgtaattatttattcctgtacatgctgttttttatcaaatgctgtttcatttcttatgagtgacataaagcctttgccggtgatatttttctcttatagttataaaatcaaaaatatgacagagagttgtacctctctagagaatgtataatgcaaatggatcttatatataatcatatcccctcagccttctcattcttgtaagttcatttgcttcataaataaactaaatagtttgtactgaaaccagaagttgaccttaatatttgtgttggctgggcacagtggtgcacgcctgtaatcccagcactttgcgaggctaaggcagcagatcgcttgagctcaggagttcgaaaccagcctgagcaacatggcaaaaccctgtctctacaaaacaaaaaatacaaaaattagcctggtgtggtggcatgcccctgtggtcccagctactcaggaggctgaggtgggtgaatgattgacccagaaaatggaggcttcagcaagctgagatcacttcactgcaccccagcctgggcaacagaatgagatcttgtctcaaaaaataataataataacaaatttaaaaatatttcttataacttttttttaaatgtgctacggatagattgcatttaaatacttgataaaatagtattgtttagaaatcatgattagcaaaactgattacagctcctgctcttatcacgtccctgactatgtctaagttacagaatcttctcagccatagtcctcacctaaataaggaaacgcatttatccccttatttgtcattttcctaacttcatcatctataaagttttcttagtgatctttttaaatagcacagcacggtatcatgggtaaattaaatctagagatttgggccaaagataggaccaaaataacagcattgaattttccttgcatatttagtcataatgaaacaaggaaaagaaaccacaggacagagaaaaaggagaaggaaatacagtattaagcaaaaataaataactttggaacgagtaacagttcattctatttgttcttgattggtagccttacttttactgagcaggttaattttatttctcagcagttttaactgcttcattcacatggtttattattttgtgttattttcttccatgatatggagtacgacagaagctgtgatatctgttttttagcagatgagcagagattaagtggcctgcctgcactctgggatttatttgttaatcagttacagagccagcactaagagctggatcttctgtctcctggtctatactcctttccataacatgtggtaaagtgcttctcccttgttctgaagaaatccctacagggaacctaacactgccctgatctggaaacaacattgttacctgacaggccggtttgccagggtgaccattcttaagtgttttagggagctaggattaatctttttttcccaagaggaagtagcaataaactgtgcaccaaaaataacgctttagctgctaaattctgcttagtaggtggtttcccaaagatgatccaatgcaatgagtcatccctctgagcacttactgcacattatttctttttactaatcctcggtgcttttggttgcatgttttttaacctttagagccctcctgggaggttcagagtcttctcactatgaatataaaacagactctactacatccccccacatgtccctcttgtcctttacttcctatacttttcaaatctaagataatccatcacttaggagaacagtcaggatcatgtccaaagataaaagatcagcagtaagtttctccagagttagcagcagctccatctcattcccagtataaaaatcaaaaatgtagatggatgtaagtcaatgtgtagaacccatatcaagaaaactataaaacttgattgagatacataaaaatgactttcctagatatagagaatatttgattattagaaagatattaaatattccattttcctgaacaggaagattgaatagttgtaaggatataaaaggtttccaaattaattcataggtttatgcaactccagtcagaattccagtgggatttcctgaaatgcatttggaagagttaaactggtgaaaatagccaagaattttttgttaccaaaaaaaaaaagttatgaagagaaactcctgctaccaagcactaaaatacattatgcaactacagtaataaaaataatgtggtaccagcagaagtgacagacattaatggaacagaatagagaatgagacttgaaaccctaatttaggaagtgatgcaatttatcataaatcacaaatctgggaggacagaacggcatatgcaacaaatgagaatagggtaattggtcaatttcatgggggaaaaatggtaacctgattagattctcactattcctcaccacagagcaaatgacagatggcttaaagagttacatattaaaagtgaagccataaaagaataaagaaactataggaagtatctgtgaccctagaatggagatatattttcaaagcattaagaagtcacaaacaaaaatactaatatatttgattatataaaaattgaaaacttttgttcatcagaaaataaaaacactgccaagttaaaaagcatgtgataatcttggagaaaatgaatgaatatgacaaaggtgtaatatccttaatgaataaaagagctcttaaaattaattggaaagccactagcacaccccactgtagctacactacattcctatcacactgtgtacatatcacagtgctaaatcattttatactcataatacagttcagatgacacaagacagtattagaaattcagatcttattttccattcacatattctttgtccaaaggcagtttaaggaaactaacacattacattatgctataaatacttcagaacagtttgtccacattgacacttccatttcctaaaatgaaaccctcgctggcccacagagggaaaaaaaaaaaaaaaaggctagctttgttaaccagctttatttcaacaagcacatccacatggtaagaacttcctctgatgagtcatccacagttgtcaaacaccaactttcctttgtttggcccatgcagaaatcaggtctgtggaagcacagttcaagagtctgaatcatttaattgtgttttattcatatctgaatttgcatctgtcacaaacccaatgtgtccaccgtgaaaaattgcatccttcaaatattactgaacaaaaaaccctattcaaataggtctgttctgtctagattgtctgtgaaatttctgaggaatgttgtgggctctgtttcctgtaccaaattgttgagttatcacacatcattggattctacccaaagtgtgctggataggcatattatattcagacaggataccagttgtctttaccattcataaaggaaaaagaaaagattactcctgctccctgccataagatataaactaagaagtgaaaatgtgtgtacccatagtttttttaatgtgtccttgatttcttttcttcaccaagatttgagttttattcagtcatagctttgttatgcactttcttgtcaccctgtacttgttcaaaactaaggactatagtcaagactcagatcctgccctgggattggtgccatcttagcttgtttggaaaaaaaaaaaaaaaaaaaaaaagatctttagagataccatcatatccatttgtatataaaaagagaaaagaatggaagtgatgctgtgtaatttattttcatctatttactctattttccaaattttccacaatgcgtatatattttataatcaagataatctgttactttttaaattttttatttttaatttttgtggatacatagtagatatatatggggtacatgagatgttttgatataggtatgcaataatttgttatttttaacagtacccatgatgaatcattcaaaatataaattcagtaaataagctttttgaaaaagttaaacttgctgttgggccagtaaaattttattctgataaaataaatgctagcttttgttgattaatcaccacactaaactcacaatactagacactggtagacaacatcactgacattcaagggccagagcccttatttatatgttgagcacattataattttttaaggaaaaaatgagaaaatcagtctttcagtgtttggactatttttaaccaatgattgaatccaatttgagaatatttttagatcatttgtaatgctttatgactgatacttttggttccattttgagcaaagcttctttttttctttttaaagaagccacttcagccaacagacacttccatttcagaaaatgtctagtgattattttcccccaaaggcaacatgaaaaccttcagcctcagaaagatgtcattttgctgacatccggctgatgtcaatattagagtttttgcaagagaaaggtgtgtgagcatagaggtgatgataattatatactcaaagacacacccacaacagagcccataagactccctttggcaaaaaatgttgtattgaagacaaaaccagtggattcagaggttaaaagtaagaagtagttttgagagccacattttagttaccgtaatgtatgtagtatttgctgttgaaatgtctctattagacagacttacttttgtattttctaatttttattccttgtatcaatgttgctttgaagtcagcctatcatgagagaaaacttgactcacttagctagttcattttcagaggtgtgtgttactgattaatgtagcactctctcttgctccacctacacagcacttcagaatcattctcaacccagcttacagcctatcgctaccaaccagactggatgaaatctccttgtcatcctatatgtgtaggtagctccaccccagtgaccccctagttgtggttgcctccttagatccagcacttcctgcagactattaatttaaccatgtagacctaaccataggcaatgctctttccctgcaaaagaggcaaggtgcgtatagttttacgaagtcatttactgaaagagagaaataacatcttgaattgtggtatgaggaggggactccccccagtctagtcccttattacacagtagcagtgagttattaggaaaaaagagaataaaacctgtctgtctggaccactttcattctgattgttttgaggtatgctcatttgatttttttaaacagcctgccccactgaaataacaaagaacttaatttttttaaaaaattctgtcttctacagcctcttgctctgagtctcctggatagggtgaccaaccatcccagtttgcctgggacagagaggtttcccaggacacagcattttcagtactgacactgggacaatcttgggcaaactgggctcgttggttaccctattcctgggccctctcctacccaaatgaccaggtattgaagaacaacagtgctaaggttcctactcatgaacgaattccctggtaaagcttttccttctctcccaggaaggcacagtataaagcaagactgggagttgtgagacagaataagtttattatgtggtatggtgaggttctaatttggtcgagtgatatctctagttcagagttctgctgcagagtgaaggcaattgataagccctgagcccagttaataatcagagcctcactaattaatcagtggcactcattttgccaggtgtccctgatcgtctctaatcatctattctgtctccacaccacaccatcacccttgctccaaatgaccttccagcatgttgtcattaaagtttttcaatgctaagcccaatttaaactatagtgagtattaaagctagaatttccacaagggagcagaagggttatccaagctctgtggttatatgaagagacagaagacagtattccccggagtgttgagcctgcgatatctgactattaaagaagcccatagtgacaggagtgattccatgggggtaccatatccttgacttgcctccaattttttaataatactaatataaagtcttcacccttgtgaattatagcttccgaagtttgactcagatttattttcctggttctaaaactttctttcatttgcaaagtttttcagtacttgctagtcgcctaacttcatggttagagtgagaattaaaatgcaataatgcattaggaacccagcccttggaaagtgctaaatacatcatcatttctttcccagccttaagaatccccctgaacagtgtgattggagagcaagagataagggaggctttggaagggaaataaataaataaataaataaataaataatgtaatttggcaagaaaaaatatcaaaaagtatataaaatgaagagttggatcctagtcacagaaagacaaatcacatttattgctgctatagtagacaagaatgtgccagcccagctttttaattttaaaattatggaagatatattacattcattaatatgaagaaggacgtgttactgactgaatgtttgtgtccctcccaaaattcttacattgaagccctaacccccaatgtgatgctatttggagatggggcttttgggagattattaggattaaatgaggtcatgaggatggggctcccatgattggattagtgccattataagaagagacaccaaagagcataccctctctctagccacgtgagtgcatagcaagaaggcaggtacaagccaggaagagggatcttaccagaaccctacattgttgagttaccatgctagcaccctgatctcaggctttccaccctacagaaccacaagaaaattaatttctgttgtttaagccacccagtttgcagtactccattattgcagcctgagtagactaaggcagggagagatgacactgggagaataaaaatgaaattatttgaatatttcagagaagtaactatttcttggaaatgggagatacccattcaatttttgtcatagtgattagaaatgactttttcatctcaacgaccgcttagtcttattttagtcatatgtaaagttgactcagtaaatatattaatttatgagttttgtaatgtttcagaaatctgaagtagtttggtgagttctagtttaattttaatcctcaattttgagttgaaaaatggtagggtttgtccctctgctctccctctctttctttctctccatctctctctctagaggaagttactcatagtccagtaaatatgagccctctgtggataaataaattattcacatcggtaacaaggaaaaattaattcagctatttatttttaaggaaattaccagactcatagtccctcctatggacagggatgccagcacactctctaacttgtgttagagacacaagtctttcctctaagtggcacctcccttccctggcagaggttttttcctatcagtctgggtctctgtgacggaacttcgtctcagattcttctttctgccacggtctttccttgtcattacttgggctttaaattgtttttttccgtgctctttcccaccagcccttctccctttctggaccggttttacttcaagtgcgtctttcccctccccactctccttaatcctataccgttttgcctttgctacactttttctcaacacttctctttctttgtcttccagggagaccatccctagccttcatacctggctgaagcaagcactggagggcaaagttcctatcctgcttgcctcttgctgcttctgtgaaggttttcgcaaggttttggatataggagaataattgtcagccagccccagtttttaaatacacattatttgcaggcagatattgtctggtgccacaggcagattaaagcataaacagatacaacaatataaattggatttggagttggctcttggtgtgtatacatctaatcgtatatatgtacctctgcagatacacctgcttgcacttgaattacccagagatgaaccaaggaagtgaattttgagacaggaggagctgaagttgaagaaaagaagggacagaaagccttcttgcaggggggagcaataaccactcagcatgtattaattgagttccaattatagccaaactgggcagtaaattcagtactctgaatacagaatcaagtgagggttggccctgtcctcagagaacttccagtttgtgtgtagaaatcaacaggtaaacgaatataatagagtgccttagtattaaagtagggaatgaagaagtgaggtgaacagatcatatatgtgcagtgtatggcaagaggcaatgttgtcgggtttttttttcttctgattttaaaactaacactcataaaacgcagtatagaaaagtagaaaaatgcagaaagcaaatcattcatcatctcaccatccaaagtgaagtataagataatagtttcataccagtgcctttttttgcatgcatagacatttttggtttattatttaaccctaatctgataaatcaggtgtttggaaagattcagatcataacaatagattatcaaaacttgcggagcacatgtctccagacaagtacttgattgaatatatggtaaaatgtttgtcactatactttaataccgcatgcttaaagcctttcatatatgtagacctaacagttttcctagcagttttttttttaatttatttttgtgtgtatgtggatggtttccaaatatttagcagtttttttaccctcctcctgaatccgtaatgtttgcttggaaatataatttcttaaccaccttttttaacagctctatcaaaatataattgatataaccacacaattcaccaatataaatagtacaattcagtgtttttttcagtttagcatattcacagagttgtaccactaccaccacagtcgattttagaacatttttatctccccaaaaagaaacgccatacccattagcagtctgtcttactcagcttgggctgctaacaaaataccatgaactggattggcttataaacagcaaaaagttcttcctcacagttctggaggctgggaagtccaaggtcagagccagtatctggagagggttcatttcctcattcattgatgatcgtcatcttgctgtgtcttcatatggtgaaagggacaagggagccttccagggtctctcttataagggcactaatgccttttatgacataattacctcccaaaggccccagttcctaatgccatcaccttaggaattaggatttcaacacaggaaattttcaggggcacagaccttcagtctgtatacagtcagttccctcaaatcccctagtcccaggcaaccaccagtctactttctgttcgtataaatttacattgtctatataaatggaatcacattatgtgtggttgtttgtgactggcttcttttactgagcataatggtttcaagggtcctccaggtagtctcagtatatcattctttttatgactcagtgatattccattgtaagtccataccacattctgtttatccatttatcagttgatggacgttaggattgtttccactttttggctattatgaataatgctgctataaatattcatgtacaagtttttatgtggacctgtatgttaatgcttttgggtatatacataggtatgccaaactaccttttttgcatattattcattctccaatttcagtgaaatgttttatataattttattatacaaggaaaatatttaaaactaaatcagttaccttctaatctcctctccccaccacctccatctatctcattctgccagactttactaataatataatacaaacttaaaatcatgcttctcctctcaagtcatgttcacatttccatcaagttctgatcatcttcttctaaatgtctttgcatctctagccatttccttgtcccacctagttgaggcccttgtcatcttacttgtacactgacttcccagttgacctccttggcttggtttccatcccttcttattgactcagtaaacccctgccaaattagtctttctaaaacactttttctatattgctgttcattgaagtcagacaaatcagcttagccacttactcatctgtgtttccttagatgttactttacttcccatctgtaaaagtaagttaatcaaaccacttcctaacattctattaagatgaaacgattaccgcgacttctgtctcccactggtaaaatgaggtaaacttctattcggtgattctgcatttgtatatcttgtctccttgtctcctgctattaatgtataaatacatattatatgtatatcatatgacttacattatatgtatattacatacattataattatatactttgaaatgtaatttatattttttatatgtgtattttttagtatttcccagcaccaattacagccgcatgtacttactgggtaatcagtcaattagtgtgtactaagtagatcagttaattgattttctgcttcatccagttatttgaataggtggtaattgtaaggtgataagttaacaattttaacttaactgataacaactctagaatagaatgtggtaatgagtataaaataatagatattctccagtaatatttttttgaaagatcactttatgaacatggaaaattcttccactaatcaagaaaaatagctgtcaaagcatagctgcaggtcaaatacaggttacaaaggtgttctataggttaacccatgacttccttgtcttttgagtacaatgaaattattgtaactaaatgaaactttcatcccctgttatgcatgaatcatttcctttctataacagacataccagtatacacttctcatctgttaaaaaacatacccaacttctaaatgttgtttgccactgttactgagattacaaatgatatctatgcatttttgagttgtttttttaaaaaggcatataatctgaaacttagtccccttggtaatttgacctgagaaaatttatctcactgatagacttaaatacttggtgaggtttttggttttttttgttttgttttgttttgttttgtttttttttgcaaaactgcatacaggaagtgatattgccaattcagaattaattaatccttattgaaaaatgtggcattcatcctttagaaaattcttttcttgataaagttgtaagagctgtaacatgtaagcaatatttagtgaccccagaggaaagactgttagacttaaatgtgacttggacctcaccacatggtggcaaatggttccttcctttctacttcactgtgtgaaatactttacatgattatctgtataatattggccaggaataagagaggtgtgtgtgtgtgtgtgtgtgtgtgtgtgtgtgtgtgtgtttagttaccacttaattgtaactctgctataagctgggcattctagtagatgagatatattcataatctcacttagttgatcctatgaggtaagtatcattctttccattttacaaatgaagcaactaagtcaaagaaattaagagactttcctaagatcatataggaagaaacagctaaatagagattcactcccaggacagtccatcgccaaacagaccctttccccagtcaaaaaaaaatcttgaaaaatcagcatgttaactaaaaagaaataaaaggagaggggaatattatgcccttaattaagccatgtaacatctccagtactcagtttcctcatctgaaaatagggataattgtactactacatttctcctggaatttttgtgagaatcaaatgagattatgtttggggcacttggcactaggccagatacaacattcatgctcaataaattataattgttaagattccattttttgcctttttttggaagttttagaaaaaaacttggacttctcaccttgtcatcttttaagacctgtcaagatgtctttcagagcgcaacttcgtgattctttatgaatttggctgcattagtgatatgcaggtggcttatattagttttataggactgctgcaacaaaataccagactggattgcttaaccaacaaaagcttattttctcacagttctggaggctggaagtccaagatgaaggtgtcagcaggtttggtttcttctgagggctctcttttaggcttaccttctcatggttctcacatgtttatttctctgtgtgcatgtgcacccctgatgtctctttgtgtccaaatggcttcttcttacaaggaaaacagtcagatttgattagggcccaccctatcttattttaattacttgtttaaaggctctatctccaaatacagttaaattcggagatcttgggagttgggcttcaacatgaatttgggggaaaaaaattcagcccatcaccttgcaataagtaaattcttttccactgcatttggaaatcattattttcaggaatagtaacattcatagaaagtatggttgagaaacgttaaggtgtgttctaaccactgaaatgctatgactgcaggattctccatatatggccatatatagtgagttcatttattgtgcacagaaaatatttaagaggtcaagtttaaggctgtataatttgatatataatataaaaagagatatgatacctgataatagactacaactattttagtacattaatgttgaaaattacctgtttatggcatttgttgaggaaggaatcagggaacgtttacttgtgtaccataggtgtatgcaaaatgaaataaaatgtttagtaactgcatctgtcagagtaaagctctatggcagggatttatagggaaacctagagaagtctcctccctcaaggggctacttgatcttcttggagaaatgccagaaatgtcacaaaatgaccttttttaattgccagttaaatgctcaatgtagacaaggaaggctgtgtgtttgaagcagacacaattgcctctaaagcccagagttaagatttagaacttgtaatggttagctgccataatattgggaggaagaaaagtggtataattagaaaaatagacccagaggtggttcactgcagcattgaggacaaatgaaaggagagagacccatgaggaagtactctgatagcagagtagtatggaaaaagtgctctgagaaatatcaaagaatctcacctatttatggttcgagactaggatggtggtatgttccaccttatcacgaagttaagcagatctttgaaacctggaactgaatttgacggtagcactgttgtaagaatgactgcaaacagaatgcccgtgattgtaaaacatggaattcatctaccaccaggtattcatgagagatcctaacccatacatgaaatgcagggaaaaccttcacttaccaaaggaaaaatgtctcaattttttttacttcttcccaacccataaagaatattttgcttcctgtgaaacaatgataatggcaaatatgattgaaatgtaatctgagaacatttcttatttaaaatgtatctttattcttttaggcctctttttcgtggaagttcagatgttgatcaactaggaaaaatcttggagtaagtaataattataattttacaccagtgtccatagcattaaaacatttacagtgactttcctctgacatgcatatcatgtgtttatctcttgtctttcttacttcaagcagctgctgcagacagtgttactatttgtgtggtgagtggagacatggtagaagtgccgttttatgcagagccctaactgctctgctctggaagcttgtatgttgcttgtgtggatctttttgctgctcctctttcttcgtgtggctgagctccagttcttttagttcaaatacattttctgcttgtggtcatttcaaaagcacccaccatcagagatgggatgcctggtgaccaagtacccatccttgtccagtgagcttcctgtccccactgagtatccttggtcacccaggttggttctgcgttgttttgttttgttttcctgggcgaaggatggtatgctacacatctcatttttctttggagcaccaaaatagaaaatgagaaccctaagtctttggcaaaataactctgcaactttgagaaagtcatttaaaacacctcgtgaagggcttacacagtgcctggcacatagtaagcactttaaaaagttatctattactgttactattagagttcatcattaattatttaaccttttatttccttaacttcatctgagaaatgaaactctgacttaaattctctataagatcctttcttgtgctcaaattctttggtttcagttacatcgctccttgatgatttacatagtttcattcatgtctgcatgttcatgcatgtatgcattcatgtttctagaatgtaactggggcacttcttctgacaaagcatgcagtgtggcatccttttttggttttttgtgtttgaaaggcccatccaaattggagtggagtaggaaaaaagtgggagttctagaccaaaaatagccctgatctttggtctgtgacattttataggaatcccagtgatttttatgaaattcgaagtctgtaagactgaaaaaaaaaaaaaaaccacccctaaagaacagattttcatatcagcactgtctactcaagcgtgactgcttaaaacagttaataaaactggaacctgattttgttcttttagtgactagaagcagctagacttctgttaatgccagtgctactgctgagtcagaacatagtagctttaaggcctgaataacatttgctagttttttatgcctgggggcttcctgggtccagggcaggtgatgctactgctcctactactgaccactctgtacagtggataaattcaacacaaagccttcatgttacccctgcttctgaatggcaagttatttaatcactcgatgaactcccatctatttttccccatgactgttgaatatattttgtgtgcatgtgatcataaagaggaaactagggaaagcagacatactgatgaccttctgttaaaaggaaagagaatcttgactaaagtcagcttgccaggacttgaaagccatcaccttctttcccttatttatactacctgacagttgtgtctacctccagcactgatgtctgcaatcttgttaacattgttagtgcccccttagtacatgaggccagtgaaatggaccagaaggaacatttgaccggcatgtttgacctgcttccaaagaaaagccagttctgcttttggcaaagtcctgacaatcgtaggttgccaacagcaaagaagctgtagagttctatggtttgtgcctttagattttactttgtggtttctggcattgtgtcatcaaaattatgttctgtttcctctgaatgcattaccttgccagagaaaagggacaatgctgcaccctagcgtcactgctgaagtacttgaaaaaatatttctgtctcctccatcactgccatttatagattttgtgccctgttgggcttgccaatataaatgtcaacttttaaggcttatattcagcagtccaaatagtggaattaagtgcaagcatttttaatggacctatcagaatttcacaacacatatttgggccataaaagttcattctggacatgaaaccaaattttttttaaggaaagccatattcacatactcttttttatttttttctttggagacaaggtcttgccctgttgtccaggctggagtacagtggtgcgatcttggctcactgaagccttggccttccgagctcaagtaatcctcctatctaagcctcccaagtagctgggactacaggcacagggcaccacaaccagctaatttttatattttttatagagatggagtttcaccatgttgcccaggctggtcttgaactcctggggtcaagtggtccacttgcctcggccttccaaactgctgggattacagccaccccacctggtccatgttcacatactcttaaagggaaaaacatttctgtgtttaggaagatttaagccttcaagtaatagcaagtattaaaagtgaaacaatagttttagcctgtgacatcttagagcatttttaagaatgatgtcatagctaaatggaaataaaatattggaatagagagaacggaactcactctggactctgtgactgagcttgctatctgtgactttggcagttcattttattcctcattctcaatttccccatctataaaatgagactaataacacctgacttacatgtcttaggaaattattacaggaatcagaggaggtgatagacttaaagttttatatatatagttatgtgtttgtttaaaattttatataaaattatataaagttatttgtatatgtacacacatacaaacagagatgtgctgttcctctgaaggcttttggcattcagttgatcatatacttgcaagatgtaattagatgtagatacattcaaagccacaaataaaaaagattttaaatatttctaggagttattaatataatcaatttctagctgactggtgaatatacacaaaaatattgatacacatagacctgacaactaaaaaggaatgaaaggaaatttttaaagctctctaacaagcatttttcattccctcctctgccctgtcccattgtatccagacacttacacgtgcatttcttttcataattaatagtggtatttttggtttttttctttttacttctattgtaggctgtactattgaacaaatctatatattgctcattgtcatttctatttattgcttctagtaaatatgtccatgaatctgtctttgcctcaataatgtagctctctcagtatgcctgatagaggccgaattacagtgtcttccccagacacccaggcagagaagccatgatgacagggttatcttcccagctgaagtctatggcctgggctccgtgtaggtgagggaaggggaaatgaagtgctacagatcttgagacctgtaccacatcttcctgaaatctggaagtacattcataagaacacctcttcctgggccttagtcccaacaagtagaggccaagcagaagaccctaatgtgggccagcacaatttctaactgtagttaaaattatttgttccagtatttgaatagctatgtaccccgtccactaaactatgattttatttttggttcagagttatacagtctgtgtgagaaagaagtccctgcatcctctgattttctctgttcaaacctacttacgacctatatgtaaactataaataatatctatacaatgtataagttatgtaagtccattgacccattaattttttaaagaatcttaagttatacatagatacaagcagttcatattttaagtgtggtagtgatgtatttcctatgcatcttgtattaataacattttctaattataataatagtaggcagtgtattgattgataattgactgtgtgtgatgtatatcaggtgctgtgctttgtactttaaattataaatttatatattactataaattcaaataaagtataactgatcctcattacaactgtaagttattatcattgtatacataaagacactaagggtcatagatgttaagtaatttgtccttacctgccagtaagtggcaggtgcaggatttgaacccaaatctgcctatttccgaagcctgtgcttatcacttgctgttctttccacatttctgatcccagaatggttttcaggggaaatataaataatagtcttttaatttactgtttgctcactttggaataccacagacttccttttataaaatcatgtttgtataatgcaggactagcacgttttagcctcatttttccttctgattctaatgtatatatttaatatgtagggaattgctctttaaccaaaaatgcaaccaaattgatatgttaataaaccatgttggatgagcatcataaaatcatgtcaatactggggtgttcgatcaaaacacaaaaagcattcttggacataaaggaagatatgtaccagtatgggtctcctctgaatacaataagtcctgctttgtcactaagtcagagcttactgcctggtaatatattttctatttctacatcatcccttacatttagtgtctgctaccagagcaatctcttatctcctcccactgaattttacaattcttctgtgagattaccctctcccccatggccaccatattgcagtaggacagagataaacagagaccctgccagtgataaagtgaaggtctcctgggactctgccccccatgtctcccccttagattttgcctttctctggaaattgatgagaaaacagcttctgcatagtagctaatgcttatgtccatgtgtggttcttttgtagcgtgattggactcccaggagaagaagactggcctagagatgttgcccttcccaggcaggcttttcattcaaaatctgcccaaccaattgagaagtttgtaacagatatcgatgaactaggcaaagacctacttctggtaagtttttctgatgtcaagctcgtctgcactgtgccagtgagacacctgctctacccagactgggtggtgggcacaaatatcagttcagtagctgctataggcatcacatgccacagccacatggagcaggaggcaacagtccctccagaggtttcattttcacacttgtagcagctggtggcttttgattctggaatgtctttctgatccacatttttttaaatctgccatctttgaatgtttatttcaatgcaggtttagaagcctctcgattcactttgacatatgtttctttagaagtaaatattatgtttcctttcttacagtttcatgctactttaagtaatttgtttgtcattttaacgtgccttttcttaaacattcacaactttggggagatgtttttccaaaagaactatatagcaatacttcttctagttgctgatttatttaataagtatttagtgtgccagggacatataaaatacctcactgaaaataaggacttctgtgctctgagactcttaatgctcaaccatatacataatttcctatacttggaggccagaacaataggtagaaaagtgtacctgttgggctgttcttgatgtctgaaacccagtgagtaatgagtgtctgctttacctcctgaattaacagcctttgatatctgcttctgcccgtgggtgaagcacaggtcttctccatgtgtctcatgctggggcccatgccagagaggcagcagctccctggggcatgtttttctcatgatagaaggtatcgatgctccagaagggcaagcagaaatatgcaatgcccctgaaggtccatacttggaagaagtacccgccactctgcccatgttccattggccaaagcaagttccatgcctaaggccaacttgaatggaggaaagaatgctccccctatggtgagaggggagagaaaagagggaatatgtactaaaagttatccaatctaccatagtatccaactcttgactaagttgtgattccaaaagctcattttataagtaaactatttggcaattaaactaaattttcttgcagaaacaatattattaacacaaagttttttaattaaccctcaacctggcaaccttgttcctgaagtagagcaataatagaacttaaacaccttttttttaaccatatttctataggacaaaatgtattaagacttccaacgtgagattctcccacacccccacatttggctaaggtgttctccttctctccaccctcttcccagctttaagccatcagtgtagctgtgaggaaagggcttcctctcacataatcctctagagacatgtctctgtattgtgaatgtattcccacagctcttttctcttctttcctatgtcctggagattaaatgccactacctaattttctccttcttgggctctgggaaaagagaactcaggctcaggaattttgcccctgctttccggtcctttgggaattcagcccttgcaaagcttttctagagatgtttcttgctgttagagacagttggaacctttctacagacaagctctttcttccacttgccctttagctcttgatgttcagaagatcctatagggaggctagcaaccatggactgatggggatctcaggataaatcagatttcagaggacccaagaatttgcctgaaattacacatagaactttctgtttgtatttgtttttctaggtcagtagccttcgatagaatattagagaggtccctaatccagttggaacctgactaggactgtgagcaggagtcctattaatatcatggttatgcagacctcttaagtggaagaggtcttccattaaccatgataatgtgaagtctgtaaattacatagaagactggaatgcatagacatttcatatacccagttcactttaggatggagaagccagtgtggcttccctgctacttgtgagctcctgtggcaatgaggaggtcttactcatcactaattagtgcttgccacctgctaggcacccagcaggaggcgttgatggaaggagaggaggaggatttgagtaacaagattacctgaggtaggggtggaaatgagactgaaattagggacacattctaactaatttaggtatggacagtttgggaatagagattgctgctactgcaaaggtttccctttccctcctttcaccttctacctcagtagctcagccaaactgcccaaaccacttgactaggaccaggagcttcttaagcgcaggcaccagctcattcaccttggtagccctacacttgagctgtcagcctggaatagagtttagtgactcgaactgaatctaatggtcccctgagagagctactgctagccatgtggcaccttggtattaattaaaaggaagatagccctgcctctgagtggtgtagccttgaggcaggataataagttacggtgaagtctccgactgtagcactaagtttgctagcactggaagaattactaaataaagttatatgcatactttaatggcttagtgagaaatcctgggcaggaaacagtccataggcacccaaaagggtcttctcctgagggacattttatacattagggatatatatgagtactgtctccatattatttagtgtccctttaaataaatactcattcccactgtagatgcgcttaacatatgacagtgaataaagggataactctgtaagtacattatttacattgatgtattgtatatcaaccaattatttttttctttattacagaagtgtttgacatttaacccagccaaaagaatatctgcctacagtgccctgtctcacccatacttccaggacctggaaaggtgcaaagaaaacctggattcccacctgccgcccagccagaacacctcggagctgaatacagcctgaggcctcagcagccgccttaagctgatcctgcggagaacacccttggtggcttatgggtccccctcagcaagccctacagagctgtggaggattgctatctggaggccttccagctgctgtcttctggacaggctctgcttctccaaggaaaccgcctagtttactgttttgaaatcaatgcaagagtgattgcagctttatgttcatttgtttgtttgtttgtctgtttgtttcaagaacctggaaaaattccagaagaagagaagctgctgaccaattgtgctgccatttgatttttctaaccttgaatgctgccagtgtggagtgggtaatccaggcacagctgagttatgatgtaatctctctgcagctgccgggcctgatttggtacttttgagtgtgtgtgtgcatgtgtgtgtgtgtgtgtgtgtgtgtgtgtgtgtatgtgagagattctgtgatcttttaaagtgttactttttgtaaacgacaagaataattcaattttaaagactcaaggtggtcagtaaataacaggcatttgttcactgaaggtgattcaccaaaatagtcttctcaaattagaaagttaaccccatgtcctcagcatttcttttctggccaaaagcagtaaatttgctagcagtaaaagatgaagttttatacacacagcaaaaaggagaaaaaattctagtatattttaagagatgtgcatgcattctatttagtcttcagaatgctgaatttacttgttgtaagtctattttaaccttctgtatgacatcatgctttatcatttcttttggaaaatagcctgtaagctttttattacttgctataggtttagggagtgtacctcagatagattttaaaaaaaagaatagaaagcctttatttcctggtttgaaattcctttcttccctttttttgttgttgttattgttgtttgttgttgttattttgtttttgtttttaggaatttgtcagaaactctttcctgttttggtttggagagtagttctctctaactagagacaggagtggccttgaaattttcctcatctattacactgtactttctgccacacactgccttgttggcaaagtatccatcttgtctatctcccggcacttctgaaatatattgctaccattgtataactaataacagattgcttaagctgttcccatgcaccacctgtttgcttgctttcaatgaacctttcataaattcgcagtctcagcttatggtttatggcctcgattctgcaaacctaacagggtcacatatgttctctaatgcagtccttctacctggtgtttacttttgttacctaaataatgagtaggatcttgttttgttttatcaccagcacacagattgctataaactgttactttgtgaattacatttttatagaagatattttcagtgtctttacctgagggtatgtctttagctatgttttagggccatacatttactctatcaaatgatcttttctccatcccccaggctgtgcttatttctagtgccttgtgctcactcctgctctctacagagccagcctggcctgggcattgtaaacagcttttcctttttctcttactgttttctctacagtcctttatatttcataccatctctgccttataagtggtttagtgctcagttggctctagtaaccagaggacacagaaagtatcttttggaaagtttagccacctgtgctttctgactcagagtgcatgcaacagttagatcatgcaacagttagattatgtttagggttaggattttcaaagaatggaggttgctgcactcagaaaataattcagatcatgtttatgcattattaagttgtactgaattctttgcagcttaatgtgatatatgactatcttgaacaagagaaaaaactaggagatgtttctcctgaagagcttttggggttgggaactattcttttttaattgctgtactacttaacattgttctaattcagtagcttgaggaacaggaacattgttttctagagcaagataataaaggagatgggccatacaaatgttttctactttcgttgtgacaacattgattaggtgttgtcagtactataaatgcttgagatataatgaatccacagcattc

SEQ ID NO: 12969 - DNA, 36148 bp, Human
attttcaacctagttatgcatccttaacagtgtagaaatttgcgtctttttctaacttgagtgtaactctttccctgttattacaatcacttcatcaactttattcttttttttttttttggaggcggagtctcactctgtcgcccaggctggagtgcagtgtcgtgatctcagctcactgcaacctctgcctcccgggttcacaccattctcctgcctcagcctcccgagtagctgggactacaggcgcctgccacctcgcccggctaattttttgtatttttagttgagacggggtttcaccgtgttagccaggatggtctcgatctcctgacctcgtgatccgcccgcctcggcctcccaaagtgctaggattacaggcttgagccaccgtgcccggccttttttaaaaccaccttaaccatttttttttttttttgagacagagtctggctctgtcacccaggctggagtgcagtggtacaatctcggctcactgaaacctcggcctcctgggttcaagcgattctcctgcctcagcctcccgagtagctgagattataggtgcacgccaccacgcccgactaatttttgtatttttggtagagacgaggtttcgccatgttgcccaggctggtctcgaactcctgacctcaagtgatctgcctgccttggcctcccaaagtgctgggattacaggtgtgagccaccacctccagcccaccataatcatttttaagtgtacagttcagtagtgttaagtatattcacattgttgtgaaacagatctcgggaactttttcatcttgcaaaactcaactctatacctattaaacaactccccttttcctcccatcaactttattctgaatggtgatgtaaaaataatagctaattatgtctagcactgtgctaagtattttatacatatgatctcttgtaagcctcaaaataactctcgaaagtaggcattattatcatcatcttacagatgagaaagtttaggcgcagagatattaataacttgccctgaggtcacaatgtaacaagtgctagtgctgcgatttggcacccagtctgggttggcagtctgtgctcttaaacctaccaggctgcactcatctcttgatttacttaaccagccccctaaccttggccatttagattgtttccaatttgttgttgttaaaagtaacacagcaatgcacagctttgtgttaactgtcctcccaccaccaccaaatttagcattttcctgagtgaataggtgtgcacatgatgcctagttgctttcaaagaggggaatccatgacattttcatacaattcgagaatgttagtgcttatgtggcaggaaattgttcaaggtcaccccctagaaaatgatggcgaagaaaggacgaaaacctgagacttctggttgtagttctctccctccattgcttcccttacattaagatagaatgaacagtatgggccgggcgcagtggctgacgcctgtaatcccagcactttgggaggccgaggtgggtggatcacctgaggtcaggagtccgagaccagcctgactgacatgacgaaaccccatctctactaaaaatacaaaaattagctgggcgtggtggcgtgagcctataatcccagctactcggaaggctgaggcaggagactagattgaacccgggaggcagaggttgcagtgagccgagatggcgccattgcactccagcctgggtgacaagagcgaaactccatctcaaaaaaaaaaaaaaaaaaaaaaaaaagaacgaaaagtatcttcctcgcgaactgaatctcagttgatgctagtatcttccatgagacttccttgttgaggcaggtaactctgtgggttaacttgatggggctcagccaaagacctaagaactaaatggattaagatgcttaatgaggccagggctcaacttaatcccctgctcctgggccagctctccagttcagtaaggtagagctttggccgaggacgaggggaagatgtcacgcaagatagaaggctttttgttattacttctctttggctatgaaggtatgtgctattcaaccattgacattcattgcatacttaatacataatttaattaatatcgttgataaataggaatatagcctgaataatataaatattattaattagcaacacgttaattaactaacatgtgttattaatgaacaacagttgtctttgtgtggatggctttccagttctgtgaggagccttctaaagttcaaaggatgcttaaaatccaacagaaaacaggatgggtctcagaaatctataaaatagccataagttgcaacaattaatgagaaagtatggcatattctggaaaacttttaggagtcaaagtgggagtgattgtagaatttaatattccaaaccggaatgctattgacggtggaggacgatgctattaataattctgttgggacgacaggtgtaacccaggaccatccagggcaaattggggtgtaaggtcaacctagtttaaatatggattaacgtaacatacccagtaccactggaatctaataaaaaacataatccaactgagagtcaggaaacctcggagactcagtacactcactcattttaaaatttctaaatatgaccctagcagaagtgatatgcttcaattaggaaaaaataagggcaaatctgtaaaatgtcatccagttccaattccctctcaatctttgaaataatattctttcatgcctctctcaattctcaagtacccatctgctcagaatttctcctcaggttcatccagatgttagaaattggttgcctgtcttctttgtggacatcgtgtatttgtgtgttatagaaaataaattaaaaagcagggagaaggaggtctctgtgctctgcaaatgacctggtagacagacacagcgaaactcacacaagtagaatcagaattcttggtttcacggctcactgtagcctcaacctcccaggctcaagccatcctcctgcctcagcctccctagtagctgggactacaggcacgcaccaccacatccggctaatttattgtatttcttgtagagaggggttttcaccatgtttcccaggctgatgacttttgttacttagtcacatttctcagtatttggaaagactggtgacaatataattccaaggtcattctgcaaaccccaaggtatatttctaagtagggatcatgtaaaccagttgtctgttaggattttttccccttgcaattaatagtctgcaacttgtcccagtaactctgactactttaagatgctttggggttttgttgtttttccttttactccttgccccctcctctttcctcagcaagaaaatctaagcagactctttcaaggcttagatctaaatactcctggttgtcagacactcccagggctcactctcggatttctcttctttgtgattggcatggagattcattcattcattccttggtcccttcttttaagagctcatccctgactatctgctagggggcaaacattgtgtatgacggcggggcgcggtggctcatgactgtaatcccagcactttgggaggctgaggcgggtctatcacctgaggtcaggagtttgagaccagcctgcccaacctggtgaaaccccgtctctacaaaaatacaaaaagtatctgggcatgatggcaggtgcctctaatcccagctactcgggggaggctgaagcgggagaatcgtctgattgctggagagggaggttgcagtgagctgagatcatgccattgcactccagcctgggtgactgagcgagactcagtctcaaaaaaaaaaaaaaaaaaaaggacttgacatgcagggcatccttgtttcttccacagtgctgagtctaacaaccctgttctgtgacctccccacccccgcgatgcgaagaagtcctagaaatgtttaccaaagcattttaaaattagacctgcccagttagtggatatcagcaataaaagacaggctgtcaggaggcatgaaggatagcactctttcgtgttctaaagtttaccaatctttgtgcatggctggggagctccagaaatgtccacgaagagcagagaacatcgcctctccaggtgccctgcaacgtgggccagtgggaaggtttggggagcttaaattatcttacttgcttaacgcaggcctttaacagcacttgaaaggaaagcagccagccaaaaatagccagtgtggcttggcaacctactgtgtgccctaccctgggccagagggatgctccaggggacagaggacacaatcactgaacttaatcagcatattatccagatggagatgcataaggcccatagacatgggaaagatgcatcccattgtacagctgggaacctgaagacaaaggctgtttgtccaatttaccctccactgcttctgtccttcagtggcagtgtctcctcattacagtgaaataaggtaaagaaattgccttcacttaggcgttggatgaaggttcatttcggagagcacacagcctcacagtaaggcatttcctatgtctttttttttttttttttttgagaatttcactcttgttgcccaggctggagtgcagtggcgtgatctcggctcaccacaacctccatctcccgggttcaagcgattctcctgcctcaggctcccgagtggctgggattacagacgtgtgccaccatgcccggatcatttttgtaattttagtagagacggggtttctccatgttggccaggctggtctcgaactcccgacctcaggtgatctgcctgcctcggcctcccaaagtgctgggattacaggcatgagccaccgcacctggcttcctatgtcttataattgagtcaggcttctatttctcttacaccgcacatattggattcaatgccaataaggatttttagaacatccatcgtattaaaatatcttacttcattacttggtcatgtttattatataaaaacaaaaaaagtccttcagcctcaacttataggtgactgtgttaccatcagagattgcaggggtttttttaaagcagttttattgagatgtaatttatatactcttaaattcacccattgaaagtctattgttcgatcgttttaagtatatttacagatttgtggagcacataatctaattttagaacattttcatcacccaaacattaagccctcgctccccattctccctgtctcccccctcccccagcccctgggcaaccacggatcgactttctgtctctaaagatttgccagttctggacagttcatttcaatggagtcacacagcatgtggtcttttgtctttcgcttagcatatgtggttgaggttcatctgtgtttgaagcatgtgcagataacagatttacccatgaatatgcctgtcgcctaaaatagtaacactttcacaccagaagcaatttccttctttctctttcacgagagggacattattgcagcctgctgcgtgcgttcctcctgtttctcaagcagattggaagctggttacagaccatttttaatcattcataattttatgcttttcttctcggcttcatctgtttccatgggaaggaacgctctatggttggtgatacccaatccaagagactaaactaggttttcctgtgtgtatctaaagcgcgcctttcctcatgggttgcaaggtacatttcaagaaatagacacgccttgaaatttcctgctgtgacaacaagggtttcctcacagcagagtggcccttttggaccaaggggcagaatgagcccatattgcataaatctaagcccacattgcataaatctaagattggtgactggcggatgtctcatgtaacatgtggcggaatcacagaagccatctaaacagggagaaaaatatgcaaccacataatcgaaatatttcactatttttcctttagaggctgagatatttctcttgttccccttccaacaatgctattttctggtatgatactattaggttggtgcaagagtaactgcggtttttgccatcacaatatgttgtcgccaaaaatgcttttgttctccagtttgttggtgattaaatcattgtgtgggactgcagcagccatgttgcttctcctttggtgacagctttttctgtaaaacgcctgtcgttccttctctctctgctcacttccataaggatatggtacctcagaaccccaggctgtctacagacaaatgctttctgcgggaggggagtctgggaagaaaagaaatgcaagaaatgggtccaaaattggattgcacccaggaattggctctgaaagcaggcctctcttccttggactctaggtttgctcagtgacagctcaacagaccagactctcttcagtgacatacatggcctttgagccaagtggatttggttatgaaagccacactgtcagtgaccaccaacaccccttgcctttggtctcccaaaaagaggatctggcactgtttttttttttttttttgagacagagtctcgctgtgttgctcagggtggagtgcagtggcgtgatcttggctcactgcaaccttccgcccgcctgggttcaatcgattctcctccctcagcctccctagtagctgggatgacaggcacgcaccaccatgcccagctaatttttgtgttttttgtagagacagggtttcaccaccttggccaggctggtctggaactcctgacctcaagtggtttgcccgcctcggtctcccaaagtgctgggattacaggcgtgagccacgggcctggcacaattgatgttgacctaactgacagggcccttcagaaactgcctcacagccagtcccagcttctcttgagggtggggatgggacagagcatctcctggactagcagcccccagccaactagaccctaattgctgatttcctttgcatctcttgatgaacagctacaggcctgaggttaggagttcatgtagtcgttaactccgcagagcacagggcaccatccagcctgtctgggctcccccttgagttccagaagcatctgtctggctgccagctcgatttcaacactggggtgtcccctaggcgtctcaaattcattatgtcccaaacagatcatcctcctccccatcctccccaaatcccttgtcttcgctgaaaccttcttccccttccgcccgccccgcaaatggcagctctatcctcccagttgccccagcctcagacttccgtttctttcacacccccacccctgccacgcgtaatctgcccgcagatcctgtgggcactacttccccagtgtagtcagaatccagccacttaacacttccactgccaccaccctgggccaagccagcatcttctctccctcggatgactgcactcacctcggaaccggaccctgttgccacacttgccgtggccagcccggtccacaacattgtaccagagggagcctttgaaactgtggtcagtaatgtcctcgtctatcctcaagttccacaaagcctcacatggcccacgaggccctgcaggaactggctcccggacacccccaacctcgtcatctcctaagactctctctcctctagctccagcctcaggagctccttgctcttcctggaacacgccaagcacacgctcacctcgagggcttggcacatgctgttccctctgcccagaatgctttgcccacaggtgtctcgcctccttcgaatctttgctccaacatcaccttctcagtgagggcttccctaagcccaaaaggaccagtccctgttccctacttccttgtgttttctccacagcagtcaccgtaattttccatactatctattctctttcttcattagttcattaatgtattctccccacccactcccacccaacacacacactagcctatgagctttatgatggcaagtgcttttcctgttttgtttgctactctatccccagcacctaaagctgggactggaatgtagtagatgctcaatgaatattagttgaatgaatgaatgctttgaggtgagtcattatcagtcattttttgtatgggtttctataatctgtgggcaagaaaaaggtggactgaaaaggccagagcaaatggtgagctgagggacaggaaaaaccctcttttttttttttttttttttttttgagacagggtctcactctgtcacccagactgaggtgcagtgatgcaatcatacctcactgcagcctccaactctcatgatcctcccacctcagtcttccaagtagctcggatcacaggtgtgtgccaccacacctggctaatttttatttatttatttgtttgtttatttatttttagcagagacagggtctcgccatgctgcccaggctggtctcaaacttctgagctcaaggggtcctcccacctcagcctcccaaagtgttagaattacagccatgagccactgcgtccggccaggaaacgtcctctttatagggaatgggctgagcaggcggagaagtaggggtggggggacgcatttgaggcaaagaaattctatggacggaggcaagagacagtctggcacatttgtggcttggcgagcagtacagagtgagaaacataaatcccgagaggtgggcaggaggtagatctatctccatgaccccttgaaggacactttattattatatgcatcataggggtgtggaaatggagagatcataatacatctcagaggtgggactcagcccctggcaacagggacccgccaaagcgttttgcgcaggagagtggcggcatcaggtttgcacctcactgcctcagcagcgtggaggatgaaagagacaagtctctctttagcaggtagagtacctgggagagagggtggggcctcaaagcaggcagtgggatggagaggagagaaagcccctggtggccataggatggtagggatttaggaaaaagaggaggcttggaggagccttctggatggggtggtagatggatggcgaagccactcaggagataagaaatagagaaaagaggccaggtgcaggggctcacgcctgtaatctcagcactttgggagggcgaggtgggaggatcccttgagcccaggaatttgagaccagcctgggtaacatagcatagaccccgtctctacaaaaaaattaacacaattagctgagcgtggcagcgcaggcctgtagtcccagctactcaggaggctgaggtgggaagactgcttgagcccaggaggtcgaggctgcagtgaggtgagatagcaccactgcactccagtgtgggtgacagagcaagaacctgtctcaaaataataataataatactactaataataacaacaataataataaagaactagagaaaggagaacagtctgaggaagcagatgagtttgttgttgttgtttttgagatggagtcttactctgttgcccaggctgggagtacagtggcgtgatcttgactcactgcaacctccgcctccccagctcaagtgattatcccgcctcagcctcctgagtagctgggactacaggtgtgcaccaccatggccggctaatttttgtatctttagtagagccagggtttcaccatgttggccaggctggtcttgaactcctgacctcaggtgatctgcctgcctcggcctcccaaagtgctgggattacaggcgtgagccacccgcgcccggccccttttgtacgttttttaatggatccatgtggtgtatctgcttcagcattggacttctcactcagcatcatgagatgcatccaccctgtggcatgtagttctagactatctatttgcattgcagtatagtgttccattgtgtaaacataccccgatgtagatgctctgcttttgatggacatatgagcatttccagtttgggggtattacaaatactgccgctatggatcatctagcacatgtttttggttttggagtatatatgtatgcatatctggtgggtagctacttaggagtggaattgctgggtcatagggcgcatatatgttcagcctttgtataaattgccaaatagttttccaaagaggttagaccaccttgcacccccaccagcaacatatgacacagttcaggtttctccacagccttgtcaacactaggttggtccactttgagctagcaagagacatctacgggaagatatcctgtaggccattcagtgcttactggatatctgaaccttggatttagcaatgtttactgggtgggtggaggaagcagagctctcaaaggagactgagaaggtgtacctagagtggtggaagctaaaggaagatgggactgacagcacccaacattgcggtgtgaagatggaaggtcagtgttgggaagagtccattggatttgaaaataagaagttggctgggtgcagtggctcacgactgtaatcccagcacttcaggaggccaaggccagaggattgcttgagcccaggagctcaagaccagcctgggcaacatagtgagacctccatctctataaaaataggtttaaaaatattgggtgtggtggcacgggcttgtagtcccagctaccatgggaggctgaggtgagaggatggcttgagccctggagttcaaggctgcagtgagctatgactgccactgtactccagcctgggcgacaagagtaagaccctgtctcaaaaaaaaaaaaaaaaaaaaaaaagccaggcacagtggctcacgcctgtaatcccagcactttgggaggccaaggcaggtggatcacctgaggtcgagagttccagaccagcctgaccaacatggtgaaaccccatctctactaaaaatacaaaattagccaggcatggtggcgcatgccggtaatcccagttactcaggaagctgaggcaggagaatcgcttgaacccaggaggccgaagttgttgtgagccgagattgcgccattgcactccagcctgggcaacgagtgaaactccgtctcaaaaaaaaaaaaaaaaaaaaaaaaagtcattgttcttggaaccaacccaaacgtccatcagtgatagactggattaagaaaatgtggcacatatacaccatggaatactatgcagctattaaaaaggatgaggtcgggtgcagtggctcacgcctgtaatcctagcactttgggaggccgaggtgggcggatcatgaggtcaggagatcgagaccatcctggctaacacagtgaaaccccgtctctactaaaaatacaaaaaattagccgggtgtggtggcgggcgcctgtagtcccagctacttaagaggctgaggcaggagaatggtgtgaacccgggaggcggagcttgcagtgagccaagatcgcgccactgcactccagcctgggcgacagagcgagactccatctcaaaaaaaaaaaaaaaaggatgagttcatgtagggacatggatgaagctggaaaccatcattctgagcaaactatcgcaaggacagaaaaccaaacaccgcatgttctcactcataggtgggaactgaacaatgaaaacacttggagacagagcgaggaacatcacacactggggcctgtcgtggggtgggggagcggggagggatagcattaggagatatacctaatgtaaatgacgcgttaacaggtgcagcacaccaacatggcacatgtatacgtatgcaacaagcctgcacgttgtgcacatgtaccctagaacttaaagtataataataatttttttaaaaagtcgttgttaacttcctcagccagcacagagtctgacattgagggactgtctttgtctgtttgagaagctataataaaataccataaactaggtggcttataaaccacagaaatttatttcgtacaatactggaggctgggaagtccacgatcaaggtgccagcagatttgggtctggtgagagcctgcttcctgcttcatccctggcaccttcttgctgtgccctcccatggcggaaggggcaagctagtgatactggaggagggcagcgcgtggtccctgcctcgggctccacccccaggcctgtgcccacggacctaggtgaggacaggcactcctgccttcgtgcccaaatgctgcatttcccaagaccaccctggcccaccacgcccccatcctgtgcctatcaaaactccaagaccctagcaggcagacacacaagcggctagatgtcgagaggagcacattggcggaagaagacacaagtggctggacgtgcagaaggcgttgagaggagtgcgccggcggaagagcgcacgatagacgccggcagccccaggccatcaaccggcggaacgaggtggagtttggccaggctgtcggagaagagtggggccacctaccaagcccgactccaggagaaaagcatctcccttctggctcccctatctgctgagagctccttccactcaataaaaccttgcactcattctgcaagcccacgtgtgatctgattcttccgataccccaaggcaagaaccctgagatacagaaagctttctgtccctgtgagaaggcagggagacgagtctaatggggctgactaacacaagccgcctacagacggcaaactaaaagagcactctgtaacacacgcctgctggggcctcagctgtaaacattcgcccctagacactgccgtgggtttggagccccacagcctgcccgtctgtatgctcccccagaggtttgagcagcggggcactgaagaagcgaaccacacctcccttgcatgccctgagatggggacaaggggacctttcctgtttcactagctccctggagtctcttttacacagatactaatcccatgtatgagggcaaagcctaatcacctcccaaaggccccacatcttactactaccacattggtgattgggtttcaacatatgaattttggggggacactaacattcacatcatagcagggactctggtggcctgctacaaagatggcgctccctaaccttcattgctacttgagaaggtcaattctgcccatagcgggtgagtaaccagtggaacaagggcccaggagagacagcagtgtggtggctgcaggtgagggtggccctgaatcttcctaggctaagagacatgtgcgcttcactcccactgcagcccctgcatagcccatcgaagtactcaccatgggcatggtccagtggcctgtcttctcctgggtcctcaagccccttgtgagcagagagtgaggcttccatttcagaaggcccagtcctagtatagcgccaagcctacagtggacacaaaaaaagtggttgcagaacagggaaatgtgtattattgaaattcaagcttttataattgtgatgataaaggctttgtgtggtttctaaaagctttttgtgagcatcagattcactttttaaatagcaaagtggttaaaggagggacttttatttccattttttacactcaggtttagtcggaaatttttttatcatcagaaaagaaagaaaggtatttgttttgttcaaaatgtctgggaaggccgggtgtggtggctcacacctgtaatcccagcactttgggaggacaaggcaggtggatcacctaaggtcaggagttcaaaaccagcctgagcaatatggcaaaacccagtctctactaaaaatacaaacattagccaggcatggtggctgtaatcccagctactcgggaggctgaggcaggagaatcgcttgaacccggaaggcagaggttgcagtgagccagtctcaaaagaaaaaaaaaaaaacaagtctgggaaatggagttttggtggtgtaggggagaaaaagtaagcacttttcctcacttatctcaaggttcatggctgagatccctacgacaaaagacagattaatgagggaaaaccatccatacttatttaataagttttacatggcacaggagctttcagagatgaagacccaacgaaacaggaagacctgtgcatttttgtggacagttgtgtggaaatatgattggaggatcaaagggtatgatctaatggtaataaatgagaaaagcataacaaggcctgtttgttcagattcgtgttggtgcccctgtgtgatattccttccctccgggtatagggcaggacacctgtcacatgagggtcttcaggggagaagattagactgaccttcctaggtttgatggcctgcttcagggaagaagaggtgaaaggaattcgatggcccatttcaggagagaaagggtcaagggctgtttttgtttctatggccagcttcaggagggagggggcaggagcaggtcagagagaccttcctgcttctgcagttttctcagtttccttgtgtgtccaggtgccatatttgatggtagcgtttcctgcaccccatcagtgctttaaaccagcagtgtccaatgcaaccttctgcgatgatagaaacgttctgtatcttcttagccagtacggtagccactagtttcatgtggctctgaagcacttgaaatgtggctggcttgactgaagaattgaactttttattttgataattttaattaatttattttattttttgagacagagtctcactctgttgcccagactggagtgcagtggtgcaatatcggctcactgcaacccgggtttcaagtgattctcctgcctcagcctcccaggtggctgggattacaggtgcctgccacaaagcccagctgatttttgtatttttagtagagacagggtttcagcatgctggccaggctggtctcgaactcctgacctcaagtgatcggcctgtctcagcttcccaaagtgctaggattacaggcatgagctaccccgcccggccaattttaattaatttaaattccaataccacatgggactagtcatgactacattggactgtgaagctttaaaccatcagtttctgctaatatatgcaaactctttacctgctaaagtgtgaattcattctctttattcatgcttctataaagagagcttatatgtcagttttatgttaaattttgcacactttcaattttcccacattatgtatatggtacttatactttgattgtggtttgatatttcctgtacattatagacaaacctataaaataatttctaaacaatgtcttaatcttaaatcatctaattgtggcacagtgagggaactgggaatcaactcctgaatagcacattgggcagacacaagggatgatgatgatgatgatgatgatgatgatgatgatgaagatttaataaaagagaaaccttgggccgggcatggtggctcatgcctgtaaccccagcactttgggaggccaaggcaggagtatcacctgaggtcaggagttcgagaccagcctggccaacatagcaaaaccctgtctctactaaaaatacaaaaaattagccaggtgtggtggtatgcacctgtaatcccagctacttgggaggctgaggcaggagaactgcttgaacccaggaggcggaggttgcagtgagccgagatcgcgccattgtactccagcctgggcaacaagagtgaaactccatctcaaaaaagaaagaaagaaagaaaaaaaacacagaaaaacttcacactgctagggttaaatgaaagggaaagcaggatacaacactgtttagatagcaagttctcaaatatatttaaaaatacacatagaaaaatgacaggaaatgacgggaaatatttatactaaaatgttaacagtgttggctttggtggtaaaaaatacaggtgttttcctctccctgccctgtccactttgctacattaatgtagtttccaaaattctataacgaacaaaaataatgattatctttttttggtttgtttttgagacagagtcttactctgtcgcccaggctggagtgcagtggagcgatcttggctcactgcaacctccgcctcccaggttcaaacgattctcctgcctcagcctcctgagtagctgggattacaggcgcgtgccaccatgcccagctaatttttgtattttttgtagaggcggggttttgtcatagtgcccagactggtctcgaactcctggcctaagtgttaggcccgcctcggcctcccaaagtgctgggattacaggtgtgagccgctgcaccggccctataatgatgatcttgttctttctgtttaattttactgtccctagcttcttagcatctgcggatgtttttcctggcagatatttactcaccatgacttcttccagaaggggtgttggtagctttcatgtgactatttctatttcacttttccatgtaacgagtgatgctgttggatttctctttcattaattagattttttctgtctcatccttttgctttagccacattgggattatcgtctaccgaggtatgtaacagtaagaaggctgtaatgtacatgcatagtacttttgaaaattttcctagccaaaaataacatagaggactatcactttgtttttaaatgtattttgaaatatattttggctgggcatggtggctcatgcctgtaatcccaacactttgggaggccgaggcaagcagatcacttgaggtcaggagttcgagaccagcctcgccaacatggtgaaaccctgtctccactttaaaaatacaaaaattagccaggtatagtggtgcatacctgtaatcctagctacttgggaggctgaggcaagagaatcgcttgaacccaggaggcagaggctgcagtgagctgagatcacaccactgcactccagcctgggcgacaaagcgagactctgtctcaaaaaaaaaaaaaaaaaaaaagtattttttttggtgatggtgactgtagcacatttgacctaggcaagctccacgattggtgtttgaatgagagaatgcaagtaaaacaggtcttcaatcagatggcacaatcttgaatctatctccccataggaacttccaggggatgtgaagagtctaaacttggattggggctccccacactcctgaagataactataatggggtgaacggtgccctctagatgggtgtatctgtgagattattagttggtcgcccagggtggcagacattttacttatttagaatggaagatgagtggtagctgtgtgtattgaggctggattaatagctcaatttggccattgtagcaaagctgctatagacgatgcataaggactgagtgtgatcactccgtgggggcaaccacagttgcctttgaccgtgacttttctgccctgcctctctggttggctgcaggatgaaggcgaggacccctggtaccaaaaagcatgcaagtgcgattgccaaggaggacccaatgctctgtggtctgcaggtgccacctccttggactgtataccaggtgagtatcccctgtccttgggatggaacagtcattgggaacaccccatttctcttcctttttcccactcagctgaattaaccccctgaacgctacccccatctttagaatgaaagatgagtggtagctgtgtgtatttattactatttattactattagtaagcctatgttaatgcgggttttctccagttggcctctgagcttcgaatctcacaatggcccctgcttcaacacatggcgtgatgtcagtgttcagaaacagctccctagatctccatgtctccaggctgggatagtacgatgggatctaactttcaatgaaatcgatgaatgagactgattgaaaataaattaatgggaggacgggcacagtggcccacgcctgtaatcccagcactttgggagactgaggcgggtggactgcttgagctcaggagtttgagactctcctgggcaacatggtgaaaccttgtctttactaagaatacaaaaattatccgggtgtggtggcttgcacctgtggtcccagctattcaggaggctgaggtgggaggattgcttgaacccgggaggcggagttgcagcaagcagtgatcgtaccactgcactctggcctgggtgacagagcgagaggctgtctcaaaaaaaaaaaaaaaaaaaaaaaggaaaagaaaagaaaagaaaagaaattaatgctaggcagcctggaattttgaaaagagcacaggctctagagccaggaagatgagggctggaatcctggctgtgtcacatctgaactctgggactgccacttttttccttgtctgtccaatggaggtgatgatagcaccatgcctggatactgcttgctcaccaaacagccatgtgcttccctcccattgcccagcccccttgtaattaatcaggtggtgccatccaaacagctacagccaaggtgagcaggccactttgaaaatggcactgaagggctggcactcaactcttcagctctccctttcctgctgtgaagccacctgttgagatagtggctttttctgcaacctggtctcaggctgatcacatggagcagaactccctgcctacccacggtagaccagttgcctgagtgaaaaataaacctgtgttttgtggagcctctgaaatttccaggccaatttgttctgcagctgatttagcctgtgtctaagacaggggccagcaaactttgtaaaggaggagagaggaaatatttgtggctttgtggaccaaataatctgtcacaactagtccattctgctcttgtcttggaaagcagccataaacaatatgtaaatgctcaagcatggctgggttccaataaaactttatttacaaaacaagcagagggccagatgtggcccatgggtcatagtttgttgacctctgctctacggggttgtcaacaaggaataaataagatgaggcattaaagcagcctgtggggtactagcacactgttgaataaaggttggtttctttcctaccagcctcctaagagctcacacactgaggagggagggagcagatccaattttcagaggcttgggcagtcgctgcaaatatttgcaatgcttaaatcctttccatgctcagagcttgttttgcatgaaaccggccttgctgcctctccagggttatgatggtattgtgccacttcatttactttacacaattgcctaataatagcttcacaagagacaggtttgtgtgtctgtgtgtgaggctcttttcattatttcattaaatatgcattaaaaaagcaaattgcaatgtgtgtgtgggagggtagggtacaatggtttctactgcgtgattttcctattttctgaaggggaagtcatttctgaactaagtttgttttccaagggaactatggggtcccaatcgtgaggaaaccggtgggcttttcctatcagacatcccctcaggctccatggcatgagctcacgcagccattaaatgttggtatgattggctcagtcaatactgacgcaccctcattaataatccatttataactcaattcacccatctttcaacatgtgcctatgatgtgtcaggcactgacaaggagacagaaatgaaggcattgtctccaccttagagaaatttaccattcagtggtaacgaatgttcttttcactagagacatgagacctcctggaattccattccaagtaagttctgtctaagaagaaattgaaaagacattgtttatgtggattggcttcatcgacccaatctagtttgatacttcaagaaagggccatgtgcagcctgggcaacatgacgaaaccccatctctagatggggggggcacggtggcatgtgcctgcagtcccagctactcgggaggccaaggtgggaagatcgcttgagccctggaggttgaggctgcagtgagccatagtcgtatcactgcactccagcctgggcaacagacagagaccctgtcccccccaccaaaaaaaaaaaaaaaagagagagagaagagtcatgtgtttgagggatgtgatattgaccctggtccccaaagctgtctcccctacacagctgtcatgagcttgaagttctaaaattagaaattcttttagcttaagtgttctcctctctccactattttttgggttttgttctttttttatttttttattttttttttgagacggaatctcactctgtctcccaggctggagtacagtagcgtgatctcggctcactgcaacccccacctcccaggttcaaacaattctcctgcctcagcctcccgagtagctgggactacaggtgcacaccaccacgcccagctaattttttgtattttagtagagacggggtttcaccgtgttgcccaggctggtctcgaactcctgagctcaggcaatgcacctgctcggcctcccaaagtgctgggattacaggcgtgagccactgcacctggccctggtttttgtccttaacaacacagatattttcagaaaggaaaactcaacctcagcgttaatggttgattcattggtgttaattggttcttccatgagagaggtgattcagggcattgggaccagccgcaggcttgcagaagtcacttgcccgtcagtgccgcattctcatggtatgtcaggagcgcagcttggtttacctgggccctgtgaatcagggcttccctcataacgtgtctcacgaagaaagagaaccctggaaagcacagaaggacagcggggtcactcagagctgccaggagcgctagcaggtgcactctggctaatgcccgggccccccacggagcagaaggccacatgcattctggcctcctaatcttcactttaatgctattaaaaatactaaaagctctgtctcttccaccgttgagccaagattaccccggcactctgagagcaaaaaatagggtagggaaattatcaaaagtataagaaatctactggtttgctaatggttccttttgattctagattttctattctatatgatgcttgagcttatgatccattcttccagaaatattattctacatattttcttctgtactctactatattgtcacatatattcaagtctaatatctatgcataacactattcacatctgtctggaatcttgtgttaagaaagtccctgaattctgtgtttctttagatctgcattctttataagcctgcctacaaactcagaaagtagccactaaagtaaaaaggctagaatatgaaatatacacagccttgggctggtaacatattgcaaatatgcctttatctatctcatgatcacatcatggctcagaagagccatttgagccacagaagatgtaggcttttccctaagggtgaaatgagtatagaaacaggtctaatagctgcaacagcaaagtgacactgggtggaaaacttgggaaggtcatattctgtgtgtgtctgataaggatccccttagtttttttttttgaaatgtagtctggctctgttgcccaagctggagtgcagtggcacgatcttggctcactgcaagctctgcctcctgggttcaagcgattctcctgtttcagcctcccaagtagctgggattacaggtgccaaccactgcgctcggctaatttttgtatttttagtagagatggggtttcaccgtgttggccaggctggtctcgaactcctgacctcaagtgatcctcccgcctcggcctcccaaagtgctgggattacaggcgtgagccactgcacccagccttggatccccttaattctttcacaacactatttatgttgccttctagcatctactcaatttatggtttcttttgattaggccagaggtcgcagtcagtgtctacttcttccctgaggcctctgctgcctgtttcgaaatgccatttcctatgcttgtccccagtggccacccaagatggggcgatggtgtgtgttcattcatctctccatccatctgtccagtcaatacctagagagtgcccagcacctgtgggcattctgctcagctagggggagaatggggagggaggcaggcgaggggagatggcagtgaagtatgcctgaggaggaggggtgcgtgacaggtgtgaagggtgctggggaggtagcacctggggcccctcagccagctcagggcgggcagagatctgaaggctgaggcatggggggccaggcggaggggtgtggatgggaggggatggcctcagggaagggctgcaggccacatgtggacctgaaaagagctcaaccaggcccacagaaggaagaggaaaggggaagaagaagtcaggaaaaatcacaataagagaactggagtgtgctcttcttcaggacacacacagtgtgggaaatgtcacattttctatttttccacgttagaagaaatccagccggagtgccccattgtaatggcctgtgaggagtgtgcagacaggatttttgaaggtcttttctccctatttagactacatgaaccccccacgagcttgcgagggcaggctggccacagccccattggaaggcagacgtctcatgggtggctcctctccctctgagccatactcagtccgagggaccttcccaagttttctgagcgtgcccagagcttagggctcccaagcccatcccagtccagcccctcaggggaatcaggtccctctctgctgcgctcaggccctcaccacatccctgctactttagctggggctgtgacctccttctcttgggcaatgcgctaattcctggtgaggcctagatcttccaggtccataagcttaagggatgctgtcgacaagtttctctctcacatccctctctgtctctctctctctctctctctctcacacacacacacacacacacacacacacacacacacacacacacttgctcctgcctggggcaaggacagccgaaaccattcattagtcacatgaagctggcctcattctctggagggtgtggcggggggtgcggtggtggggggacggggagggtaatggggacagaacagagtaggatagaggggcaatggatttcctccctattgagtctttgccagaaaaacatgcaaaattcaagaaggttatcaacgtagtctcacaaattcacctccaccaatgtcatgcacctgctgctttttggcaagacgctgtgctctacgaactctacaatctccaaatagtttcactcaatcttacagcaattttatgaagacaggtactacatcatgcccccatttcacagatgaggagactgagacccagagaggttaagcaactggcctgcgcacacgctgagagggtgggcccctaccccaggtgtcattggctggacgcaggcctgcttgaccttgactgcccattacaatcacctgcagctttgtccccatgcccaggccaatgatgtcagaatccctgggggtgtggcctgaacatctgcatttctacagctcctcgggcaattccgaggtacagcccaggctgagccccaccggtctagagtctctgcttaccggattgctgggttgggcagctgaaagcatcagtgcctcggacctggagtgtcgggcacatggaagtgcctcggacctggagtactggatagggagcaggactggagattggacgatgaagggctcggtttgggacgcacggagtgtgaggcttctttgggtcaccacagcagaagtattctcctggaaaatattcagagggcagtggaatgaagcttggggcccgggaggcaggcatcggctcccagacaccagctgaagccaaggtgacagtgagagcgtcaccttccctggggagtaagtacagcatccacgtctggacacacgggtctttagatcgcagagtgagccacacattctctgctgcctggacaggccctcccaggctgtcaaggccattggccctggccaggtacccctgcagggctacagaccgctctggagtgttagatgagctatttgggaagaaatggcaaaagagatgtgaaggggaaacagatgaagaagagcaaagtgccaagaataaggtgactgggagaggtggcactggctttttcccttcccctctgcctactctctcagagctagtagccctgagcggggcggcggcggcgggtgggggtggaaaacaaaaaggaggttcagtcatcaaatgctcaaagtggaggggcctcagagacacccaaggttagaattttgcccatgaaaaatccctgccacctggccttgtgcccctccccctgatcgctcgggcttgtcttcccagctggaggggtgtcgcgggtgggggaggagccctcgagtccgcaggcactcagtcctcgggatccccagcccacagaaagaatgtcttccctggcaggccaaggttttcaaggtgcactttcaaaagttggcttgttaaaaatgcaattgctctggggtggagtcctggaaactgcattcttgagtacttgagtactcaataaactacaaattctgtgccctcaccctcagacccacagagctgcagatactagtgagatcaggcctattcctttcgtgcattggggcagaaaggaagttaagcctccccggccagaggtctgaagctggcctgtttttagcctctggggacagggcatggccgtctctgcaagcatgtttcattcaactttactggcttttgaaaaattctggagaaaatactatgatttgccttaattgcagtttatcattcatcatcagaaaactaggagaatgaggtgggaggatcacttgagcccaggagttagagttgcagagagctatgactgcgccacagcactccagcctgtgcgacacagcgagaccaggtctctaaccaaaaaaggaaaatatatttgccatttgttttctgtagaaattcagttaggaactgggtttggttataagcacaagaccccctaaatactggcttattgatttaggagttttaactcacatggtaaaaaaaattaggggtagggagttataatacttaaggttatcaaggctaaggtctctgtagttttcttttttttttttttttttgagacagtgtctatcacccaggctggaatgcagtggtgtgatcatggctcactgcagccacagactcctaggctcaagcaatcctcctccctcagcctccccggtagctgggactatagacgtgagccacgagatggggtctccctatgttgccccaggctggtcttgaactcctgggctcaagtgatcctcccaaagcactgggattacaggcatgagccactgcactcagcctctgcagttctctcggccttacccacatggtgcaagatggttactgtcacaccaactatcagatgtgatctaggcaacaggaaaaaagaaggggcaagcaaaacctgaccagaaatcccagcaggcagtctttatgtctcactggtcagaagttatgtcacctgggcacttctaactgcaaaggaggctgggaaaggccctttattcagctggctacattgctgctcccaataaaaggagagctctttagtcaaaaagaaggggaggctgggtgtgatggctcacacctgtaatccctagtgccttgggaggccgaggcaggtggatcccttgagcccaggagttcaagaccagcctggggaacatggcaaaatcctgtctctacaaaaaatacaaaaattagctgggtgtggtggtgtgcacctgtggtcccagctactcagaaggctgaggtggcaggatcgcttgagcccaggaggcagaggttgcagtgggctgacatagcagcaccgcactgcagcctaggacagggcgagaccctgtctcaaaagaaaaaaaaaaggagaagaaggggagaatgaatgaatactgggttgaaaattggcagcctctgaccaggtaactcgacactgtgcctgccactgcaggcaccacctcggctcactgaaacctctgcctcccgggttcaagcgattctcctgcctcagcctcccgagtagctgggattacaggcatgagtcaccgtgcccagcctcaacaccgtttttactgtgaggggacatacagacgagaggaagggggagacaatcaacacagaagaaccacctttgggtactaccactgggaaaaagcagttccttttagctgtttctcactcaacagtcccccaagcacatttcacccattttttttttcattagactggtgagaaaactgcaatttacaagtaggaagtcattctctatatctcaatatgtcatcgcccttcttgcgtctcactgtggttttgtccctataattggcatgatctgctgcccaaggacaacaagagacctgacgtcatgaggcaggatggctaaatctgtgttaatgggggaaataaagatgtatggcatttaaatatggtatttcactgtgcacctcttggtttttagatctctaagttggtggaggaggtgaagtatttctcaaaattccacacaccccttgtgaagttgccatagagccacttccctctgcttttacaaaggctgttgagtctctatggcaattcctttacttcatccttcattcctttcttgcgtgagtagtgaaccgttgaagacacagctgtacccattgtgaaccacagagacaggtaaagccttctccgtctccgaagcgcaaagcagatgggtttgttttgttatttcagtcacctggtgcttgttgagtattgagatatgtgtgaatgtgaattctttttcctttcccagaatgcccatatcacaagcctctgggtttcgagtcaggggaggtcacaccggaccagatcacctgctctaacccggagcagtatgtgggctggtattcttcgtggactgcaaacaaggcccggctcaacagtcaaggctttgggtaagcagggcccggggattttttttcatgtgcttttaaaaaaaaataggcctctctaccagcgtggccaacacagtgaaaccccgtctctactaaaaatacaaaaaattaactggcgtggtggcacgtgcctgtaatcccagctactcaggaggctgaggcaggagaattgcttgaacctgggaagcggaggttacagtgagccgagatcacaccactgcactacagcctgggcgacagagtgagaccctgtctcaaaaatgaaaaaaaatataggcctctctaataaacaaatgacacagaatgtacttatgagtgctgggggagagatgaaggaagaaagacctcatccatgcagccagggaaggctttctaaggaaaacatatttgacctgtggcttgaagttggccaggtgagggaggggaagaggcgtggggtacagcaggtgcaaaagccctgagtcgggatgatacctccagggtgtggatggggaacataagcagggcagcaagcctgaagcacaagtgagacaaggtggagaggcaagcggaggtcagatggtgcaggaccttagaagccacgttaatgactgtggtccgtactgtagggataatgggaggaccctgagtgcgtattagttagcatacatgttcatgctgttgtaacaaagagcaccaaagtacagtgacttaatgtagaagtgtgtttcttgctcacttaaaagttccattcatcagccaggcacagtggcttacgcctgtaatcctagcactttgggaggccgagggggggcagattacctgaggtcaggagttcaagaccagcttagccaacatggtgaaacctcatctctactaaaaatacaaaaattagccgggcatggtggcaggtggctataatcccagctacttaggaggctgaggcaggagaatcacttgaacctgggaggcggaggttgcagtgagccgagattgtgtgccactgcacaccagcctgggcgacagagcaagactctgtctcagaaaggaaaaaaaaaagtttcattcagtagtctagggtcgttatggcagcttgatggcatgcggggcccagactctaccttgttgttctgtcgtccttaacatgaagcgtctatcttggggtccagaatggtgtctctgtcttctgccatcacatccaccgtctagttagtggggagaaacaaaagagcagcagagtgcgcatgacttgcctttaagaacacaaacatattctattggccacttctgcccacatcccattgaccagagtttggttagggggccccatctagttgcaagggagactaggaaatgccatcttagccagatggccatttgcccagatgaaactcaggggttctattaccaaatgaggatgggaagggagtatcgggtgataattagcagactctgccggataaatattttaagtcgaagagtatcgcaagcacatttgtgttttaagaaaagttctctggttcctgtggggccagagcaatccagggagagtagttgaggtgtgggaagaaagagggggacacgggctagagtggtggcggtggagaccgacagaagtagaagaatttgaggcacttggagatggagccaatagatagattgggcactggaggtggagaggaggggcccaggatggttctcaggtggccggcatggacacatgcaaggatggggttaactcagagacgtggggtctgaaagcagggtggggtgggggcacttaggggctcacattgggacgtgtttcatctgagatgctgagaggcatacagaagtcctctagctggcaactgaactctctggatttggggtttagaaaaggtgtgggatagaagtgaaaagtcaggagccacccaaggaataagtctggaaaaggaagagaaggtggcccagggcttaagtcctacaaagctaattaaaatacacactaaaaggaaaaaaggaggtggcggggggaactactataggtttccacgatttatgaggaatgtagctaaaaaaacaacttagttgcttcaacggttatctggcttgacacttgtcaaagcccttctagatccacatgggtcagtgctctgcacgaggcaggaatgtcaccaaccgagggaaacacaaataggtgtgaagagagtgaaatgcgcagaaaggttcaccctgggagtctcaagcagagggcaggggctggtggtctaacagccatgcacctgcgtgttttgcagacagacatgttcaaccactcccaaaggcaatttcagccacactctgaggcatttctttgacaaattagtcgaatctggaaatcttttcttgggaggtggagatgcagggagagggagaatgagatgcaagttaagtataacggaagctggccattcctaggagacaaggctcagactgcagcccagactgcccgagcttggcagggggctctttggatgctggcatcccctcgagagccagcacctgcgggctttttgcagacatgcacagggggagtctctcggtgactcggtatgttctcggcaggtgtgcctggctctccaagttccaggacagtagccagtggttacagatagatctgaaggagatcaaagtgatttcagggatcctcacccaggggcgctgtgacatcgatgagtggatgaccaagtacagcgtgcagtacaggaccgatgagcgcctgaactggatttactacaaggaccagactggaaacaaccgggtaagttgggcttatcccaaaccaacttcagctcgcaccctctgggacttcccctcctgtccccgagctcctgtcactgccctctgtcagagcaccgactccacagcacagtggatcatctgcgctttcccccacaatgtgctgtgctctctttcctgggcttgctttggtgcccagcacagtttgtttgcaaatgaatgctattcttaagctcaaaaaaaaaatttgtctgagtttccatatcagcatgcagttgcctgaactcttaagactgaccatttggactatttcaactcactggatcattgaatgcactttgcttcacgggtatggtctgatgttattgatgtgggtagagaatcatccatttatatagatgtggcctctcctattgtttgagactgacagaggggagccttttgagaacctagcaagttacccattagccaaatggttaaaaggacttcaccagcacaaacacagacgaacttaaacctttgggcaactctacatcctattaatctttgtggattgagacagaagtcttcttcaccattgactaaacgcagtagactcctgactatatatatatatatatatttgctatgaataaaaatgaattaaaaactccctagctctttggaaatggtaaacatccttttgcctaagagtaaggagttccccaggctaatttcaacatttaatcaggttaagtagacatgtacagctgagattcagaaggctttgtaagtctctgatgacaatttgtacggccaagacgttcatgggttgttccaaggagtttgaacacaagaggaaaaaccatcttgatacttggacatttaatttcatttttattcttattagctggcctcttcaaaagacatgagaagtttttcaagccctgtgcttctgaaggccttgaaggttctttgcaaagaggcacttcacccctgcacttgtgcaatctggtggagcctgttccaccctcccctctcttcacctggctcctgacttgaataggctcaaagacaaactgcaatagagagggtggtgtggggcggtgccactgcggagaaaggcaagaacatggcagaccaggcccttcccgttttgtggatggatggggccaaatgcaacagccagatattttcaggagataatcccagaaggagatgaaatgtcctagtggcatcaggcagagcaccatgactttggtaagagggcaaagaatgatttctttggaaatggcgtcaaacacccacagcatgtttttatgttacatccttaaaaacactaagcaaaccccctttctctttactctggcaccaccctcccctttccagaatcttccttcgagtttttatgtctttttgttttgttttgagatggagtctcactctgttgcccaggctggagtgcaacggtgtgatctcagctcactgtaacctccgcctcccgggttcaagtaattctcctgcctccgcctccagagtagctgggatttacaggcacctgccactgcgcctggctaatttttttgtatttttagtagagacggggtctcactgtgtgttggccaggctggtctcaaactcctgacctcaaacgatccgcccgcctccgcctcccaaagtgctgggattacaggcgtgagccactgcgcctggccaagtttttatgtctttttaaaaaaacattttccaagttggaaaggtactcatcacttgtatcaaagtaggaatacacatttaagttttggcttacaactcctgagccaagcacgggttttcacttgagccctactttggatacctttggaacatgtaagtgtgatgtgggccttttcaaaatgtcaaaatgcaaaggataaaaactcaaaagcgatgagtcaagtggcattttctagcagcaccctccaatagaactttctgtgatggaaatgttcacatctgcactgtccaatatggcggccacttgaaatgtggctcatgtgactgaggaactgaatttttatctaattttaattaattgaagtgtaaacagacatattggctagtggccaccctattggatggtgcagttccagatgtcccaagcatgtaggtgtgatgacaatcactcaaggtcagattttggggggcacccgcaaactgctttaactacttcctaatcatttctatagttaaaagttggggctagctccagaaaggaacccttcttccttttccctccccgatgtgatggtgacaggatttcctctatctctctaggtcttctatggcaactcggaccgcacctccacggttcagaacctgctgcggccccccatcatctcccgcttcatccgcctcatcccgctgggctggcacgtccgcattgccatccggatggagctgctggagtgcgtcagcaagtgtgcctgatgcctgcctcagctcggcgcctgccagggggtgactggcacagagcgggccgtaggggaccccctcacacaccaccgagatggacagggctatatttcgcaaagcaattgtaactgcagtgctgggtagataatttttttttttttaagatatagctttctgatttcaatgaaataaaaatgaacttattccccactcagggccagagaaagtcagaacaaagaaaatgtccccgaaacgaattttcttacaaaagcctaagtagcaggggtaattttctgctcattttttgtctcagtgatactgtgaaaggtgcagtctcaggggaacacaaagcagccctgataatttgaaaattcatttgctttaccacattcaagacagaaacatacagtttcctaaagcctggctttgaatgcagaagggagcagctcctcctagttaagtttccactaaatcatcgccaaagaggacttcagagccctggggaggcagctgagggtctcaagggtgactgggtggcagggatgagtgcggtgggtgagaatcccggtgccctgagaggctatacgtgacaaatgaccaaaagcccaaggtaggggagtttcctctgctcacagttcttaccttcaaggcggatctgggcttccaccctcatgaacacagggattggggagggaccagagcgcccaatacacacagctccattatgcaatccattccagcaaattccccgtgtctgtggtcaccatttaggtgatcatacaggacaggctgcacatctcagtatatgtagggaccccaaatgaccacaacacagtacaattgccctttacctagggctaccatttcctagcaaaccaaacatagttcgagaacagctggcccaggagctaccactggctactcagaggaggctcattagctggctacatgcttcgcaggaagtgggaaggactcacatcataaaaaggaccatgtagctttttccctgaaagcttctcaccctccaccctctgccttgcaatacgcaaactgcgcctgctcctgaaaagctctctgggaaggaatgggcctggctttccgttcctggaggcggcgccttagattgggaggcctcattggccacttagagcgcagcctgagtttccaggccccttcctgggagaggctgttaacacgggggaggggcaggagagggatatggagagcaggtggtggaatcagaggacgaggctgctctaaagactgttctggccccagacacagggtagtctttgctagcagctcatttccgagttacttttcattttcaaatgccaaggcaagtgactagactcgcgctaatacagtgctggacaacacattcaccttttctgtgaacaggcagccttctaaaagccccaaacatccttcttgatgctttgggggctcaattattttatatccaacccagcatctttctagtccctatgctgtatgcttgaacttcggaaaatgcttttccccgcccaatcttctctcaaatataaacacatcacacagggtgttgggggtggggggggggggtggggggacttatccctggccttaggacacaggacaaatctattttggatagaaatgcctgaacagagacccttatttggaaaggtgaattaactttggtcacgacatggactgtcagacaaaatggcagtatcctaagagttaaggcacatcaaacacaggagtcgagagagtgcagttcagggaaaaaggagaggaggaaacagtgaggcagggagaaaggctttccaaataagagttcatgttggaaacttttgtcacggctttattgagattaagttcacatacaatttgtatccatttaaagtgtacaatttgatgacttttggtatattcagagttgtgcaaccattatcactagatcaattttagaaagtttatcaccccaaagagaaatcctgcacccatcagccaacactccccaacccatcggccaccccaagccctctgcaaccacgaatcgactgtctctgtagattggccttctggacgttctacataaatgaaatcatatagtatgtggtatttcgtgactggcttctttcacttagcatagtgttttaaagttcatccacgttataacatgtgtatcactatgtcacttgtcactcctttttattgctgaacatcattgttcagtatcatgtcaagagcacattgttatttatccattcatccattgatggatatttgggtttccactctttagctattatgaataatgctgctatgaacatttgtgtataagtttttgtgcggatgtgtgttttcatttatcttgggtatatacttaggagtaaaactgctgggacacacagtcactcttgtttaatctttggaggaactattatcccaagtggctgcatcattttacatttccaccagcaatgtaggaggcttccactttctccacatcctcagcaacacttgttactgtccatctttgactatacccataatgtgtgaagttgcatctcaactgtggttttgatttgcatttccctagtgactaatgatgttgagcatcttttcatgtgtttactggccatttgtacatctttggataaaggtttttcagatcctctgcccattttaaatcggcttacaacttactgagtttaagaattctttgtatattctaattcccttattggatatgatttgcaaatattttctcccattctgtggatctttttaaccctctcgatagagtcctcttaagcacaaaattttaaatatttgatgaagtccaatttatttttctctttgcttgtgcctttggtgtcatatctgagaaaccactgccaaatccaaggtcatgaagatttacccctatgttttcttctatgagttttatagttctacctcttacagttagatctttgttccattttgagttaatttttgtatatggtgtgaaataggagtccaacgtcattcttttgcatgtggatatccagttgtcccaccactatttgctgaaaagactattctttcccccattgaatgatcttggcacccttgtcaaaaaacaattgaccataaatgtgagagggtttatttctggactccaaattctattacctcactttcttcattattgtagctttgtagtaagttttgaaattggggcatgtgagtcctccaactttgctcttcgggattgttttggctattctgggttccttgaatttccatatgaattataactaacttgtccatcattgcaaagaagccagctgggatttcacattggaaactgctcaatacttcagaatttaataaacagtaagatatacgattcataagacatttatctgcagataatttgcttacaacagcatattatttacttcattcaattcatgacagaatgtataaaaactaaaacttttattgagggaaatctgaagcctaatagaatcttgctgtcaaacacacaaactatgcttccaagtatcatttcttttgtgggggaaactttcaattaaaaattatacatagtgtaggaaaaactcactcttaccttattttaacatatttacttttatttttagaaatgctagagcacggtctacactggagtttgtttaaaaattgcggtaaaatatacacaacatttgcagatttttaaataattaaatgaaatgttacgaacaaagaagtagcattaagtgttgccaatattaaggaaaaaaaatctgagctgattcgggtactctgtgtgggaggaggttacttggacaaagcaaaggtatttccagatagagatgctgctgtgaatccattctcagagcccagaagattgcacccctaaagtgacccttggaatggatgctcacagaaccccatctttctgtccacttggggcttggttgctaaggcccactgacaaacagcttacaaggactgttgcttcccctgtggtcccaagagtacttccatgctgggtcattcttaagcccaaccttacagggctgatacgaagatcaaataggctacgtgcatctaaagggct

SEQ ID NO: 12970 - DNA, 32068 bp, Human
caaaaagaaacctggttctatattttgtttaaatttatttttttaaccatcatgtaatatgtccaggtaatttgtttaaattttgacatcaaatgcaattgtgagaatttttatgattcagaaaaatctaagcaagctttataaaaacatacttttttttttacttttttttttttttctgagacacagcctcactctgtcgcccaggctggagtgcaggttttcatgtttatctgtgagatgtacctttggcacattactttcctgacatgagatttaaatttttttttttatcttgtgacaatttaacttttttgacacataaaaattgtacatatttatttgtttgagatggagtcgcactctgtcactcaggctggagtgcagtggcgtgatcttggctcactgcaacctccgcctcccgagttcaagtgattctcctggctcagcctcccaagcagctgtcattacaggcctgcaccaccacacccggctgatttttgtatttttaggagaaacagggtttcaccatgttggccaggctggtcttgaagtcctgacctcaagtgatccacccaccttggcctcccaaagtgctgggattataggcatgagccaccgtaccagacccctaaaaattgtatatatttaaggtgtaccatttgatgtttagatatacattgtgaaatgattacattccacatattacctctacagagttaccatttttgtacacttggtcaacatcatcccattctccccttcctccacagatatttcttgtatactatatagaagccaagggtattttgggggaagagctcaaagttcctttcgtggagttaaaaatatatatatactatgtacatataagccatttagcaaccctagatgcttaataaagaatactggaggcccggtgtggtggctcacacctgtaatcccagcactttgggaggccgaggcggtcggattacgaggtcaggagttcaagaccagcctggccaacatggtgaaaccccatctttactaaaaatacaaaaattagccgggtgtggtggtgggcgcctgtaatcccagctactcggggggctgaggcagaattgcttgaacctgggaggcagaggttgcagtgagctgagatcacgccactgcattccagcctgggtgacagagcaatactctgtcgcaaaaaaaaaaaagaatactggaggctgggcgaggtggctcacacctgtaatcccagcattttgggatgccagaggcgggcggaatatcttgagctcaggagttcgagaccagcctacacaatatgctccaaacgccgcctctacaaaacatacagaaactagccgggtgtggtggcgtgcccctgtggtcctagctacttgggaggttgaggcgggaggatcgcttgagctcgggaggtcgaggctgcaatgagccgagatggtgccactgcactctgacgacagagcgagactccgtctcaaaacaaacaacaaataaggttgggggatcaaatatcttctagtgtttaaggatctgccttccttcctgcccccatgtttgtctttccttgtttgtctttatatagatcaagcaggttttaaattcctagtaggagcttacatttacttttccaagggggagggggaataaatatctacacacacacacacacacacacacacacacacacacacacactggagttcgagacgaggcctaagcaacatgccgaaaccccgtctctactaaatacaaaaaatagctgagcttggtggcgcacgcctatagtcctagctactggggaggctgaggtgggaggatcgcttgagcccaagaagtcgaggctgcagtgagccgagatcgcgccgctgcactccagcctgagcgacagggcgaggctctgtctcaaaacaaacaaacaaaaaaaaaaggaaaggaaatataacacagtgaaatgaaaggattgagagaaatgaaaaatatacacgccacaaatgtgggagggcgataaccactcgtagaaagcgtgagaagttactacaagcggtcctcccggccaccgtactgttccgctcccagaagccccgggcggcggaagtcgtcactcttaagaagggacggggccccacgctgcgcacccgcgggtttgctatggcgatgagcagcggcggcagtggtggcggcgtcccggagcaggaggattccgtgctgttccggcgcggcacaggccaggtgaggtcgcagccagtgcagtctccctattagcgctctcagcacccttcttccggcccaactctccttccgcagcctcgggacagcatcaagtcgatccgctcactggagttgtggtccgcgtttttctacgtcttttcccactccgttccctgcgaaccacatccgcaagctccttcctcgagcagtttgggctccttgatagcgttgagtggaggccctgccgcgacttggcagtagcttattttgttcactcctctctggctggtgtgggggaggtgggggcattaggccagggtgaagcaggggaaccacttaggagtctgttaagatgatctgaacttcagaacaagatgttattaacagagtgaaagtatttggattctgggtatattttgaaatcggaggcaacaggtttttcagatagattcgataacggaggttatcctgaatagttgaaaagataaagttgccttttgctgaggtgggaaagagaagattgccagtagagcaggtttctcaggagttcagtcttgggcatagcatggtaggggtgaatttggctggagtgagttggagagtaggagaagagaaatccaaggcaacatttgaccagcctgggcaacatagtgtgactccgagtctgcaaaaattagacgggtgttgtggtgcgcgtctgtggtctcagctacctggaaggttcaggccttggaaggctcagggaggtggaggctgcagtgatctgtgattgcgcctctgcactccagcctgggcgacagagccagaccctgtcttaaaacaaaataaacggccgggcgcggtggctcaagcctgtaatcccagcactttgggaggccgaggcggccggatcacaaggtcaggagatcgagaccatcctggctaacacggtgaaaccccgtctctactacaaatacaaaaaattagccgggcgtggtgacgggcgcctgtagtcccagctactcgggaggctgaggcaggagaatgtcatgaagccgggaggcggagcttgcagtgagccgagatcgcgccactgcactccagcctgggcgatagagcaagactccgtctcaaataaataaataaataaataaataaataataaaaacatcggtaggcatatttcaaggaattctatttaaaaaaaatttttttagagacaagttcgctctctgtggcccaggctggagtacagtggcatgatcctagcccatggcagcgttgatctcttggcctcaagcgaccctcctttggagtcgctgggcctaaaggagtgagccaccacgaaattttattataaatggagggtagagaaattgggcaataaatggagggggaagtgagttaagaggaattttaattatgtgtgtgtggttttaaaagaggggggtcttgctctgttgcccaggctgctggggtgccagtggcgcaatcatgaatcactacagccttggactcctggcctcaagctatcctcccacctctgcctcccaaagtactgggattactagtgtgagccactgcactaagataggagcaacatgtttcagcatgtttgtgggttgataggaaagatgagaatgggaaagttgatgtcggaaagaagacaatggctagagcaatgtcctagagtaggtaagaagggatggatttggcctttgttggaaacattagcggttcttttggtgacagctatatagttaacacatctatgatacgtgaatgggcagataggatggcaggagattttgaaagttctcttgattcttactgttctcttagtgaaagaagcaaggttatcagctagaagctgggatgggagaggaaagagaagatgggaagtagatagttctttagaagagtgggcaagggttggactagggaagtttagtggaaatattgctaggcaacataaagagcctacttgagattcgtggtcatgagttgaaggagaccagacagcaagattgtgtatgagggcacccacagagtaaatggagagttgaaattaatgcagttgtgattttaccacgtggatatgaagaagtgagggggagaagtacaaaggagttctcttaatgattgaccatggaatttaagctggctaagaaaggaagtgagaggccgggcgcggtggctcacgcctgtaatcccagcactttgggagactgaggtgggtggattacctgaggtcaggagtttgagaccaacctggccgatatggcgaaaccccatctctaataaaaatacagaaaaattagccgggaatggtggcaggtgcctgtaatcccagctactcaagaggctgtggcaggagtatcccttggacccaggaggtggaggttgcagtgagccgagatcacgccactgtactccagcctggacgatatagtgagacttcacctcaaaaaaaaaaaaaaagaaaggaagtgaggattttaagaccctgagagacagtttaaaaagtgggaggatcggccgggcgctgtggctgacacctgtaatcccagcactttgggaggccgagttgggcagatcacaaggtcaggagttcgagaccagcctggccaatatggtgaaaccttgtctctactaaaaatacaaaaattagccgggcatggtgtcacgtgtctataatcccagctactcgggaggctgaggcagaaaaattgcttgaacctgggaggcagaggttgcagacagctgagatcactccattgcactccagcctgggcaacaagagcaaaactttgtctttaaaaaaaaaaaaaaaaaaagaatacaaaaattagccgggcgtggtggcgcgtgcctataatcccagctacttgggaggctgaggcaggagaatcagttgaacacgggaggcgaggtttgcagtgagccgagattgcgccactgcactccagcctgggcgacagagcaggactcctcttggaaaaaaaaaattagctgggcatggtggcaggtgcctgtagtctcagctactagggaggctgaggcaggaaaatcacttgaacccgggatgtggagtttgcagtgacccgagatcgtgccactgtactccatcctgggcgacaaaatgagactctgcctcaaaaaaaaaaaaaaaaaaaagtgggaggatcaatgtactgccagtcctaatgaagtggaatgattgtccccatcaaatcactagtaggagtaagttgcagagcctagaaggtgatggttaagagagtgggattcttgaaactgcatttatggagaggttgtggttattggttataataaataaatacagttgaagtgagtgagtagctgagatttggggatgtatcagttcattcttacactgctacaaagacatacctgagaccaggtatttataaagataagaggtttaatcagctcacagttctgctgcctgtacaggcttctcttgtggaggcctaaggaaacttacagtcatggtggaaggtgaaggggaaacaagcacagtcttcacatggccagcaggagagagagagaagggggaagtgctacatactttaaaacaaccagatcttgtgagaacgcttatcaggaaacagcacttggggatggtgctaaatcattagaaatcacccccatgatccagtcgcctcctaccatgcccacctccaacactggggatcacaattcagcatgagatttgggtaggaacacagagctgcaccacatcagaggatgtacaagattgtggtggagaggagtttagagacctgcaaatatagggtaattgaagggatcatctacatggatatttaaatcaccaaaaattatgacaggagtagtgttggagagagaactgcgatgtaaacattaaggaatgaggaagagtgactcggtaggctgtaggtgactgcaataggaaacgataatagactgtgagtctggtgacaagattttccttctttctttttttccccccccccgagacagggcctctttttgttgcccaggtgggagtgcagtggcgcgatcacggctcactacaacctcctcccaagctcaagggattctcccacttcagcctctcaagtagctggaactacaggtgctgaccaccatgcctggctactttttgtcaggattttcaaggctgggaattttgagaggggaatggaggagaataatctgaaagtgcaagtaaggagcagggaagatttcttttttctttttttttttttttttgagtcggagtctggctcagtcgcccaggctggagtgcagtggcgagatctccgctcactgcaagctccgcctcccgtgttcacgccattctcctccttcagcctcccgagtagctgggactacaggcgcccgccaccacgcccagctaattgtttttttgtatttttagtagagacggggtttcaccgtgttagccaggatggtctcaatctcctgactttgtgatccgcccaccccggcctcccaaagcgcttgggattacaggcgtgagccaccgcgccagccagagcagggaagatttcttccccacatctccagtaggtacagtgatatgaagtgtgtggaggagaaaagaggaaacatctatcatttgagatggctgcgaaaggaaaaggcatcctcagggagctagattttacttagagcaagaaatgaagggatgattcagaggttaaagagtggattttatgaattactcaagggagcacagtggaagtttcaggaagtggtaggagaaggtagaagatggcagggtgttgggaataatttgagaaatctgagctactggaaatgactgagaatcagatataaaggcagtcctggtggtccgttctggctgccgttgctgtgtaacgaatctgccaaaacttagtggcttgaaacaacaaagaacattttattatctctcattgtttctgtgggttaggaatttgtgagagccgtgctgggcagttttcgtgcggctgtctcgtggttgcacctacatagttgctagagctacagtagctggggactgagcagctagggattggcaggctatctctttttttcatgtagtctcatgaagatttctttatgtggtttcaatgtgtgggctggtttggatttccttatagcatggtggcctcagttggattgctgttttgtgatccttttcatccctccttgtcctgtccccagacaaccactgatctactttctgtcaccatagattagcctgcatttttaagaatttttataaacgtggaatgatagagtaccttttttgtcacgtttcttttatttatcatagctattttgattttcatccattttattgctgagtagtatcccattgcatgtatatactatactgtattcattcgcttgcttgtgaacatttgggctttttccagtttgggactgttaacaagtagagccactatgaatattagtgtataagacttcatatagccaaggctggcagatcgcttgagcccaggagtttgagaccagcctgggaaacatggtgaaacctctatttttattttaaaatcaaaaattaaaaattttctataaaaaattttaaagaagactttgtatagacatacgctttcatttttcttgagtgaatacttaggtctcagggtagatgtattttaagtctttaaggagctgtcaaactcttcctcaaagtggtggttgtaccatgttactttttaatataacagagattaattgagcaaagaaaaattcaaaagttggacagcccccacaactaaataggttcagaacagctcccccattttgcattttgaccagcaatgtatgaaagttccatttgctcagtgtccctgcaaacacctggtatggtcagtctttttaattttaggcattataatagatatagtggcttcttgtgattttaattagcatttcctaatgaccagtgctgctgttgatcatttcatgagtgtatttgccatccgtatatcttttttggtgaagtgtctattcaaatcatttgggttttttttttgtttgttttttttttttggagacagtgtctcactctgtcacccaggctgttgtgcagtggtgcaatcacacagcctactgcagcctccacctcctgcgctcagtcttcttgtctcagccttctgagtagctgaaattacgagcacacgccacaatgcctggctaattttttaaaattttgtagaaacaaggtctcattatgttgcctgggcttgtcgtgaactcctgggctcaagcaatcttcctgcctcagcctcccaaagattgggattgcaagtatgagccactgcacccggccaacttacccatcttttaattgaatttttttgttgttgaggtttgagagttcttcatgtttgctgggtacaatatctttatcagataggtaacttgcatgtattttctcccggtttacactttggtttttcattttgttaacaacgtctttttaagaacagaaaatcttaattttgctgaaatctaatttttcagttttttctttgatggttttgagagaggaggtaaaaaaagactaggtaagccgatagttagacagagtcctcggtagaacttcccttctaacaaaaagcagcccaagaaatcacttctcttctaacaaggagcagcctggaagatcgggctgtaaacatgtataaggaagcagctctggcacagagggggagcttcctgggtaatcagcaagcttcacatacgtaaggtgggtatgtgaagtaaacacagtatgtgaagtaaacacagtggaccttagtacatactcagataaggaagctggaagcttgcatgttgtgagttgttggggttgcctgcagctgcacggagagaaaggggtacctggggccaggcatgtccaccatggtggctccacctccccttatttagcacatgcacaataggaaagagataagcaatgtggagtagctcaggccaaggacctgcctgcataataaaaggttggggtgggggatgccagagattcacgctctgtgcagatggcaacacctggtcctaactggttttttgctccctatgtgtagataagctacccccttcccattagctcatttataaaaatgcttgcatttcactgtggaatgggaactcttttcaggacctctctctgcaggagagagctagtctctttcttttgcctattaaacttctgctctagcctcacacccttggtgtgtcagcgtccttgatttcctcagcgtgagaccaagaacctcgggtgccaccccaggcaacaaggccatttcagtttgttcttttgttataggcaatccatgatcacagatttttctctcttttttttttttacacagtttagagttttagttttacacttaggtctgtaatccattttgtattaattcttatatgtggctcagtgtaggtggaaatttggtttgtttttgcataaggatttccaatagttttaccaccatttcttgaaactactatgctttctctattaaaccacatttgtaactttagttaaaatcagtcacatatatcacagggctatttctgactctcaattctgttacattgtctattagtgtatattgatgtcagtactacacttttaattactattgcttcagggtatgtcttgtaaaccaaaaataaaattataggccccccccgcccctgcacaaccaactgaatggacccatcctctcagccaagggcattccaaaattaacctgaaaaactagttcaagccatgatgggaagggggagttggacatgtctcatcacaccctactaccttttggaattactgatagaacagactcttaaagtctgaaaagaaacatttacaacctaccctctctgaagcctgctacctgggagcttcatctgcatgataaaaccttggtctccacaaccccttatggtaacccaaacattcctttctgttgataataactctttcaactagttgccaattagaaaatctttaaatcttcctatgacctagaaacctccctacccccactttgagttgtcctgcctttcctgacagaactcatgtacatcttacatatattgattgatgcctcatgtctccctaaaatgtataaaacaaagctgtaccccaccaccttggggacatgtcatcaggacctcctgtggctgtgtcataggagcgtctttaactttggcaaaataaactttctaaattgattgaaacctgtcttagctacttctggtttacagtcttaaagttagataatgtaaattgtccagctttggtttatttttgtccttagtagttccatataaattttagaatcagcttttcaatttaatacactactttcctcttagatccacaattaaatatatttgatgctaacaattctgttttatgtttttcgttttttttttttgagacaagagtttcgctcttgttgcccaggctggagtgcagtggcgcgatcttggctcaccacaacctccacctcccaggttcaagcaattcttctgcctcagcctcccgagtagctgggattacaggcatgcgccaccacgcccggctaattttgtatttttagtagagacggggtttcaccatgttgatcaggctggtcttgaactcctgacctcaggtgatccacccacctcggcctcccaaagtgttgggattacaggcgtgaaccaccatgcctggccagttctgttatttttaaaacccaagtttccctggtcatatcttggttggatgaagcgtattttcaatagattaccctggaaaggctagtgagtacggtattcttctacattttagacttttcttagtcttgctacttcaaggacagctaggctgcatataaaattcttggctcatactttttccccataaatttctatgagaaagtctaatgataactgattttctttattttgtaacttagtctttttgcttagaggctctctgaggatgggagggggttcttcctcccatccctaggaatttttcttttttttaaattcctaatcactagaccaccaggaagattgtttgttttgttttgtttttattcttcagggaccccatttatacatacgttaaataaatactgtttgccaatgtatcaaccattttgcttcttatttatttttgttcctttggttctttttcatggctttgctttggtgctccttagattttcagtcagatgtatttgtccttgggtaccttgtaatcagtattaccttttcttctgtcgctttgttttctgttcgttttgaaattacttgtttcctggtctggcaataacagttgagatatgaggagtttgagctgccatctgtctgtgtatcttgctttaagactgcactcttctattgatatcactggccttgattttgtgatttctttatttcttcaggaccacccttcattttctactgtttgcttcctttttttttgagatggagtctcactctgtcactcaggctggagtgcagtgatcttggctcattgcaacctctgcctcccgggttccagcaattctcctgcctcagcctcccaagtatctgggactacaggtgtgcaccaccatgcccggctaagttttgtatttttaatagagacggggttttgccacattggcaggctggtctcaaactcctgatgtcaagtgatccacccaccccacccacctctgcatcccaaagtgctgggattacaggaatgagctgccgtgcccagcctcccccctacccccctttttttctttcgagacagagattataggtgtgagccactggacccagcctgtttttattccttttaccaaatctccaaggaatatcttcccttccaagtgcgaatgtaaccttaagtcagttaacctctttgtgattacttttcttatctgcaaagtgacttaatgatcttaagtactttttttttttgagacagggtctcactgtcaccctggctggagtgcagtggcacgatctctgatctccactcactgcaatctcctcttccctggttcaagcggccctcccaccttagccttctgggtagctgggactacagatgtgaaccaccacgcccagctaatttttgtactttttgtagagatggggttttgccatgttgcccaggctgggattattaagtactttttatcatacagcaagattgacattttatattggaatacatttgtctctatataacggagattaacaggaaaatgacaagcctgggtgcggtggctcatgcctgtaatcccagcactttgggaggctgaggtgggaggatcacttgaggtcaggagttcgagaccagttttgccaagatgatgaaagcccatgtctactaaaaatacaaaaattagcccagcttgatggtgggcgcctataatcccagctatttgagagactgaggcaggagaatcacttgaacctgggcggcagaggttgcagtgagccgagatcatgccactgcactccagcctgggtggcatagcgagactcttgtctcaagagaaaacaaaacaaaacaaaaaaaaaacaggaaaatgacaaaaagtaatattacaactcagtgaattttataacaaacttttttggaattcattgactaatactataccaaatccaaaatactctctagtataccaaatccaactctaccctatagtataaattggattctatttggacttgtctcactaatccctcatacagtgtgttttattttttattgaagtaaaaaaatttgtcattttaaccatttttaagtatatagttcagtaatattaagtatgttcatgttgttgcgcaatagatcttcggaagtttttcgtcttgcaacctgaaactctacccattagcaaattcccatttctccttacacttagcccttggtaatcatcattcttttttttttttttttttttttgagatggagttttactcttgttgcccaggctggagtgcaatggtgcaatctcgactcaccacaacctccgcctcccaggttcaagcaattctacctcagcctcccgagtagctgggattacagtcatgcaccaccacgcccggctaattttgtatttttagtagagaaggggtttctccatgttgaggctggtctcgaactcctgacctcaggtgatctgcccacctcggcctcccaaagtgctgggattacaggcgtgagccactgcgcctggcccattctttctaattctataaatttgactacttagttaccttacataaataaattcttatagttagtgttatttttgcttccatgccttttttgttgttgttcatgctcttacttggaatgcgttctattttgtctacctatgcacatcctgttgggttttttttttttttggggggttttttttgtttttttttgtttttttttcccagacaaggtctcaatttgttacccaggctggagtgcagcggcgccatctccactcactgcatcctcaacttcctgggcccaggtgatcctctcgcctcagcccctgcaggtagctgggactataggcatgtgccaccatgcccagctaaatttggtttttttgtttgtttgtttttgagacagagtctcactgtgtcacccaggctggagtgcagtggcacaatctcagctcactgcaatctctgccgcccgggttcaagtgattctcctgcctcagcctcccaagcagctgggattacaggtgactgccaccacgccagctaagttttgtagttttagtagagatggggtttcaccttgttggccatgctggtctcgaactcctgacctcgtgatctgcctgcttctgcctcccaaagtgctggaattacaggcatgagccaccacgcccggccagaatttttgtatttttagtagacacaaggttcttaccctgttgcctaggctggtctggaagtcctggactcaagcaattcacctgccttggcctcccaaaatgctgggattacaagccaccatgcccggcctaaatcctgttgttttgttttgttttattttgttttgttttgttttgtttgttttttgagacagagtctcgctatgtctctcaggctgtagtgcagtggcgcgatcttggctcactgccacctctgcctcccaggttcaagtgattctcctgcctcagcctcccaagtagctgggattacaggcatgtgctactatgtccggctaatttttgtatttttagtagagacagggtttcaccatgttggccaggctggtctcgaactcctgacctcgtgatccacccacctcggccacccaaagtgctgggattacaggcgtgagtggtttttatttcttaggccggtttcctccatatgatcttgcagtagacattaatttctttcctttttaattaaaatactgtttgtatttcacattttgatgtttgttaagatttgttttatattgttttttgttttgtcttgtgtgatagtcttaaatccctagttagataataactggagagtaccatgtttctatatatctctcagtgacttgcacagtgctagcagatagtgctaaaaaattatttattattattattattttgttattgttgttgttgttgttagacagggtcttcctctgtcacccaggctagagggcaatgggatgatcatagcttactgcagcctccaacaactgggctcatgtaattctcctgcctcagcttcccaagtagctgggattacaggcatgagccaccatgtctggacaaaaatatttccaggtgcagtggctcatgcctgtaattcccacacttgggaggccgagcgaggctggaggatcacttgagcctaggagttcaagaccagcttggctaagatggcgagaccccgtccctacaaaaaattttaaaaactagccaggcatggtggcatgcacctatattcccaactactcagtgggctgaggtgggagggtcgtttgaacacaggaatttgaggggagaaaaaaagaagagagaaagagaagtgaaggaaggaagaaaggaaggagggagggagagaagaaagaaacgaaagaaaggaaaagaaaaggaaggaaagaaaattggtaccaggaaagcaggaaagggaaatggaagtaaaaaaataataataataataaaatgaaaattggttagtcactattaacaatttgtatccttataatctggaaacattataatttcaaaagaaaaaatattctttggatcataggttctgaggtcagaacagcattcccgtagtctagatgaagtcaagttttatctgatcttaattgaaataaatatagctggccttgaacaaatctactcatggtatgtggataggaattaaattgtaggggcattcacttgatggcattcattcttagaacatttacctatgtctagcttttggagtaaagtcacataacctctaaccaggtaagtttcctgtggctttatttaggattttaaatactcattttcagtgtaattttgttatgtgtggattaagatgactcttggtactaacatacattttctgattaaacctatctgaacatgagttgtttttatttcttaccctttccagagcgatgattctgacatttgggatgatacagcactgataaaagcatatgataaagctgtggcttcatttaaggtatgaaatgcttgcttagtcgttttcttattttctcgttattcatttggaaaggaattgataacatacgataaagtgttaaagtacatgttattcagttttcattttgaagattagatggtagtatgagttagttaaatcaggtgatatcctcctttagaagttgatagcctatatatgtcatcctttgtggaggcaatttaaataaaatttaaaacatttattcctggctgggtatggtggctcactcctgtaatcccagcactttgagaggctgaggcgggtggatcacctgaggtcaggagtttgagaccagcctggccaacatggtgaaaccccgtctttactaaaaatacaaaaattagccaagcatggtggcacgtgcctgtaatcccagctgcttgggacactgaggcaggagaattgcttgaacctggggggcagaggttgcaatgattgcaccactgcactccagcctgggcgatagagtgagactccatctcagaaaacgaacaaacaatgtattccttttagtatttttacattgtatcaaactatggaagtcctctaattgagattaataagaaaaagacaatctgaattataattttaaacatttaacaagcatgtagtaaaataatgatgaagataaatagcattagtacagcaattaatatttgtagcatgctgacagtgctctgtgtgcgtttcatatattaaattactctaatcatcccaaatcctgtaagttgggtatcaattcaagtgttcctattgggtaggaatatacagttcttttaggaaatgtagtatggttctgtgtctcaaacaggacacttacacagttggccaacatcatcaccttctccattctctgagatgtttagtcttactgagcactaaatatgggtcatcaatagtccagactaccttgagcaaacaatagtccagactaccttgagcaaacagagcatatactcatacagtgtataaagagcaccaagcatacagatttcatgtctttctcatagttactcttgtaacatgagctaaagatcagacctctatgtcacctttgtaactgatttctagatttttttttttttttgagatggggtcttgccctgtcacccaggctggagtgtagtggcgtgatcatgcctcattggagccttcaactcatgagctcaaacaatcctcctacctcagcttcctgagtagttgggaccacaggtgtgtgccaccacacccagctcatttttgtattctttgtagagatgcagtctcaccctgttgcccacgctggcctggaactcctgagctcaaaagatccctccgccttgaccttccaaagtgctgggattacaagcatgaaccactgcacccggcctagatttttaaatgtgctttccagtatacactgaaactacaagtcgactaaagaattaccaagagaattctataaaatagagattgaaatggggctcgatgtgggatgggttggtgatattgcagggagaagtaatctgagtaaaggaggaaaagaactgatttgggaaaacgatagttttagtagtgagtttgagtatgaattaagttgagattgaatttgaattaagttgaggttgaatatgaattaagttgaggttgagtttgaggtatgaattaagatgtgaaattgatcattggaaatgttagattgagaaaagtcacagctggattaatagcttcagaagtgtgtttgcagacagttgcaactaaagtaataagaatagatggccttggccgggcgcggtggctcacgcctgtaatcccagtactttgggaggctgaggcgagcaaatcacgaggtcaggagttcaagaccagcctggcccacatggtgaaaccccgtctttattaaaaatacaaaaattagctgtgcacagtggtgcacgcctgtaatcccagctactcgggaggctgagacaggagaatcgcttgaacctgggaggtggaggttgcagtgagctgagatcagtgtgactgcactccagcccggtgacagagtgagactctgtgtaaaaaaataaaataaataaaataatggccgtaagcaagtaaagaaggatggccagctcttattgggaatgcctaaatctaaggcttgatcagaagtaatgaaaccgttggggccctacattgctatgacatccaaagggccatgaatatcaggaagaaagataattaacagggtctaatgttacagagaggttgagagcaaggagatttgattaaaagggtctttagagctgatgtcaggtgtatgatgcctttaagagcagtttttatagtgcagggggtggtcaaaagagaaaataggtgctttctgaggtgacggagccttgagactagcttatagtagtaactgggttatgtcgtgacttttattctgtgcaccaccctgtaacatgtacatttttattcctattttcgtagcatgctctaaagaatggtgacatttgtgaaacttcgggtaaaccaaaaaccacacctaaaagaaaacctgctaagaagaataaaagccaaaagaagaatactgcagcttccttacaacaggttattttaaaatgttgagatttaacttcaaaggatgtctcattagtccttatttaatagtgtaaaatgtctttaacttaagtgattagtacagtgtttctattgacatatacttatacaacttcaaaaacaactattaaattttctgttatttaggaacatgcatattagtcatgaaagtataaagaattagatgggaatgataaatgctaaaatcaggacatgtgttccatttgtgaatggaaggcagggagaaggtgccgtttggaaggagtacccaagagccgtaagctgaattggcagtgttttacatcttaagctgagagatagatttttttttcccctttttctttaaaaactctaaaactgttaattccaaggaacccagaagtctaggtagattatttctgctagttaaaagcagtagtcctgaaagctgaatattttggtgtcttttgagccaactttagtttcatcattaccaagggggaagagagctaacagttgatgagcacttgctctaggccagtccagagtgctgggcaccatacgcattttatctccctcccgctattcacaacaaatatgggaggtagtttatattatagccatctaataagatggggaaactaagactcaaagagattcagaaacttgtccatgattataaatgtaagagagttggaattcagatttatgtatttagaccccaagcctttctcattacatcattttgccttccaaatctctaccctctatccttcacctccccactgatcaaaacgagatgatagtttgccctcttcaaaagaaatgtgtgcatgtatatatctttgatttcttttgtagtggaaagttggggacaaatgttctgccatttggtcagaagacggttgcatttacccagctaccattgcttcaattgattttaagagagaaacctgtgttgtggtttacactggatatggaaatagagaggagcaaaatctgtccgatctactttccccaatctgtgaagtagctaataatatagaacagaatgctcaagaggtaaggatacaaaaaaaaaaaaattcaatttctggaagcagagactagatgagaaactgttaaacagtatacacagttgtcagtttgatccaccgaggcattaattttttcttaatcacacccttataacaaaaacctgcatattttttctttttaaagaatgaaaatgaaagccaagtttcaacagatgaaagtgagaactccaggtctcctggaaataaatcagataacatcaagcccaaatctgctccatggaactcttttctccctccaccaccccccatgccagggccaagactgggaccaggaaaggtaaaccttctatgaaagttttccagaaaatagttaatgtcgggacatttaacctctctgttaactaatttgtagctctcccatgaaacttttgtagcttaaatacacaagaattttttgaaaaggaaataagataatgatgcaaaatagttaattttttaaaaaaatgttagacactgcagtggatgcaacaaaatactttatatgaaagatttatccagttaacttttgtggagtattaggtattagactaataattagcacacttacttaagttagaaagtataataatgcgccggacgcggtagctcacgcctgtaatcccagcactttgggaggccaaggtgggcggatcacaaggtcaggagatcgagaccatcctggctaacacggtgaaaccccatctctactgaaaatacaaaaaaatttgccgggcgtgatggcgggcacctgtagtcccagctactcgggaggctgaggcaggaggatggtgtgaaccccggaggcagagcttgcagtgagtcaagatcgtgccactgcactccaacctgggcgacagaatgagactccatctcaaacaaaaaaacaaaacaaaacaaaaaaaagtgtaataataatttatcattagctggatgatatgctgttgtttcccatgtcacctgtataagatatgtaaaataagaacacattatttacatctaatatagataaaatcctgaggcgctctcagattgttttgtagagttcaaatgtaaatattgttttcatttatggtccttttggttataagtaacagaaatcaactctaaaaagatttttattataggttagattatgtcatggaaccttaaggcttgtccctttctagttcttttgtgtaaagcggtgatttcttccatggagggaatggtatttaggcaattttttttttttttcgagatggagtcttgctctgtcgctcaggctggagtgcagtggcaccatttcagctcactgcaacttccacctcctgggttcaagtgattctcctgcttcagcctcccaagtagctgagattacaggcacccgccaccacacccggcttattttgtatttttagtagagatggggtttcaccatgttggccaggctggtcttgaactcctgacctcaagtgatctccccaccttggccttccaaagtgctaggattacaggcgcctagcctaggcagtcattttcaaaaaacaagcatgactcaccaaaagttttaagattttctgtgataatgttcttattgaggcttacattatattacagtttcttgaatctaaaatgatgtaccctcttaggatatatacatcatgcttcattggtctcagggggctgatttttataaggagagatttgctagttttcacaatatgtcctctaagttggcatgtatagctaaacaggctttcataaaaatatacaatttagttaatgaaatttgggatatagtcttttatgattgaaataattttgctaaatagactgtctctgatttattaggtaatcaccactcttattttgttttacttccttaatgtctacatagaaaggaaatgagaaaaatccagaggttgtcatttgacttatgagtctgtttgacttcaggatttggtacatgaaatttcacttaatctttttgatatgtataaaacaaatattctgggtaattatttttatccttttggttttgagtcctttttattcctatcatattgaaattggtaagttaattttcctttgaaatattccttatagccaggtctaaaattcaatggcccaccaccgccaccgccaccaccaccaccccacttactatcatgctggctgcctccatttccttctggaccaccagtaagtaaaaaagagtataggttagattttgctttcacatacaatttgataattagcagaatagaggattgtaaaatgtcattgtagaacatcccttgggccagattctaatgggtagaaatttgaactaaacctctgggttttgtttgtttttaatgcctttctgttacccagatgcagtgctcttgtagtcccaagtctaagctctaggttgccttctttcctggcagaagttggtgtctatgccataaggaggtagttcctgttagaagggatttaattataccttatataaggaattagtgtttgcccttctaggtatagttggatgttagcttctgatgtaaactggatttctttttctttctctctctttttttttttttgttttggaggcagagttttgcccttgtaccccaggctggagtgcagtggtgtgatctcagctcacagcaacctccgcctcctgggttcaagcaattctgcctcggcctcccaagtagctgggattacaggcgactgccaccacacccggctaatttttgttttattagtagagatggggtttcaccatgttggccagactgatcttgaactcctgacctcaggtgatccacccgccttggcctcccaaagcgctgggattacaggcgtgagctgccgcacccagctgtaaactggatttctaatggtagatttttaggtattaacaatagataaaaagatactttttggcatactgtgtattgggatggggttagaacaggtgttctacccaagacatttacttaaaatcgccctcgaaatgctatgtgagctgtgtgtgtgtgtgtgtgtgtgtgtgtattaaggaaaagcatgaaagtatttatgcttgattttttttttttactcatagcttcatagtggaacagatacatagtctaaatcaaaatgtttaaactttttatgtcacttgctgtcttttcgtcctcgttaaatttaattttgttggtcttttgttgttattggttggttttctccaaatgctagctatgttaagaaatttaaggccaggtacagtggctcatgcctgtaatcccggcattttagaaggctgaggcaggaggatcacttgagctcaggagtttgagaccagtctgggcaacatagcaagacctcgtctttgtttaggggaaaaaaaagaaatttaagtaggagattatataagcaaaaatacaattaatttccagcattcactatataatataaatctccagactttacttttttgtttactggatataaacaatatctttttctgtctccagataattcccccaccacctcccatatgtccagattctcttgatgatgctgatgctttgggaagtatgttaatttcatggtacatgagtggctatcatactggctattatatggtaagtaatcactcagcatcttttcctgacaatttttttgtagttatgtgactttgttttgtaaatttataaaatactacttgcttctctctttatattactaaaaaataaaaataaaaaaatacaactgtctgaggcttaaattactcttgcattgtccctaagtataattttagttaattttaaaaagctttcatgctattgttagattattttgattatacacttttgaattgaaattatactttttctaaataatgttttaatctctgatttgaaattgattgtagggaatggaaaagatgggataatttttcataaatgaaaaatgaaattctttttttttttttttttttttgagacggagtcttgctctgttgcccaggctggagtgcaatggcgtgatcttggctcacagcaagctctgcctcctggattcacgccattctcctgcctcagcctcagaggtagctgggactacaggtgcctgccaccacgcctgtctaattttttgtatttttttgtaaagacagggtttcactgtgttagccaggatggtctcaatctcctgaccccgtgatccacccgcctcggccttccaagagaaatgaaatttttttaatgcacaaagatctggggtaatgtgtaccacattgaaccttggggagtatggcttcaaacttgtcactttatacgttagtctcctacggacatgttctattgtattttagtcagaacatttaaaattattttattttattttattttttttttttttttgagacggagtctcgctctgtcacccaggctggagtacagtggcgcagtctcggctcactgcaagctccgcctcccgggttcacgccattctcctgcctcagcctctccgagtagctgggactacaggcgcccgccaccacgcccggctaatttttttttatttttagtagagacggggtttcaccgtggtctcgatctcctgacctcgtgatccacccgcctcggcctcccaaagtgctgggattacaagcgtgagccaccgcgcccggcctaaaattatttttaaaagtaagctcttgtgccctgctaaaattatgatgtgatattgtaggcacttgtatttttagtaaattaatatagaagaaacaactgacttaaaggtgtatgtttttaaatgtatcatctgtgtgtgcccccattaatattcttatttaaaagttaaggccagacatggtggcttacaactgtaatcccaacagtttgtgaggccgaggcaggcagatcacttgaggtcaggagtttgagaccagcctggccaacatgatgaaaccttgtctctactaaaaataccaaaaaaaatttagccaggcatggtggcacatgcctgtaatccgagctacttgggaggctgtggcaggaaaattgctttaatctgggaggcagaggttgcagtgagttgagattgtgccactgcactccacccttggtgacagagtgagattccgtctcaaaaaaagaaaaaggcctggcacggtggctcacacctataatcccagtactttgggaggtagaggcaggtggatcacttgaggttaggagttcaggaccagcctggccaacatggtgactactccatttctactaaatacacaaaacttagcccagtggcgggcagttgtaatcccagctacttgagaggttgaggcaggagaatcacttgaacctgggaggcagaggttgcagtgagccaagatcacaccgctgcactctagcctggccaacagagtgagaatttgcggagggaaaaaaaagtcacgcttcagttgttgtagtataaccttggtatattgtatgtatcatgaattcctcattttaatgaccaaaaagtaataaatcaacagcttgtaatttgttttgagatcagttatctgactgtaacactgtaggcttttgtgttttttaaattatgaaatatttgaaaaaaatacataatgtatatataaagtattggtataatttatgttctaaataactttcttgagaaataattcacatggtgtgcagtttacctttgaaagtatacaagttggctgggcacaatggctcacgcctgtaatcccagcactttgggaggccagggcaggtggatcacgaggtcaggagatcgagaccatcctggctaacatggtgaaaccccgtctctactaaaagtacaaaaacaaattagccgggcatgttggcgggcaccttttgtcccagctgctcgggaggctgaggcaggagagtggcgtgaacccaggaggtggagcttgcagtgagccgagattgtgccagtgcactccagcctgggcgacagagcgagactctgtctcaaaaaataaaataaaaaagaaagtatacaagtcagtggttttggttttcagttatgcaaccatcactacaatttaagaacattttcatcaccccaaaaagaaaccctgttaccttcattttccccagccctaggcagtcagtacactttctgtctctatgaatttgtctattttagatattatatataaacggaattatacgatatgtggtcttttgtgtctggcttctttcacttagcatgctattttcaagattcatccatgctgtagaatgcaccagtactgcattccttcttattgctgaatattctgttgtttggttatatcacattttatccattcatcagttcatggacatttaggttgtttttatttttgggctataatgaataatgttgctatgaacattcgtttgtgttctttttgtttttttggttttttgggttttttttgttttgtttttgtttttgagacagtcttgctctgtctcctaagctggagtgcagtggcatgatcttggcttactgcaagctctgcctcccgggttcacaccattctcctgcctcagcccgacaagtagctgggactacaggcgtgtgccaccatgcacggctaattttttgtatttttagtagagatggggtttcaccgtgttagccaggatggtctcgatctcctgacctcgtgatctgcctgcctaggcctcccaaagtgctgggattacaggcgtgagccactgcacctggccttaagtgtttttaatacgtcattgccttaagctaacaattcttaacctttgttctactgaagccacgtggttgagataggctctgagtctagcttttaacctctatctttttgtcttagaaatctaagcagaatgcaaatgactaagaataatgttgttgaaataacataaaataggttataactttgatactcattagtaacaaatctttcaatacatcttacggtctgttaggtgtagattagtaatgaagtgggaagccactgcaagctagtatacatgtagggaaagatagaaagcattgaagccagaagagagacagaggacatttgggctagatctgacaagaaaaacaaatgttttagtattaatttttgactttaaattttttttttatttagtgaatactggtgtttaatggtctcattttaataagtatgacacaggtagtttaaggtcatatattttatttgatgaaaataaggtataggccgggcacggtggctcacacctgtaatcccagcactttgggaggccgaggcaggcggatcacctgaggtcgggagttagagactagcctcaacatggagaaaccccgtctctactaaaaaaaatacaaaattaggcgggcgtggtggtgcatgcctgtaatcccagctactcaggaggctgaggcaggagaattgcttgaacctgggaggtggaggttgcggtgagccgagatcacctcattgcactccagcctgggcaacaagagcaaaactccatctcaaaaaaaaaaaaataaggtataagcgggctcaggaacatcattggacatactgaaagaagaaaaatcagctgggcgcagtggctcacgccggtaatcccaacactttgggaggccaaggcaggcgaatcacctgaagtcgggagttccagatcagcctgaccaacatggagaaaccctgtctctactaaaaatacaaaactagccgggcatggtggcgcatgcctgtaatcccagctacttgggaggctgaggcaggagaattgcttgaaccgagaaggcggaggttgcggtgagccaagattgcaccattgcactccagcctgggcaacaagagcgaaactccgtctcaaaaaaaaaaggaagaaaaatatttttttaaattaattagtttatttattttttaagatggagttttgccctgtcgcccaggctggggtgcaatggtgcaatctcggctcactgcaacctccgcctcctgggttcaagtgattctcctgcctcagcttcccgagtagctgtgattacagccatatgccaccacgcccagccagttttgtgttttgttttgttttttgttttttttttttgagagggtgtcttgctctgtcccccaagctggagtgcagcggcgcgatcttggctcactgcaagctctgcctcccaggttcacaccattctcttgcctcagcctcccgagtagctgggactacaggtgcccgccaccacacccggctaatttttttgtgtttttagtagagatggggtttcactgtgttagccaggatggtctcgatctcctgaccttttgatccacccgcctcagcctccccaagtgctgggattataggcgtgagccactgtgcccggcctagtcttgtatttttagtagagtcgggatttctccatgttggtcaggctgttctccaaatccgacctcaggtgatccgcccgccttggcctccaaaagtgcaaggcattacaggcatgagccactgtgaccggcaatgtttttaaattttttaaatttaaattttattttttagagaccaggtctcactctattgctcaggctggagtgcaagggcacattcacagctcactgcagccttgacctccagggctcaagcagtcctctcacctcagtttcccgagtagctgggactacagtgataatgccactgcacctggctaatttttatttttatttatttatttttttttgagacagagtcttgctctgtcacccaggctggagtgcagtggtgtaaatctcagctcactgcagcctccgcctcctgggttcaagtgattctcctgcctcagcctcccaagtagctgggattagaggtccccaccaccatgcctggctaattttttgtactttcagtagaaatggggttttgccatgttggccaggctgttctcgaactcctgagctcaggtgatccaactgtctcggcctcccaaagtgctgggattacaggcgtgagccactgtgcctagcctgagccaccacgccggcctaatttttaaattttttgtagagacagggtctcattatgttgcccagggtggtgtcaagctccaggtctcaagtgatccccctacctccgcctcccaaagttgtgggattgtaggcatgagccactgcaagaaaaccttaactgcagcctaataattgttttctttgggataacttttaaagtacattaaaagactatcaacttaatttctgatcatattttgttgaataaaataagtaaaatgtcttgtgaaacaaaatgctttttaacatccatataaagctatctatatatagctatctatgtctatatagctattttttttaacttcctttattttccttacagggtttcagacaaaatcaaaaagaaggaaggtgctcacattccttaaattaaggagtaagtctgccagcattatgaaagtgaatcttacttttgtaaaactttatggtttgtggaaaacaaatgtttttgaacatttaaaaagttcagatgttaaaaagttgaaaggttaatgtaaaacaatcaatattaaagaattttgatgccaaaactattagataaaaggttaatctacatccctactagaattctcatacttaactggttggttatgtggaagaaacatactttcacaataaagagctttaggatatgatgccattttatatcactagtaggcagaccagcagacttttttttattgtgatatgggataacctaggcatactgcactgtacactctgacatatgaagtgctctagtcaagtttaactggtgtccacagaggacatggtttaactggaattcgtcaagcctctggttctaatttctcatttgcaggaaatgctggcatagagcagcactaaatgacaccactaaagaaacgatcagacagatctggaatgtgaagcgttatagaagataactggcctcatttcttcaaaatatcaagtgttgggaaagaaaaaaggaagtggaatgggtaactcttcttgattaaaagttatgtaataaccaaatgcaatgtgaaatattttactggactctattttgaaaaaccatctgtaaaagactggggtgggggtgggaggccagcacggtggtgaggcagttgagaaaatttgaatgtggattagattttgaatgatattggataattattggtaattttatgagctgtgagaagggtgttgtagtttataaaagactgtcttaatttgcatacttaagcatttaggaatgaagtgttagagtgtcttaaaatgtttcaaatggtttaacaaaatgtatgtgaggcgtatgtggcaaaatgttacagaatctaactggtggacatggctgttcattgtactgtttttttctatcttctatatgtttaaaagtatataataaaaatatttaatttttttttaaattagctgtatctgtgattgtatttcttttttgcatattattttgccctttggcccatattttgatatggatgccaccatagcattttgtgtatgtgcatgtgtattcccacttaatgtcacatttttcatgtctttacatattcttatttttgtttgtttttgagacagagtctcgctctgctgcccacgctggagtgcagtggtgcaatctcagctcactgcaacctctgctatccgggttcaagcggttctcgtgcctcagccacgtgagtagttgggattacaggcatgtggcaccatgccccactaagttttgtatttttagtagagatggagtttcaccatgttggccaggctggtctcaaactcctgccctcaagtgattcgaccaccctggcctcccaaagtgctgggattacagccgtgagccaccgcacacggcctctctatttatttctatacatagcttttcacattatattatgtttatatattgtttatatctgtatttcctctttcattagagaaaaggtagtacatcttattcttcatggtgtctacaatatctggcagtttttggaagtcaagcgtgagcttagagcatagactggtgggattgtcaaagaagagggcaactggaagagaactgtcagttatttttggatcagtctttaattcatcatgacgggttaggcattagttgtatttcttgctaattttgaagaagacttattaacaaatcctacattaggtaaatggttttgaaagttgagttaatcataatggtgtttgacctaggactatttttaggccctatttatcttaatatcgaataatgaagcagcttcccccttagatatagacagaaaacatcaaagccaccacactacctggctggatttatcctagtaataaaatcaaaactgagctagttctctggctttcattgtaataattgtccttgtggttgtaaggaatctagatgaaaattacatggtctgttctacagccacagctgtacctacattcagaagacagacaaaagttgctgtgtttgaagagatccttcattaagggatcagacagagattactttgagacatattctaagtttaacttttctgcagggttgccattaacagaaataaactacagagttaatttctttttgtttttgatacagtctaactctcacccaagctggagtgcagtggcgcaatttcagctcactgcaacctctgcctcccaggttcaagcaattctcctgcctcagcctcccgagcagctgggactacaggcatgtgccactatgcctggctaatttttgtatttttagtagtagagacgtggtttcgccacgttggccaggctggtctggaactcctgaccccaggtaatccacctgcctcggcctcccaaagtgctgggattacaagcttgagccactacgcctgacccagagttaactttttaaaaaagtttttatgaacttaagtcttgtgatgtttgaaataatggattcaatttagacatcaaattccagaagttactaagagcagctgggcgcggcagctcacacctgtaatcccagcactttgggaggccgaggcgggtggatcacctgagatcaggagttccagaccagcctggccaacatagtaaaaccctgtctctactaaaaatacaaaaattagcccggcatggtggcacgccctgtagtcccagctacttgggaggctgaggcaggagaattgcttgaacccgggaggtggaggttgtggtgagccgagattgtgccgctgtactcaagcctgggctaaaaagcgagactccgtctcaaaaaaaaaaaaaaaaaaacacgttactaagagcaactctgggccaggcacggtggcttacacctgtaatcccagcattttgggaggacgagacaggcggatcacttgagcccaggagttcaagaccagcataagcaacaacgcaaaacccctgactctac

SEQ ID NO: 12971 - DNA, 32068 bp, Human; identical to SEQ ID NO: 12970

SEQ ID NO: 12972 - DNA, 32068 bp, Human; identical to SEQ ID NO: 12970

SEQ ID NO: 12973 - DNA, 32068 bp, Human; identical to SEQ ID NO: 12970

SEQ ID NO: 12974 - DNA, 32068 bp, Human; identical to SEQ ID NO: 12970

SEQ ID NO: 12975 - DNA, 32068 bp, Human; identical to SEQ ID NO: 12970

SEQ ID NO: 12976 - DNA, 56832 bp, Human
acagagagagactccgtctcaaaaaaaaaaaagaaagaaactacagtaaatcccaacatgcaataatacatatatagcatatctataaacatatatatctacacgtgcacttacacaaacttacccttactcatttttttaactcaccactgtactaatgaggacacatacttacccttactatgcataacgcagttttctattctgttctattttttttaaaaaaaggtaaaactaaactgattttataatgcaaggaatttagtagcatctgttcaaaaacaccgtggtgagggtatccgaatccacaggataaaaacgacacattttacaggagagtgcattttaagacctttattttaaaatacttaaaataactatagcgtaaacctcaacatttcatggaaacatagaacttccagacattgatcacttctggctggctgcctggggcttccatctgtagatccccgaggacaagaatgcacaccccagcccctcatcggagtgcttccgtgggaaagctggagggagtcgctcttgggttgggtgttccaagtcgactccagtcacctctaaaccttcctacgctggaatacaaggcctgccactcagcttcccctggcttcattcctccccaccgatcactggcaaagggcgaagggccatgcccggcctctgcaggtccccactgccaaacagcctgggcagaataggggcgggttccccggcgcggcggagtctctgctaactcggcaagtgccaagccctccagcagccaccacgccgggcctgcctgcaggctggtccctcaacggcacctgcgttcccggccgggcttcccttcccgcgcccctctgcactgcacccctgggaaggctgtgcccacaccacggtctccgcccgtccacaccgcggcccgaggcgttcctggcacccggctcgggcctgcccgccgcaccagccgccccggtgctggcggagaaccggcttcccgccccggcgctgttccaggaggtgcgccgagctccgcgcgaagcgaagcggacaccagaactgacgaggctcgccctgtttttaatgaaattcctaacactttgaattaacgcagactccatgcttcccacagtccttcggccgtcggtgacgcttagtcaccactacatcctcaaacccagacacgaacgctaacgcagctcaaggagaattttcaaaaaaccccgagggaggagccagcccacccgcccaggccacgcgcctcgcgcccttcacgggctcagcgggcgcgaacccgccaaccgcttagcgtttcgccaatcaccgcacctcccacctattgccccgccctgcgctccgttctggccaatcaccagggagccaccgtttgtctctccgcctctcccgcccgcccctaaccggttggaagtttgaagccttcaaacctagccggcgcccaacagcgcggtagcagcgaggtgtatttttagctcccgggcgggcagccccgcccccccctccccgcctccttgtttcccccaatgggagatggagtttccgacacgtcatcgcgcggctgtgcaggagctgtccaatcggcgctcggggagaatggcgtaattaaaaagcggcggaagaaggtgggagggtcatgacgcagcgagtttcagtcgtgacttttctgggggcatcgcggcgtcccctttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccgccgccgccgcggttgatgtggttgggccggggctgaggaggccgccaagatgccgcagtccaagtcccggaagatcgcgatcctgggctaccggtctgtgggtgagtggccggtggccgcgcggcctcctcgcgccgccggggcctcgcctgggagccgggtcgcggccgggcctgcgaagtttggagccggcgcggccatgtggcggggcgggcgggggccgcgcgtttcgtaaccaccattctgagcggaggtggtggcggtcggggcggcgtccgcgccggtggaggagccgcggtagctgggcgccctccgcgggccgggcgggcaggtggcggccgggcggagggcgtgggaggcgcggggcgggggccgtcggccgccgaggagtccgggtctcgtctggggaagtgaggcggcgccggggagccgcgctagaggctgccgcgagggagtcacacctgcctccccgccttcgccgcgggcgcgcgtgaccggggctggcggtctcccccaccccgcccccgatgtaaggaaaagaaagtccgtgggattttaacaaaggaagcagcgcctcggcttcattccatctgtggtgaagtttacccttgtaaagaaaactagggatttagaggacgtttgggcactgaacgcaagttttctgcataggaaacctaggcgatcccccaaaagaggtccctctggaggccctcgagatgctgctggcggcctgggtaggaagacagagaaaaaggaatgtctgatctctcggtgccctatttttgttcgggaaggaataaggtcaggtacttgcaaccaggctgttgaagtaattccaaagtctttttgttttctttttcttcccccaaaaggttgacatacatttgaaacagttcctagcagtcgccttattgctgaataaggtggcttagggtcgggttggggggcggacggggtgttacagaacgagcggttttctggcctgtgtgaaaccagagcgattgaacttagacacgcttcagggtgaggctgtattgtctcccgacatccggaagcctggagaaattagttcatcttttcgggctgttttgaagtaactgtctatagaaggcgtgcaccgggccacagttgaggggatggggaggtgaaagcgagggttccgaggctcccgtgattgcggaacggggtgactatctgtcatgggaagcttgtacctgcctgccgctcactggatgcactccccaactgcgctttccaccgcctgtgccagggtctgtgctctttgaccaagatcagccactgcatgcttactcatccttttaccacctctccgtcgagagccggggggaaattaagggctgaaagaagcttggctagagatgcggggtgcctagagtcgtaggggaactcttgtgcgatgcggtgctgaatccgaggggatgcataggtggcagctttaacagctgcagccaggaagtaaccatgaatcaaatggaggggttcaaagtcactaattgttcaaatatcaacatggaacctgggatccagcctttattggcagcctgaatccatgctcttgtctctgttctcttgatttcctcctctgcattttgaggagttgggaccgcgaggtgttctggctcttgggtgagccttccctagtcagtcaagtaagtacttattggcaactatttggaaatagtagtccctgaataatcacgttataggcaacaagtacctcggctacctgatttcaacccaagagaatgacctaaagatcttgactgatttacccttttcaaatgtcgaaatggtagctctagtctttggtgagcagggctagttttatcacttttttttttttttttttggctacagaagttccttatgtccagttgaaatccattctgttttatcttccctctattcagcgtcctcctgaggacggagatgtgacaggccaccccttagccttgtcctcacaaactgttgcttgttaaatactgtgctaacttagtctccggtgggatacagggtcacttttagtccctattttctgtcttcagtatttcatatttctgcaacctaccccacttctccatatttattttcaagcgtagtcatattaaacgattttggagaggttaagttgctcccaatcttgtatttgatttttttttttttttttttccgagacggagtttcgctcttgtgacccaggctggagtgcaatggcgcgatctcggctcactgcatcctccacgccccggactcaagcgattctcctgcctcagcctccagagtagctggcactacaggcgtgcaccactatgcccggctaattttgtatttttagtagagacgggtttcaccacttggccaaacgtcaggcttgtctcaaacgcctgacctcaggtggtcctcccaccttggcctcccaaagtgctgggattataggcgtgagccaccatgcccagccgcatttgattttaaagtgtattatgagccaggatattttgtagtatgtggggtcttttttaggggaaggagattaggttttgccagcaggtttcttctagtaagccacccttttgagaattactcagcatgctcacttctgggagcttactggcatgtttgcttgcaaatggtggtgctgtaccagagaaatttgagtacctgtgtttctagattgtggtattttgtgatgctgagctgtttgtcctatattctgggggtagagccacataaaaagcctccacacctttcttagaatgttctcttgattaaatacattaagccagtttgactagtaggatacttgtcattgtgatttgtcatgccacaaactttatttttaaagttgtcttcagataaaacaaaaaagtgctatgtttgtttaactagttggctttcttttttttttttttttttttttgtgacagagtctcactctatcacccaggctggagtgcagtggcgggatctgggctcactgcaacctctgctgcccaggttcaaccgattctcctgcctcagcctcccaagtagctgggataacaggcgcctgccaccccgcccagctaatttttgtatttttagtagagactgggtttcaccatcttggccaggatggtcttgaactcctgacctcgtgatccacctgcctcggcctccctaagtgctgggattacaggcatgagtcactgcacccagcccactacttggctttccgttttctttttttctttttttttgagtgttgtcagaactaccaataggtaaaatataattctcaggtagtctatacaattctccctgccagtcccctgtacttttcctggtatttacaatgttaaagcttttaaggacacgtcacctataactctgggagtctggctttcagggagtgctttgtattaactgttgccgtggtggccaaaagtaccagctccctgacattccgttatttctaccacaacggagtagtcccgcgataggaagtaactcaacttaagttaaaatggtagtgttacgtaaactgtcttcagcctggtacatctttcactgggattttacctgtacagagagctttggtaacctagtttaccattagaccataattaaaagctggttgtcatatataagcctcttacatacagttaataagagggatgggatcacaggcatgtgaaagatcatagggggaaaatgaaacagctttgtggtttggaagaaggcaattcagcaaaagtactcaaattattactttgtcaaaatgtttaggtagtatttagagtcttcatgaggaaagatgtcattaaatatttggttgttcccagcagattctgacttactgtttattttttaagttaacctatcatttgttgacactttttattgaaaaattgaaaggcaaaacaatatttgctatgtatgacatctaccagtatgtgaaattgtatattcaggtgcttaatattctgatgttgtatacttgtgggtgggggtagtcctgaagtgcccactttgtattgaaacttgaaattactgtttttcagtctcattcattgttctgcacaagagcataatcagaattcagatttctgattatggctttccagtgccaaatgttattttgctgtccatatgggttatatctctctgtacttcatcaccccaaaaagaaactctgtactcattagcagtcactctccatcctgcttccctgtcagcccctggcaaccactaatctttctgtttctatgaatttacttactctggacatttcatataaataagaacatacatatgtggtcttctggggctggcgtcttttacttagtataatgttttcaaggttcgttcatgttgtagcatatgtcgcttcttcctgtttagtgctgactaatattctgtcatgtgagtataccacattttttctatgcatttgtcaattggatatgtgggtggtttcttttctttctttttttttttggctattattttttatttatttacttttctgaggcagggtcttgctctgttgcccaggctggagtgcagtggagctatcatggctcactgcagtgtcaacctcctggactcaagtgatcctcctgcctcagcttcccgagtagctaggactgcaggtgtgcgccatcacacccagctagtttttttatttttttgtagaggtgggaaccttgctttgttgcccaagctggtcttgaactcttgacctcaagcaatcctctggtctcagtctcccagtgttgggattacaggtgtgagacaccacttggagctctactttctggctactatgaataataatgttttgaacattcctgtacaagcttttatgtagacatgttttcatttctcttgggtacattcctaggagtggaattgctgggtcattatggttaactctgtgcttaatattttgaagaactgtcagattttttccagaacagctgcacaattttatattcccatcagcaatgtatgagggtttaattttctccacattctcgtcaacaattgttacactgcctttttcattttagccatcctattgggtgtgaagtggtatcataggatttgcaaataatttctcctgtctgtgggttgtccttttaccttctcgatggtgtccttcaaagcagaaagtttttaatttgaaggccgatatatctatttttctcctgccacttatgcttttggtgtcacatcttagaagccattgcctaatccaaggtcatatagatttactactatattttcttctagatattttatcctgttaactcttacattagatctgtgatctatttgtggttaatatttgtatatgatgtgagggagggatagaactttatacttttgcatgtggatatcaagttgccctagcttcttttgttaaaataatgttctttcttcattgaattcccttgtccgagatgaagtgaccgtcaatagaagaactcactcattccattgatctgtatgtctgtcctgccagtaccatacgatcttgattactgtagttttgtagctggtttttaaataggggcatatgagtcctctaactttattatttctgaagatgtttttgggtattctcagtcccttgcatttccatattgaattttaggactagattgccagtttctgccaaaaaagcaactgcaattttgataaggtgtttcacggttttgcaggtatcttttaatgtcttaacagctggattctcatctctgctcctgaattcattcccttaacgttattttaatgaagtaaggagtacttgaatagtttttcaggtagttgaatattctttgataccgaaacttcataagtgatagtttgcaaagaatagttacactatgcaatctgaaatcatattgatgaatttgcccaactccgcaggtctgctttatacttggaatggatcttctaccatgcctggttttgtagcgttactggtcatttggaaaatatttgttcatcgttacgcagatcttccacatgttgacacattttattatacaagcatttttaaaaatcacatttgttaatatcaccaccaatctctgcaaagtcttaagttttagaacactgttcgctatgagtggtgcaagttttccaaaattctaatttcctccttgagttcaaataatttccttggcaacatgctaccagtttttacttgaattgactgttttgtttctttaatttccaagaaaatgtctgccagctattcacatttgcaataatgatagtttgtcatcattcttgcaagtaaaaaaggcattccatgataaaagtggccagttcagatcacttctcaaatgactgcacaagtgctttttttggaaacaaccatcatacttcagtatgtaacagaggtgctttatgtgtacatctcattttgtcgtgcagaatattaaaaagacaggtaccaaagggtcaagatttaatataattttactgctttttcaaggacactgttaagtagaaacagctcttttcccactgtgaatgcatggtagtaaagaatacagtgacttaccactcagtttgtaactactgtttttgattcatgccaaggggtgccgagctagcagttttccctaccattgcttttgcacccttagtacaaatgggaactttgtggaaaaggcaaatgataacttaatattgctatgaatatcgttttgacctcatgagacccctgaaaagattttggtaaaccccttagaggtccacagaccaccctttgagaaccattaaactgttgtaagctaggatcttgttcactgctgtgcaaaatcgaattgacagtgactgcatcctaaatgctgttcacagcgatatggttcccacagtgttagaagagcctcctaggagaggccctgtagcgttgtgagagacaaagatggcaaggcaggaaagaacttggcgtggttagaatggaaggaagcacgagggaggccagagaacatcaggagagttatgatatctgtgtgcctattggtttggcctctgattgtgttgcatttttggatgagttgtgtttggacctggtgatggcgaggctcccagagagtagtgaaaattgcaaagagtagcaggataccagagacccatatactaataatatagtttttaaatacgagtatcaggatgaaggtggggaggagtacacaagtaaaaatagcaactttatcacagaatgagacactgccacctctacctgtgattgtggaaggtcagagatgcacaatgcttttcttgggtgaagattcagaataacaagttcgcaaacaactgtaatagtgtccatggctggattgttcttagttacttgaataaatcagaactgaacttgcacatgattgtgcaagtgagagtattatgaaatctttagggatcatacttgaaggaaccttcattcttagttctaatttattctgaagtaccaaatgaaatcttaacattgatacagtactcacggtctatcttcgtcacgtcattcttgctaactgtgagaatgcaaactgctgagtccttttaacatgaattgctggattgatttttaaatataatcagctgtgcgcagtggctctcgcctataattccagcactttgggaggccgaggcgagtggatcacctgaggtcaggagttcgagaccagcctggccaacctggcgaaaccctgtctctactaaaaatacaaaaattagctgggcgtggtggtgggcgcctgtaatcccagctactagggaggctgaggcctgcaggagaatcacttgaacccgaagggggaggttgcagtgagtcgagatcgcgccactgggcgacagagcaagactccatctcaaaaaaaaaaaaagaaatctaacattttaaaggttctggaatactattttagtattttaattttcttcaatatatgttgggcttctggttattaaaaaaaaaaaaggagttcctgtaggattggagctttaaatctaaactggtattagtttagaacaggaagtgctagaaaagcctttacgttgtgctcttatgggcaagttaagaaagcagggcagtttaaagatagtgatagaattcactccgaagtgtcatgcttgcttggtttgcgtcttatctgtagtagaattgagtctttctctcccgcatttctctttttgttgtgcttacatgtttgcagaaggactcctcatggacatttgaaagagaagttggtgttttagcaagatacaccatcccaccttttgcaggattgagagttgaatgttaataactacctgatggcatagtacataatttgtgaatggggatgcaaatatgggcttttacagttaatacagttttatgagatgaaatgcttttctaagacttctgtgtcttagatataaatgtgtctgcctattttgctagctttatttttttttttattttttattttttgagacggagtctcactgtgtcatccaggctgcagtgcaatgtcgcgatctcggcacactgcagcttcaaccttccagcctcaaggatcctcccgcctcagcctcccgagcagctgggactatgggtgtgtgccaccatgccctggctatttttttatttttttgtagacatgaggtcttacttgttgcctcgactggtctcgaagtcctggactcaagcgatccagccacctcagcctcccagagttctgggatcacaggctgagccactgcacctgtattttgctggctttaaaatctcaatcacatttggcatttgtttgaaagagaacatttgggccaggcccccaaagattgaatcactgcaactgttggttgaagaggacagtttgtgagtgttatgtgttattcaaattaggtgttcattaagcatttgaataaatgctctactttgtaccagtcacaaaagctaggacagttataatccttgccctcaaggagcttcagtctagttgagagccacaggaacttgttcctgctactgagaataataattgttggtgcttttgaagcatttactgttatggggtacaatcttaatgcacatgtattaatagcctttaaactcgggtaggtgcagttgttacacctattttgcagataaggaaactgaagtacaaaaagtttatgtgacttgcccaatgtcaaactgttgttaagtgacaaagccaggattttgaactcaggcagtggctccagagcaggcagtctttaatcagctactacacgattgttacttaaatacagttgggataggtgtttgagagaaataatcaaaggcagggctaacttgatcatcaagtggggatgggggtggtgggagaattgtctttaaaggaaaggcagtgtggctcactgagtgaatgagaagggtgaggtgtgagtaatgagagaggtcgggactcatgtgtttgccaactgtccttcaagaacagttttgtctgctctgtgaaaagttttagactttttcctagaaactgtgggaagtgactgaagggttttaagcaacaaataagacgatgatctataccagggactggcagacttgttctgtaaaaggccagatagtaaatatctcaagctttgcagggcaggccatgtagcctctcttgcagctattctactttgcctttgtaggacggaagcagccacagacaatacatcaacgagtgggtgtggctgtgtgctagtaaaactttatttatggatataacacttgaacttcatctgattttcagtatcatgaaatactgtttctttttccaaccacttaaagatgaaaaaaacatttttagctcatagactgtacaaaaccaaaacaggctgtaggccaaatttggcccctggtctgtagtgtgctgatcctggcttccatcctcctgctgttctgtgaagtgggaggggtggtaagggagtagaaatgggaagaccagccaaggcgcagagtagatgagatgaagaggacacacatgggagatttccttagagggagaatgggcaagaccaatgtggaagctgtgaagtagccttcagatttctcatgtgagtgcctgagtaggtcatgttgccattggctaaaatcagaaatgatggaacaggagcaagtttaaggggtggaccagatttatttatgcacctgccagatccacacactttccttgctttctggccacagaggccctagcgaccacccacacagggcacagttcccatggtcccgaagacaggtggctgtgcctacaagtagggttctgagggtttgctggccctgggtccttgtgtcacccaaggatttgaccaagcataccctcacaccgcaggattgttgccccagagacaaatgaggttgctgggcccgggtggccccacacgctcacgctgcccactcaggcaggcagtgtcttactacaaggatgtttgtcattcctgcttgctgggagggggagttggactctttctctagatcttttcattctgcataagagtgctacaaaaatgtgtgaatatgttttataataataaattgctttcttaatctaaccatgtttctgtatgagcagtgtcctaaaaaattgagctgtacacaaaatgagcctaccttccaatttttttagacttctatggaagtatttctggagcacaaatttagggagctaaatttatacaaataatatgatcctattcccttaaacaagggtacagagcagccttgcccaatggaaacaatctggcctggtgcagtggctcacgcctagaatcccagcactttgggacccaaggtgagaggaccacttgagctcaggagctccagaacaacctgggcaacacagcgaaaccctgtctctacaaaagtgggaggctgaggtctcaaaaaaaaaaaaaaactaaaaatataacctaatgtaattttagatttttccagtaggcatattaagtaaaaagaaataagtgaaattaatatacttaatttagctcagtatgtccaaaatgttatttcaacatgtgatggatattgttgatatttgtacatttgtcatacttacactgtgacacatctcagtcggaactgagcacatttcaggtacttactgtccatgtatggctactggctgccatattagacagcccagatactgtgaggagtgaattggtgttgataatgaggtcagcgcagattttaagaacttttgaagaaattatctttataaaatatgaatggttttaaccattcaggctgacggatgagtatactctatttcatatctcattttcctcatactgtgttattactagttttgatcattcttaaatttcatgttctttaatatgttaagaaatagagaatttttgtctttgcttttctctagctctttcccaccctcacctgtatcccgggtcttctctccagattggccaccgttctaggaaaactcattcttcattgttgctaaacatttaatttcctgcagtttatcagggctattattgttgccttccacctcagctttgtctttaaaccatcctgtagagatgaatatcctgttttgaaaatctccagggaaacagttttatggcctttctgggtagcactttatttttctttagtttaataatcctgttaataaaattcttcatttatgaaactgagtccttcatgttatataattaaacgtatttcttattttcctcagtggtatatatctggtagcataataattggcaatagggttacctataagtatttgaaagggtatttttatgaactagttttactttttctgccttgtctttgtcataataataataattgcagtttaattttttcttttttttaaaatctcccagcatctatttttaaaattggggaaggggtgtgagaaagaacaacatgatgtcaaccctgcttagctcacaggaacaagcgagataattcatgtgagaatgttccgtaaactctaacggtgtctcactttttaggttctgtacaataattaagatgtgtatgttctgcatcacacactctcatctgactctatatgacggacatgtggggattggtattccaattagaatcgtaaacatcttttcaaaacacttccttagtgacactaatatatatatgtgtgtgtaatatacatagacacacacaatacaacacatatcacccctccctctcgaaaaagcaacaaccaccaatcctgccatagggggagctacacatttcttactagagtgggtgcatacgattgttaagcatatgattggcattgtgtgtcatgtaaggaacacatagaaacctttatgcggttcattgtttttccagccttttaacagtggtgattcaggtttcattccatttataagccaggtgagtctgcagtcttttttctgccgtttacaaaccaagtctgctttactggtgtctgttctattgttagtccccaacgaggcactctcctggtattcctgtgcttgccctgtgactgtcttgagcctgcagaatgcagcagagatggtgatgtgccagttccaggctttaagccctaagaagttggcagcttctgcttttgtgttcttgggagcctcaagtgatgtgcagtagatgttaggaggagacacagagaaagggagaatgccccgccttcccagctgtgtagcaccaccagcccaccagataaaggccccccaaagagtaaactaaaagtgagcccagcgttgactgtagaaccatgagcacatgaaatgggtggtgtcagtcactcagctgtgggtaaatgaaacagtaattttctgctttaggggtatatgtatgtttgttattttgcttgtgttattttgaggctttagttgaaatagttactgtatgtcatctttcaggttaatttattagatataattccgaaaatactttttttatcctaagcggattatttctgcctaagagcagttactaatagtattactaatattaataataatgagatttgctgagcacttgctacatgccagatgtttggtatacattttcatttaatcctcacaaagcacgttataggataggtaccattatgatgtccatttacagataaggaaaaggactcaggaaaactgcccaaagtcacatagctaataaccaccatctcatactgtttagtaaaaagtagtaaatgggctgggcatggtgacacacacctgtaatcccagtgctttgagagaccaaggtgagaggatcatttgagaccagcagtttgaatacagtgagctatgatcctgccattgtactccagcctgggcaacagatagagaccctgtctcaaaaaaaaaaaaaaaagtaaatgcattatcttttaaaaaaaatctttttttcctaaatcaagtttattgaggtgtaatttacatataataaagtatccattttaagtgtagagttggatgagttttgacagatttatgcacctatgtaacctctgcctttatcaaaatatgaaacattccgtcatccccacaagttctctcatgtccctcacgccctaccccagctccccgggaagcactgatctgctctccatcactctgggttagtttttcttaccctaaaatttcacatacatcgaatcatacaatatatactcatttttgtatgtcagttagcataatgtttttgagattcatccatggtgttgcatgtataatttctttttattgcaaagtggtattctgttgaatggatataccttaatttgtttatctgatcacccattggtggatatttgggttatcccagtatttaactattaagaataaagctattatgagcattttgagtaaatgtcttcgtggacacacagtcatttctctttggtaaatacctaggtgtgatattgctgagtcacatatatgttaagtgtatactttaggagaaactaccaaactgtttttccaaaacattttgaccattttatgcctccactagcagcacatgagagctttggttgctgcctgcccatcctccctgatacttggtattggcggcctttctaactttctagctattctcagatggtaggttgtggttttatttgaaatttcccactaagaatggtggacatcttttcatatacctactggaaatttggatatcttggtttgtgaagtgtctgttcaagtcttttgcctagattatcagattcttcttactgaattatatattctgaataaaagtcctttttcagatgtgtatttaatgaatattttctcctagtgtgacttttttgttgttcctgtgtttcagagaacagaagaagtttgtaagtttgatgaaactcggttcactttttcgtttttttttttgttttgtttattttgtatcgtgtcaggaatctgtctacctgaagatcataaagttgtttttttttttgttttcacttttaagctctgttggacttgagaaagttttgttttttgggttttttttttcatattctagaagttttgtagttttagcttttatgtttaggtctctgatccatttctagttagtttttatgtatgaggtaagggtgaagattttttaaaaaacttgaggtcccacacctgtaaaaagaaaggaaaaataacatttaaaactttgagaaaatttcttttttttttttgaggtagcattcaacaggttttggcaagtctgcagtcatctacatccagaatcaggctgtagaacaatccatcaacccaaaaagcgccctgtgcctgtttctagttagccccctacccctttgtggtttttatcctatagttttgtctttatcaggatgcccaataaatggaaccatatattatgcagctttttgcgtctggctacttagcacaacacatttgagatttattcatgtgtacatataccagtatttaattcctttgtattgcttaataggacagttgacccttaatcaacacagttggaactgtgtgggcccacttataggcaggaatttttttttcctcaaccaaatgcaaatggaaaatacagtattccttggatgcaaagcccacatgtatggagggccgacttttcatatatgcagattctgcagggtgaaaagcagggcttcatcacactcggattttgctatcctcaagcatcctggaaccagtcccccttgtataccaagggatgcctgtatccctttgggtggattttttccccccacttaaattgcatgttttatttcccccaatcccagcaatagcacagaagccccatcatatccaacccaaactggtttcgagtaggttaaggttatagggacacttgtcagaacgttgatacaaagggctcccaaacgctgggcacaaatgtgtcagcaaacagatggaagtaaacagtgcactggcccaaatgcttcatgagtcagtttgattttgcaatgcagtttgcatccttgaaactgccagtctggagggagacagggtagcttgagggagtgaagttgaaattgcctcctattagctcaccctttcaacattaaacagaccaagagagaaatggttccaacatttcaccacatctatttcttatgcagtctaagctgggaatgccatgtaaatggatcactgcgaaatgcagcaatttaatttttctccaatcaaaataagaaaaaaaccagtatgatctcacttctattaacttttgaaggtttacagcagttaaaatatttttacttctgtatatgaaggcttaaaaaaatttttttttttttcataaaatacaagagcaacgaatttcaccatcgagtaaaagtaaaaactgggattcttgtttaaattagtccaaagtggcatttaggaacttagttgtaggctgctgcgctgacaccatgacaaaacaaagtgtggggttgggtctggttttgtttcagttatcttttcaataaccagtactcatggataaagttctggaagtgtttcagttgtaaggcagggatctgttagaattccaccatgggtatgcttcttgggttggatgctggagggtgaggcacgttttgccagactcatgtctagtcatcaaggtcaaaaaattcattgtctcctccttggtattccattccctggaaatctactcggtactgcaggatacctccaattccaccaaatcctttcacaaaccgagacccgtcttgcattttatctgtgatcatttccaacatagctccaaattttttatagttgttagcaaaccattccaacaggggcatgctctcgataagctcatgttcctgtccggtctctttgtctgtgaaatgagatttatccttttcttgctttggagttagagaattttctccttttctgtgccttggcaataaagaacatatctcattatatccagattttcatagaccattagaatttctacagctcccttttccaaagtctttagtgtatcttcaacgccaaaacagtactttcgcgtgtcctgggtgatttcatcaaagtatcgttctattgatttcttttcttgaatgaatttcacttcggagaggacttcagtagataactcagtagcttgattgaatccattttcaccaccataggatatatcaactaattttaaaactttcgattgtaacctctgatcaaacatatcagattgacttagttcaaagtcagcagatccagctaaaactagaccagccacattcactttgtccccagaaatagctgcacagcagtctctgctactttctgaacatagttatgtcgcttttccatttttaaacgggcaaaacgcctctactgtgtttctttgggagatccacagtgaatttgtgcaggacttctcttgtgtttccttggagtgtgccaaaaagtgcaccactaccatctattacaatgaatccaaacttgctgtcatctgaaagtagtgctgtaagagcccctttatggaatttgttgtcacacaatacaatgacgtattaattggtttgaaagattcaaagtcaacgttgactttcttttcctttccttcttctgttacagttgttccacagtaaacaaccagaccatctggaggtactttgttataaagtttgagcctttgttgtatagatgtaatggctcccaggactggatggcggtttactcctgccttaatgttagatgcagttccaaactcatctgataacatttttgccactggtgaaatctggtctttgggaggaatgatcagtgatatcatgctagtgccattgctgcaggctgcctccaagctcctttttttttttttttttttgagacagctctgtcgcccaggctggagtacagtggcgtgatcttgcctcactgccacataagcctcccgggttcacaagattcttctgcctcagcctcccaagtagctgggactacaggcatgtgccaccacacccagctaatttttgtatttttagtagagacagggtttcaccatattggccaggcaggtcttgaactcctgacctcaggtgatctgcccgcctcggcctcaaagtgctgggattacaggcgtgagccacggcgcccagcccgcctccaagctcttaatgagcttcttgatcttccagaactccacgttcctgtccacagcactggggtcgtccaccatcttcttgcctcctcttccctaagggcccagttctgggcagcagcggctggtaggacaccggctctttctgaccaggcaactgcatgtgttgcagtgcgctcacatggggcccgtgatgtcacttcctccgccaggggcggagcacaaggctgcgggatgggtttaacataatttaggacatttggtttgtttccactttggggcaattatgagtaaaaccagtataaacatgcaaatacaggtttttgtgttgaccataaattttcgtttgtcttccataaatacttaggaatgagattgctgggtcatatggtaagtgtaggttaagcttttcagaagctgctgaacttgccaaattgactgcaccattttgcattcccacaggcaatgggtgagtgtataggttgctccacgtcctagcaagcactgggatggccaatattttttattttagccattttaattaggtgtgtagcatctcattgtaatttttaatttacatttccctaatggataatgatgttaaaagcatctttaatgtgctttgccatttgaatattttctttgttaaagtgttcagatcttttgctcactttcttaattggattgtttcttgttgttgagttatgagagtgaaacatattctggatatgggtcctttgcacatattttctcccagtctgtggcctgtcttttcattcccttaacaaggctcttagtacagtttttaattttgatgaagtccaagatgttatttttttcttttatggattgtactttggattttatacctcagaatcttcacccaactccaggttgcaaagatttttttccaatgcttcttctagaagtttgatagtttttacatttaggtctatgatttttttgattttggagacagcgtcttgttccgtcacccaggctggtatgcagtggcagaatcacagcttgctgcagcctcaacctcccaggctcaaatgatccttccacctcatcctccccagtagctggtaccacaagagcacaccaccacacctggctcattttttgattttctatagagatgagatttcgttatgtgacccaggcaggtcttaaatcctgggctcaagcaatatgatctattttggatcctatacatttttataggatacaaaccaagcttctctctcttctgtttttattttaaaaattttttgtagagactggtcttcctgtgttccccaggcttgtctcaaactcctgacctcaagcgatcttcgcaccttggctccaaagtgtggagattacagccatgagctactgccgcagcctctcttttattttttctgatattgacatccagttgtttcagcaccatttgttgaaaaagaccgttctttgttgaaaatcaattgatgatacatgtgtatagatctattttgggagtgtgcattttcttccattaatctgtgtctgtccttatgccagtaccacactgtcttaattactttagactcctagtaagtcttgaaaccaggtacatactttgtttcttcttaaggttttcttatttttttcttagagattaattttttccttttttttgttggtttgtaataagtacctatgttgaagtggactaaaaaaagtccagtttttatttctagtccatttttcagagtcacattctcatcttcctaatgtttcatcttctcatgtcactcttctgactggaaaacccttagtggcttttgaaagtaaatcttcagcatgtttttttaaagacattttcaggccaggcacagtgggttcacacccataatctcagcactttgggaggacagaatgggcggaccgcttgagcccaggtgtttgagaccagcatgggcagcatggtggaccctgtctctacaaaaaaaactcactgggtgtggtggggacaccctgtagtcccagctacttgggaggctgagacaagaggatcccttcagcccaggagttggaggctgcagtgagctctgattgctctactgcactccagcctgggcaaccgagggagaccctgtctccgaaaaaaagacacttccaaagtggaggagggtgatatttgacttttctcaattagtagtacctttctccctgttgagactacaggttccttgtaggtttcaatcaggtattttatactaactcttccacaattacacgtggagtaggacttcagttggtgtttgtggattcaaggtgttgatcataatttgggaaaggcttgattgaatatgggattgtggtacagaattgaataactgtttactgaatatgtatgtgatgggtgccaggtactgtgctttatatctgtgatttcatttaatcattatgatgcagagagattttgaggcccagagcgcttaacttcaagacacagctaggattcacaccacagtcatgagtttaaatcctaaacctttacccactctcctgtttcttcctttcctgtcctgtcctgccctttcctttcctgtcctttcttttcgttttttatagagtttcactcttgtatcccaggctggagtgcagtggcacgatcttggctcactgcaacctctgcctcccaggttcaagtgattcttgtgcctcagcctccccagtaattgggattacaggctcgtgccaccacgcccagctatttttttgtatttttagtagagactgggtttcaccagctggtctcaagctcctgagctcagtcagtccacccgccttggcctcccaaagtgctaggattacaagcctaagccactgtgtctggcctattgtgtttatttttaatgtgtttctccccattagaatttatatactgaggaaggggtttgtgtctattcatcaatgtattcccaggcttagaattgtgcctcgcacttaatagctgtttaacagatagatacttgagtaaatgaatgaattaatccatagtcagatctttgaaaacttgggattcagaatggaatggaatgttgccatgcttggaactgtaaaaatacagctgttaggaggtagagctgggagaaaggacgactggagagttaatcttattctacaaaagggattctgtctgtaactgatgaaactaggtagaggtttaagtaaatgtgtaaccgagctggagggaagaaacctaatagctgttctgcgggaatgtcatcatttagtcagtagggaggtagacatccagaagtcacagcttgcctcttgcctcttgcctctgcccagtagcttttcagtggtatctttttaagagagggtctcactctgtcacccaggctggagtgcagctttgacctcccgggctcaagtggtcctcccatctcagcctcccaagtacctgggagcatgggcgtgcactaccacaccctgctaatttttttttgtattttttttatagagactgggggggtctcactgtgttgcccgggctggtcttgaattcctaggcccaagaaatctgccagcctcagcccagtctccaaaattgctaggattacagctactgtatcctttcaattcagtggtactcattgagttctattctgcaggttgcattgatgtttgatttctttcattgatgtttcccctaaagttagagagctgcttctcttcctcttccttaattgcctccagtactttaaactctatttacctgaccttttccttgaaggttcctcaagccaggacctacgcacctgttgtgagtggtgttatagttctgcagggcgcacaggtgcatccccatgggcacatttaatttaggtgagtaaaatggagctgtaagtggctgagatcattttctgtaaggtgcattcatcttcatggtcaagtgtgtggcacccaactactgcagcatccagcaagagttccctgtaacactgagagcaaaggggagcctaatcaatatgccccgttggatttttaagtatatttaaatatttcagagataccattataacaagccacatggaatgaagttaactaaaaatgtgtttataactaattcaggaggaggaaggttcagaggagaccaggagggagtgtgggatctagagaacaaggggatagaacagcttttgtggaaggggagggtggctaactcttcctccggtgaaaacgtcagaccgtgtaaggcagacagggctacatgcccagctcaggagctccagtcactgtgtttgatgcatgtgcaccaaggctgggacactgggtgaatagaggatagcggcgatcgggacattgcgagtgccgtcctcatagctcagaagtcatagcatgtcttaatcatggccatatcctcagtgcctggcccatagtaggtgtcctttaagtgattatgaactgagttgctggtaggagctggaggattagggaacactctggaggcgataggtgataatagttgaacttgctgcctgagggcagtggttcctaaacattgaactgtgcagctgaatcacctagggggcttgttcatacttccattctggaattgcgcatccagtagatttgagtgggactcaataaattacatttgttacaggttaccctgtagtactaagctgctgggcccacactttgagaaagaattactactgttggaggcaaggaagaagccactcagtattctaaagcaatgggacatggagggatagaccttagcttgctaagggtcaccagcccacatggttgtggaattttctgtagctgagctcaataggctcacaaaggcagttgattagattaagatcatagaggtttgtggctgggtgcggcggctcatacctgtaatcccagcactttgggaggctgaggcaggcagatcacaagaccagggatcgagaccatcctggctaacacagtgaaaccccatctctactaaaaatacaaaaaaaaaaaaaaaaatagccgagtgtggtggtcggtgcctgtagtcccagctacttgggaggctgaggcaggagaatggtgtgaacctgggaggcggagcttacaatgagccaaaattgcatcactgcactccagcctgggcaacagagcaagactctgtctcaaaaaaacaaaacaaaacaaaaaaacaaaagtcatagaggtttgttgaagggccctacagaagggaaattggagacttcttacaaaagagtagtggaagatttgtcttggggcttatactgtatagggaagaaagaaacctggtggagattggagattcaaggtcatggtttagtatatttctaaccttttcgtctgtagccaccttagtaagaaacacattttacattgtgacccagtaataaatgtatgtataactgagatagaaggttcataacacctttcttgtttgcagtccatgctgggattcctatttcttaaaaaaaaaaatagtatgggtcatggctcagtatattgacttcatgaatagttaggccacaccactgatttgaaagcattgctggtagagatggtttggattagatgatgagaatcagaaagggagaccactggggaatactgtgtattgattgataggtgggaagaagggcaggtgccagaggaacagcagtctgggtggtgaccaggcacttcttggtgtgctcaggaggtgggttgctgaagttgcatggagaggattactggtgcaaaggccagtgggctttcaggcccactgttagcttgtgtccatggtcatcaaagccccttaaagttatgttgtgaatttgaggtggtgaaagcagccctggaatgggttgtgtcctagatgcattacatcggttctaatggactcccccttctgcagaatgccttgatagactagttaatagattgaaaatctggtcttccccatcatatcccaatgaacaagcaatgtataaactgggaaaatgctgggcttgtagggagtcggtgggaggggggacagaccgtggctggagtgcagtggcacgctcaacgcacactgcagcctcaacccttcggctcaagcgatcctcctacatcagcttcttgagtaactgagactatatgcacacatcaccacactcagctaatttttatattttttttgtagagatagggttttatcacgttgtccaggctggtctcaaactcctggggtcaagcaatccaccggcctcagcctcccagagtgctgggattacaggcatgagccaccacaccgggctaataagttattttttaggagaataagcatgataacaaagtcaatattaatctgaaaacttaaaataattctgtaaacagtgcctattttgcagtaatcatgaggtataagattgagtcaacacccctgaaagtacaccttctgtagtgaaaataccagctgagaaactcactgtgccattttatcattggaaaaaataatacaatgctgttccctgataaaagctcagaagaattttttaaaataatttttatttttaaaagttaaggtgggttttggtttggaggaagagtatttgacagttaattgtaggaattgagatactgccttttaaaccatttatagtaatttatgtcattaaatgagtgatttgtgtttgaggataaacacacatctgagtatgggctacttttccatttatttgggatcactcctgtgtagttttcatgtaacatttttccaaagagttgatctggagtgtgagattatcttcagcaagcgagtaacagtgtttccagacctgaatttgctaaggacaaaagccaaagtaaatatatgaagttattgagagaaaaaggttaaaggtgatcacagtagagatcaccaatgcctttttgtggttgcaaacaaactagaaaaacctaaccaaaagatctgaactacgtctccagaagacactccttaaagccagaaattacaactggaactgagaacacttgaaaatgagcggtggggtttatttatgaagattcattagcatttaatgctgacttgtcaagatttcaacactagttaataatagcactttttaatggaaatggcaaaaaacagcatgttagcaaatatagccttcctatcccttctggattagttaaataattaatgacctcaccttggcgggagagccccagggaggagagacccaagggaaacgtagtttttctccagtgccacttctgctaatgaacagtacctttctcctagggccagtctgattgaaaatccagtttccaccctggaggaatacgttttaaattctggtatcccagtttactattcatgaaaacaacagttggctgtcaacctgcgatgtgattttggttagactacattgtctgttaccggaatgattacttatgttttcaagtgaaatgttaatttagcctgtcaaatagtgtatgcccattgtgatacaaataaggagctcttctctcactccgtttttgcacttgatctcatgctgtcttgtttaatgtgtgtaactttcttttctgttcaaatgtggcttcctgaatttcacgggaaactcctgaggctcttttcccccgtcccttcactcccgcaagtcaggttgtcgagacttggccagtgccagttcagaggactgtctgatccaggggttcctggttgcccagtgcttggggagcttatcccatgtatcatacttagcccctctttcactatttttagtccagttctactacacaaaatgttgcaaaaatctttttaattatattatttccttttttctttgtaactcttgcccatatctttagggagaaaatgatcgctttctttcctttctttccatttgtaagcaaaacaaaaaccccacaaacccttatcctacccacataagggtataaaaagcccactggagtccttagaagtaccttgcaaaagcccttaagaagtttgttcccttctttctttctaattaaatttcatttctttaagcagtagcattcagtgtaaataacagtttgttttttttttactccttctaatttttcagtttcaataacatgagaggagttttcttcttgctatttttgttacctgaagtagttctgctgtattttgagttaaattctcctttacaggctagcatatataacatggtttcttttcaacacaattcattttaaatttgtggaattcttaaactattgtattcctatatcacaggcaagcctgtgattaggtaccaataaatactaattgaattgtttcttaatttctgttgaactgtgttttgtatttcatttgtataaaattgagatcttttgtagtatctaaatggctaagagtgacctttggagatctacgctttaatttcgttcatttgttcagaaatctcaatgtttacaatgtgtcggctggccctgtgctggcttcagtggagtgttcactaaatgaatatcattccaaataacttaataaaacagtagctatgagaatgacttttaaggaatgggtactaccttagggtggtcttgaaggtttctctgtgaaactaacatttgagctcagatcagaatgacaaagatgagtcatatattcagagatgggggcagtgggggttgctagagtaaaggggccaaggcaggcaggaactccaggagcagaagggatgtgactggagcctcaggatgggttgtcgggggctgttggcggatgaggtcagagtggtaaccagagcagggatggcctggtgtttgtgggccacggttagaagctgggaatttagggcaggcgcggtggctcacgcctgtcatcccagcactttgggaggccgaggcgggtggatcatgaggtcaggagttcgagaccagcctgaccaatgtggtgaaaccctgtctctactaaaaatacaaaaaaaattagtcaggtgtggtggcgcgtgcctgtaatcccagctactcaggagggctgaggcaggagaatcgcctcaacccgggaggcagaggttgcagtgagccaagattgcaccactgcactccagcctgggtgacacagcaagactccgtctcaaaaaaaaaaaaaaaaaatgttgagaatttattctaattgcaatgaggattggaagcagagaagtagcgtttaattttcaaatgctcatgtaggttgctttgtagagaataatttcaggtattagtaattctagagacattttgaactgtattgggctgcggataaggagtaaataggtctaccaacttgtggcctttccttctcagcaacccctactttttttctttttttttttttataagacagagtctcactctgttgcccagagtggagtgcagtggcgccatctcagctcactgcaacctccgcctcctgggttcaaactatcctcctgcctcagcctcctgagtagctgggatcgcaggtgcccatcaccacgcttgggtaactttttttgtatttttagtagagacaggaccaaccatgttggccaggctggtctcgaactccagacctcaggtgatccacccgcttcagcctcccaaagtgctggaattacaagcatgagccaccacacccggccagcaaccactacttttaagccaactttttaataatttaaattttaaggaatgcctttggtgtgaaaacattgtgcaactatacctatccatagtttggaggagaaacaagcataaattaaacccagtagtgtaagatgggtgttaccatgcctctccttcactctcactgcacgtcctgttgtgatggagttaagtatgccaggcatatacagcatgtgtgtaataatgctccaaggatgcaagagagaaggaagggtttggaggtgaaattagggagagaccacttcctcattcctggtgataaagtcatctgaactatgcatctcatgcgatttcttcacagggcatgtaccctgttctaaagtcctccagtagacattttaggtagcagaagagtgagaagctaaggctctagttgttgatttattaacatacaagttcaattattggcgattttgtgaaatccataacatttcttaatttctagatactgctaggcctttcatactgaatgacataggatttctagcttcaaaggagtttttaagataaagacttatgttacatattttcagattaccctttttttttttttgacacagggtcttgctctgtcgcccaggcttgagtgcagtggtgcaatcttggcccactgcagcctctgcctcctgggggcaagcaattctattatctcagcctcccaagtagctgggattacaggtgcccgccaccacacccagctaatttttgttaattttagtagagacgggatttcgccatgttggccaggctggtctcaaactcctgacctcaggtgatccgtctgcctcagcctcccaaagtgctgggattacaggcgtgagccatggtgcctggccggattactctttttaaaagctgtacttggtaacacttctaaccgtcatatatgaatgaatacaacgaaactaatcattttaattttcatattaaaattaaatagcaagattccaagaatactagaggaaattagcttactttaaaccttttagattatctttaacagaatatctgatgtgcttgttggtcagtaatatttgttaatgtcacagacatgtttactttgtaatagcttaattgcataatatcctcatataaagcaaattaatgaaatttatttcattttttgaaattgctcacatgctaattaaatgaatgttttctgaccctgataccttcagtgtcttcatctattaatggttttttaataaaacagcaaaattaaaaatttttaccttcatatgccaacacacactaagctcttgttctcttttatagggaaatcctcattgacgattcaatttgttgaaggccaatttgtggactcctacgatccaaccatagaaaacagtaagtattgttttcaagtacttaaaaactgagaagccttcttttgtgtaaaatagccattgtgtattcatggaggctttgagtgcaggaggtaaattctgtgtgtctcccaattggggtcaaagaaaacttgcaaaagatttacctactttaccctgaaagatttttccttccatgtctgcatcccctgccatctagaaattattaattcaagtcagtaggagtctggcccattactggaatcttcaaattccagaatctgctccaaaacaggaatggagagcacagtcttctcccccacaccccctttctcccagccattgcagtttccagggattccaagcttgaaagaatgaaaaacactcgagatccctgttccttattcttacagaagccgtactcccacccacatttctctatacccttctttccagccctaaagatttgaaagagaaatgaactattctgggattggatagagcagttgcagcattaaaaagaagttggctcaaaaagcctgttgacattttaggccatgtgcagaaaaaagcagggaagacagaaccagccatgacctttactttgttcaattttaatccatggtttcagaatattcctgatggattctaggaccatgagactatttatttattttattttattttttaaagagacatgagtctcacagtgttacccaggctggactcaatatcctggactcaagtgatcctctttcctcagcctcccaggtggctggaactacaggcatacaacactgtgcccagctttgagacagatcttgattctagggatcgccaaggataatctgaagcagggaagctggtcttttcaggcttagaaccccaggtgggccctggaactaggtttctcagattcttgagaccaggacttatctaggatttgtcaccaggaacatgtagatttaaacatgggattcatcaacacctgattggcatattagacacgaagcatatttcaccggccggaggcttgcaagagaatcacttgaatgctttggctgacagtaaagagcttggcaaacgacagcctgcaggccagcaaggcccatttcctgtctttatacagaccaagagctaagaaaggtttttccatttaagcataatatataaaagtccaaagaagaataatgtctggcatgtgaaaattatatgaaattcaaatgttaacctctataaagttttattgatacacagccatgcttgttcctttacatgttgtcctttacatgctgtacaatggcagagttgttgaatagtaagagcagagaccaggtggcctacaaagcctaaaatatttactggtactgtctggccctttacagaaaaagtttgctcacccctcgcttaaaatatttggctgtcctttgtgttccagtgtgctggtagcagagaaggaaacctgttggttgataaactaactccaggaatatttttgaaagtaacctttcaagatgttatatttgaaagtaacctctgggtatctacagggaggagtcctgattacatcctatgatttgtctagctggtcattatataatagtaagcaagtgtgaggagcagattaatgtgagtgctggatgaacaagctcggttttctgtccactggaataagaacataagaaaatcatcatcttggaccttaatatttgctatacaaagcaatttaggattttagatccttgaaataataaggttcattttggaattgtattaacagaacaatagaagattgttttcttcgtaagctctgcctctaaaagtggatattgtggctgtatcctcatgccatttcatactgagctggaattagctgggcgtgatggtgtgtgcctgtagtctcagctgagacaggcggatcacttgaacccaggagtttgaggctgcagtgatctgtaatcatgtcactgtactccagcctgggcagcagagcaagatgtggtctcaaaagtaaaaactgagttggaaggaaagtcatggagttgtgtatcatggagctatatatacatacattttcttagtaagtaatggatcagaagaaagtccaacttatgtaacttgatgttatctcagaaacagagtaatatgaccctacttttttgaggctatcaacatcatctttggtcatattttaaattttttctcatcttacagttcaataatgaagacttctttacctcaaaaatgaattcagagtacttgtttattaaagtctgtaggcaggagcagaaataaatatgaatatgtatccattaaaagttcgtgaggcatgttcagacattatattctacttaccacacttctgataacctaacacagggcaggagcccttcgcccaccctttcctccactgtttggtagaaaaacattgttcagtgataacaatgaattagaaagaaaagaaaaggttatcatgaacttgttgctagcaagataaataagtgggtggtttcatgattttaaaaaactgctctgtagatctggaaataatttagtagttattttacactttataatattagaacaagctgttatagcaaacactcagtggtgacacatttcagtgaagtgtcatggtgagcaaaaattctgggactgtgtcatctttaacagtaggggtgtaggagaataatattaataaaaccacatattttctagtttggggaaattttaaagcagaagtactacttatgcaagtgtacttcattatctactgtagtgttaatctaacaactcaatacaaactaaattgataggctgaaattaagctagtggtagtttataactaaaaagcaagcatagcagcaatttccgacttctgccatctcaaggtagcactgttagtgaatgacaaagcgccttccagaaagttgggaggttgcacttaggtgttgcagcattctcaaggcactgcgtcctgggtgtggacttctcagtagggtatgaatgaagagccctcaccacactttagtaacacaaatcttgctttgtgaacaccaaattttggaaacctctatgaccgtggttagtagcatttactagtaaatagctattagtctacttaggagaatttcaggggtttaggttggaaatggattctctggtgattcaaagaggcagggagaaaggggctcaaggagagtgatgtcagaagaaagccagctttccactttgacatgaggttaaaatgagagacagtagaattatttccgagtctatcctatctcttattatacctcccttttttctatagtaaaaaactggcagttttcctatgacagcaagatggaaggtctttttcattttactgctacaagtaggacaagttacattctttttacatgcaaagatagatgcaaatgtttatttttttttttttcttttatacactatgtacaatgacatctcagtcttcttggccgaatcttctgcatttttttgacttggcaacatggggtgccctggttcaggcctttcctctgcacttgctctcaagtaatcttcccctctcttcaatttgctattgactcaccagtgtgtattctcagccgcaacctctccccccagctctgggctttattttataatttattttattctacatgacaaggtctttcactctgtccttcaggcaggagtgcagtggcatgatcatagctcactgtaaccttgaatacctgggcttaaaatgatctttcctcagcctcacaagtagctaggactacaggcgtgagccaccacgctggagcagtttttccatttttgtggagattgggtctccctgtgttgcccagggtggtcttgaactccaggcctcaagcagtcctcctgcctgggcctcccaaagtgggattacaggcataagccactacatcctgggcttttttatttaactgcctgcatttccccttggtatttaataggcatcccaaaacatccctaaaacccaactcatttcccttcctctcctatccctagtattcttcccctagtctttcctgtaagtggcaacttacagaagctttggagtcatcctgactcttcattttcttacatcccacttccagtcaatcagaaaatccttttggttctgcctctgaaatatttccagaatatctccacctctaatccaggccagtgtcaccctctatagattgtgatagtctgtacagtcatgtggtcactgtatcatgggctcctgcctaatatccctgggaccatttttgttacttacagcgtagccagagtgatctttccttggtttctcctcacattcagagtaaaaatcccaagttctgtaggaccttctgcctcctgtccatcctagttagctatctaccgttctctctgagctttagctgcattgacttttttgcttttttcacttgctgtttaacctctgcctgggtgttccactcccagggaagatacccgacagggtgggagggtacatgtgtgtgtctataccttctttccttccctgggatctaagctcactgagtatcagagactacagcatcccaagcacccacaacagtgctactggtgataataggcactcaagaaattgttcttgaatgaatgaatgaatgaatgatgtttcctttcagtaaccttgtcatcataattatacttgataactgcagttacttagttctaattgaaggtcactggttttattgctcaccagtgtttcttacatacttctcatcaaatctgaaatacacttcaatctcacgtgactgaaggttttcacacagctatgtagtgactgcaccctggctgacaaggactgaaacctccagcggtgcaggatgcatcccaagttcagagagaataaggtgtaaaaacaaatctgaattctttcttagaattgatgaaataggttatattgggtatccccccagcttgaaatattccgattcagtttccatctgatttaactgtttcctaaaagtgataacttccggaacaggtacaagcataatatagtgtggccattgatttcatgctgtggtctgttatctttactcacctgacttttggcccccctgcttgtattagaaaagtgtgacgctaatatggttctctgtgatgattgcttgtctttcagccatcatttctttccctgtggaactcatataactcagataagatctctgatcaatcctccttattacttagagttttctcacataatttccatttgtctgtgtcagctttgcctttctgctgtgggtagagtgggacctctctcagttgtatgagggatagattctgctgcctggctctagtcatataggacggccaatcaggagattggaggactcatggtgagtcaagatggctggggcgggtatgcaagataaatctgttccacttccttgtcagagttccaggtggttatttttacattgtttctgttagtagttctttcctcttttgtctatatttgtttgaagtctgtctccctctaattctgaattgacttttccggaagttattcaagtctgattttctttcctcccttgtcagggaaaagaagttgtgacaaattgcttggatccttaagcttaagtgggaaggatggcttcaacacagaacatctgtttcattgctgttttatccgtcagtaaaactgttacttcttttatgtactaaaagttcttagcacttaactaatattagctctttgtgctctgatgccagacttcctataaattaatggaaaatttttgtggttttggtttattctagacctcagactttacgtagtatatttcactttttcacaagaggaaggatttgccacacagcattcaaattactattataggatatgaattgttgcgtactttgtctctttgaaaaagaatcaaggtttaccaagcttgattttagccagtcaccgtatttcctagctaaataatggaagtaggggagaatctatacaagtcagagagttgttcttttttgtttcatggggcctttctctgagactgctagggactctgtgcttgattggttgtcattgttcaaacttcaggtggtttcgagttaatttttttaaactaatgtttaatttcctttttccctgtagcttttacaaagttgatcacagtaaatggacaagaatatcatcttcaacttgtagacacagccgggcaagtaagtgacctctggtatctcagaatcttatacagcatatctgacagtcttggtcctagcactgatttttaaaagtaccagctatgccaagaaaacccctcaggttgtgtgcagacagtccctgactcccaatggtttggcttgcagtggctcgacttaacaatttctcatctttacgatgggtctattgaggtatttgatacattttcaactcatgatatttttggtttacagtaggtttatcacgatgtaaccccatcataagtcaaggagcttacacagataactaaatgttagtatgctgtctacttggtcttttctaagacatttctggcagttatcttttaataacttgtttttctgctttagaattgctttaaatatattaacattgtaagggttaatacttattacaggatagtggttttctattttctaaactttaattctatattagagagtcatattagttgctttctttctctttgtgatatgtgttctcctacattagggcaaaagtacatcttttctagaggaaaggcataagaggggcatagggcagaaattagctgatttaatcttatgaggacctgggccataaaataccagtttgactggagtccaggctctggtttgagtgttggctttagtttatatagtagagtctctgggtgggtggatttgagagtgattactagattagggagtttcaatttatttgatagacagtagataatggccaaaagtcaaataatccccccagaaaggatattcacatgtcggttaatgtagcagggatgtgtggaatggatcaccagggaattggctggaagcaagggggaaaggagtacatgaaacaaagaaaagcccttttgacagcttagctgccccattaccatgacatccaggcctgcttttactagaaactattctgtaagactgaatttacccttcttcactggagggtgaggaatgtaaagaagctgggatttcagctcctaactcctgcccttgcaacatttttttgagacagagtcttgctctgtcacccaggctggaaggcagtggtgctatcccactacaacctgtgcctcctgagttaaagcaattctcctggcacagcctcccaagtagccgggattacaggcacaccaccacacccggctaattttgtatttttagtagaggcggggtttcgccatattggcctggctggtcttgaactcctgacctcaggtgattcacctgcctcggcctctgaaagtgctaggatgacaggcatgagccaccatgcctggcccgcccttgcaacttataatcaaaggataagagtagcaggagggtgagtgtagtgtgatctggtttgctgtgttaaatgggggctatttttctggaatctggggaaattggagtagacccagaataatatgacctgtcctgtgggtttggaatgaattccctctgctttgcattttgaagtaaacatagaaggaaagtgtgatgccttagtgaagcaagaagatagctgtattgagtgatgttagcattggaggaaccctgaggtttccattttggaagcttggaagaaaataaatgtgtttggctctttgagcttgtacacagagctatagcatgtgcctccttcactcaccctacacactccctgctggtggtgatgcagtgtgctttagcagtcagattcttgatgctttcattagagcagagccatcctaggctttcaccccctgatacctgtcctcttgacagaagaataggagttggggcttatatggaccaggggagcagtagaagtctctgttagggggtcgggggcatggcacagatgacgaggctcattagaaattagtagggaagggaagagccgcttgagtaggaaattgttttggattgttgggttttgtatctttcttttatagttgactatataatttattgcctaaaccaagacactttcagagttgtgggctgggggtgctaataataattatgttgggacaacagtgtaacttagaatgtcctgggcaaagaaatacagctgttctgtttattgtgggactctgacactatcaagacttcagtttgcttttgtatccttatttggaatctcctttaagctcctgaaaactggtgatgagaatgtaaattgataaatcactttcatgtaatgttactgtggaaacacgttttgtatcaggcaattcagggaaccagtatttcataactgtttggagtgtgggccctggggttacacttgcctggatttgaatcttggtttttgttgctaacccagtaaccttaaggaagcgaatgagggctgggcatggtggctcatgcccttaatcccaacactgtgggaggtggaaggatcacttgagcccaggagtttgaggttgcagtgagctgtgatagcaccactgcagtccagcctgggcaacacagcgagatcccatctctttacataaaagggtgaagaagtctttctgtgcctcagagctttatctataaatagtgataactggcattgttgcaggattgtcacattggggttaaagaggctgtgctctttctttgtagaccttcaatgctgctgaggcaagtgtgacgccagcatattaactgtgttgacaggctgcatggtggaagtgcacatgttcttaatacttggagagctgtctttgaaaagatttctctaaagaataaatttctttatactgactacttatcaagttggaatatgtgttcctctggggtactgttttgccctggaacataaatgtacactcaggtatcaaacaatttaaaatattttagtgatgtagtaatacaaatagtgaaaccaaaagcaccagtgtttaggaagagtatatgatatgagataagacaagagcagtggtcatattagcagccctgttgtcttgccccttcgggttatattacaactgggtaagagtatttggagaatttttgcacaaaatatatccaaatttggctactttaaattatttgtagtcattgcaactagtagttcttgaaggttatatttacagttgagagacaataaattaaagatgtgctctttatttacagctcaggatggtggcacacaggcatgtcctgccgtggtttcacccttcattctgttgaaaactggatgataacaaactcaggtgtttactgctccaagagctgctttataaattggatgcatacgggggctggttctaggattaagactggtagtagtagggtaaaatgattaaggggcaaattcttttaaaagtaatctatagtaaatttgttcactggcttccacatttcaggagtgaaattgcacgcagtgaattgctgcatagcggtatttgttagcaagttctatttactacttagtagtttatgtcggtacatccataccactatggtttaatagtggtttaattgcccacctaggaatgatgatgaacatggttaaatacagattatttttagattgcatgaaatattttggttttgcccaattttagggtgagaacatataccctaaatgaattttggggtaagaatgtgaagtatcaaaaaaaaaaaaaagtagcctcttctatattaacctatttatgcctggtgttacattattggaacgttaagcttgtgggagttatttatatcctactgctcaaggtcaccaaggtctgatttttcatgaaaaaaaaaattttgcaacctccggcataaatgggttaataacttagattcacacctgtaatccccgcactttgggaggccaaggcgggtggatcactttaggtcaggattttgaaaccagcctgaccaacatggtgaaactctgtctctactaaaactacaaaattagccagacatggtggtacatgcctataatcccagctacttgggaggccgaggcaggagaattgcttgaacccaggaggcggaggttgtagtaacccaagattgcaccattgccctctagcctgggcaacaagagtgaaactctgtctcaaaaaaaaaaaaaaataattaataataattaaaattgattcaatgacaatccatcttataatgtaaccaaatttgcttttttgaaaattgagtttaatttttaaaaaataggtgtaatgcgcatggtacaaaaataaatagtgccaaaaggtgtaaatagtaaaacttaagacgttcctaccctagctatctaaccccccacccccaccagcaaccacatttaccagtttctagtatatgcctctaggatacttgatacatgaatatgcaaatatagttttaagcttgggttttgttttgttttttttcctttttacacaaaaagtaatacatctccctcttggagattattccatatcaatacctatggcctccttttcccccaaggctgcgtaatatccagttgttgggatatatatcctaagttaactgctgatcaacagttagactgttgctggtcttgctaccatcagcagtcccttaatgaacatcccggacgttgttttagacatagggtaataatgcacataggaaaacttcctggatgtgggctatcatagggttacagttcatgttcttgccagcagtgaatgagagtgtctatttccctacaccctcaccagcactatgtgttagcaaacgttttggtacttaccaatctgataggtgagaaaaagcagtgtacttttaaaaatgcagtgtacttttaataatgcacttttcttcttaggaggggctttgatttttcctatgttagaagatgtttgtatttttccccctatgaattatcctgtctgtgtacttggccattttttttctattgggtggttggtctttgcgtgttgatgtgagattccccttgatatgtgaagaaaattagcgttttgtatatgatctgagatgcacagttttgttttcagtttgtcttttatttatggtttttatttgaggggtttgcagccatgaagaactttttcacatagttgaatttatttattaatctttttttttttttttttgagacggagtctcgctctatcgcccaggctggagtgctgtggcgcgatctcggctcactgcaagctccgccacccaggttcacaccattctcctgcctcagcctcctgagtagctgggactacaggcgcccgccaccacgcccagctagtttttttgtattttgagtggagacggggtttcactgtgttagccaggatgatatgaatctcctgaccttgtgatctgcccaccttggcctcccaaagtgctgggattacagacgtgagccattgtgcccggccttattaatctttttttaactgataatgtattttaagctctcccatctatcatacgcatcgttttcatctttaaatctttgcttcctctggaatatgtttttgccaaagtgtgaattggagttccagcttagccattcatcctcaggtggctctgggcttgtccctacactcagttgagggttacttttggtcctcactgattgaaatgccaatattatcatgtacctcattctcatatctgtcaggtctttctggatttttcagtctgttctgtttgtgagccagtacagtattacttatgagagctttatgatttctactcagctgccctcccaattgctattatattgttatattgctattattctttctcagaaagtagactttaaaggccgggcacagtagctcctgccactgcactccaggctgggtgacagaatgagactgtctcaaaaaaaaaaaatcagactgggtgcagtggctcacacgtgtaatcccagcactttgggaggccaaggcaagcggatcacctgaggtcaggggttcgagaccagcctggccaacgtggtaaaatcctgtctctactgcaaatgcaaaaatgaaccaggtgtggtggtgtagcctgtagtcccagctactcaggaggctgaggcaggagaatcgcttgaacctgagaggtggaggttgcagtgagctgagatagtgccattgcattccagcctgggcaacaagagggaaactacgtctcaaaaaaaaaaatcagaattatatcagctgggggctctttcctccattataccttctaactggtagttttttactcagtgcttcttagacataacttcttttttctatgtttccacagtttccctttagggaaaacagaattttaactttgaacctactctagctgagctagtgattaaaatcatttgggattttgtttttaatcttatttattatatcaaagaatttataataaaacttaatttttcttttctttttttttttttctttaaagaactttaccatagggcagtaattctgggctgtcataaacagtggttataaccatactataagtttacaaaaataatagactgctgcttaatcttctggtaccatgatgtgatttttccataatagtgcttaggacatgtgttatgttgacaatttagtttcaactaagaatgaaacgttcgtaccagacagtggcgcgtgctgttgaaaactgcactgacatcagaactttctgtatgctttaatacgtatataaagcaaagtgtcataacgctgctttataaaactaaagactactgtgctgttgcgtaataggtacctttctctttaattcctagagttgctcagtaaataactctcttggtccccaaaagtctgaatacctcaattgaacctggtgttttgatcctcttttctctttctctgtttctctctctctcccccacctccctccctctctccctctctccttcagatgctgatggcacccctctagcaacctgtagactgaagctcaggtcattgtgactgacatgcagagaataaatcaaataatatgccagtttcaaatataaaaatacagatttatgggataaatcagcaggatttataaatgtcctgaggtctagaaggttctggagttagtgatgctcatcccttgttttgagatcacagagccaatgatttttgtgttccatccatcctcttctcccagaaattatgaaggtcatcagactttcccctaaagttctagaacagctagtcatttttaaatattggcttgaaccacattatcacctccaggccattcttaaagcttcactttgtaggctgtttctggcataatattgtaatccactctgcgtctactttgatttcttcaggtaatacatgaaaaactttgggtaaagtttgtttgtgatgctatatgaagactactcaaagataattttttttccccacaggatgaatattctatctttcctcagacatactccatagatattaatggctatattcttgtgtattctgttacatcaatcaaaaggtaagactcctgctgcctgcttgagttgatttgctactcatagataacattgatccttttaagggactgtgctggaattattaatagtgacaattagaattattaggctacatgttttttagtgattttctcgtggagcaactggattgctgggaaacatggcccactagatgttctgttagttacaccaataggataaaaggctctttcttacctcaagctacctagaaaaacagtggttcagcatgatctaagcttttctgctaattgaaatgggaaatgcctaaattaattttactttgtgtgtgtttttaccatattaaggtgaaatagactttctaataaaatgtgggggtttgggtttgttcaatatcttatcctttgaatttatgaaataagaccttttggtaatagagtctgactttactacataaaaacaaagccactatttttattaataagaatggatatcggttcctctagctacgtatttcatgtctcctcttatcgggggatggcatgtattatcaggaggagcagtggtctgtgtctgttaacagaacagctggctgtatacagcagcggagctctgggcattggtgacagcttatgtttgaagactttatgaaaatatcagtgccagtggagggcgtttggtggctacgtagcatctattgagtgtgtgcgacatgttagggagtttgctactctctttgcctacatatgatacattacttatttcatcattaccttaatccttcatcagagatgttttatatcccactttacgtggaaagaaactgagtgacagagacctaaagcagcttgcccagggctacataatgacattgctgggattcatagccatctctccagttccacagtcaaggctgacactgtccaatagaacttactgcggtgatagaagtgtttgctctctgtgctgcaggtggctgtttaactaaaaatggaaaattaagcctccctcggttacagtagccccatttcaggtgctcagtagccacatgtggctggaggctgccatgttggccagtgtctgggttccttacccccacatactccactgccagtgaaaattcagtctgctgctctgtgagtgtgttgtttaacatttttctccgtggcagagaaacatactttagggtgttgagttctagctataaaatgtttgagtaccattctcggccattcttataaacagaccccatactgtcaatccccgagaaagtttacacctgaatcaaaaccaagtaccagaattatgtgttccttaaggaaaattgaggaactgtgaaaaatagaaagtgagggtaatcattcttaatctaattacctaagcatagatactgttaatatcttggtatatgttttttctggtctttgttttagtctgcatggattgttttaacatccttttatttgctctctgaatgctgttttatggtttatattttccatgtttttatatttttacttaccatgtaatatatatttttccatattacctagtatttgaaatagtaaatggctttataatatttcatgttcaatgatagatggatatctctcttcctgtttaatgtatttatttatattgtcactgaaagcaatgcttggattggattttatgcttaaaaccactgtgtacttagtatttggaaacatgatcattttcttactgacttataagagcactttaaatagtaaaactattggccatttttatacaaagatttttttaatttcagttgtatatttttaaaatgtatatactgccacgtgtaaggccttgtccagaacaaatttagtgtaccaataatctaatgaatgttggaagttcatgtttgtttatgaatttccattattttactaatttacttgaaaaacatgattcaaagattgttttgttgttggtaagtacaattttatcctagctgatttttagaaaacagtgttggtgttactttacaaattgttactttgaggcattaaagtagtaggtagaaaattttcttagtgcatccactgattttttttaagtctcttttttggtgtgcacaaattagatgacattatagaatcaagttgaaaacatagcatgtgccactggggaaattgaaaaatacattgagctggattaaaaatatgaaagtgtgctcaccaaggaccttatgtatttgagaaaacactggcctagtgcaaagcagaggacaaaaagcttggtactgtgtcttctcagtggcactgttgcaagttttgaccaagtttctccttactaaaatgggtgtgttttcttttgttatatgccttttacctcagtaactcatagtttaatgagcattctcaaatctcaaacatgagtgtgagaagagtggtgttttgttttttagaaacctatatgctgaatacacaaatatttatgaatatacaagaaatatgtcagtaaaactttctgaatcaaccagtttgttgatcagaattgtctaatcctttttattgaatttaacctctatctaaataataaccattttcattgtttgtgaaataaaacagaagtctcacattattcctttatatcataaaacccctgtagaattgctctttctgagtaaataaagcgaaaatacatcctatttcataatttctagaaatggaaaaaagaaacctgcagttgagagatgtgagatttgggttttcatttatccccactaacaactttggacaagttacttcaccgtacctttgtcgcctgtaaattgggtatattgatataggagtagatctctcctatctgaggcagccgggttacttactttaaaacattagttaagggccaggcgcagtggcccacacctgtaatcccaatactttgggaggccgaagtgggcagatcatttgaggtcaggagttcgagaccagcctggccaacatggtgaaacctcatctctactaaaaatacaaaaattacccgggtgtggtggcgggtgcctgtaatcccagctgctcgggaggctgaggcaggagaatctcttgaacctgggaggcggagactgtatcatgagctgaaatcatgccattgcacttcagcctgagcgacaaagcaaggctgtgtctcaaaaaaaaaacaaaaaaacaacactggttaaagggaaaaaaaatcggaaaggtgatgtcaatctccagtgttttgttttaaagcataaatatacattcagtcactcatcttgtgaaattttcaaattgtcatctttgaatatgagttcacccactgctgttcagtatgactacatccacgatttgtccattatgacttctggttcggtttcttccgagtgagatgcttgggaaacagtctacacctcaactatttagattgctgtgattttccccaccagtctttttcagttggtttggcacaccttattaaggagcaccgtttttagtagatcaactcacagtattcaacttctagttttcagacaaacaaaactctgtctacacatacttcaaaagtttgcaacataaattatgactatgatgaatttaactggcataagtgggtttgggaacaaatggggctgttttaaataatgccttttttttctagtagctcgtagtttaatcagcattctcaaatttgagacatgagggagtatgagaagagtggtgttttgttttttagaaatctgtatgctgaatacacaaatatttatgaatatccaagaaatacgtcagtaaaactttccgaatcaaccagtttgattcagaaaatcagtgatctcaagaaatttagccacttagaacagtacacatttatgatctcacagtttttgtgggtcaggaatctgggtgtggcctagctgtgtcctctgcttcagtctctcagagccacagtgtgggtatcagcaggggctgcagtcccatctgaaggcttgcctgggggaagatgtttcccagcgtgttcacgtggctcttgacagggttgagtttcttgcaagttgttggactgagcttcttagttccttgctggccgctggcctgaggctgccctctgctccttgccaggtgcttcacttcattggggcaggtgcacaagagagccagggaatttcctgcatgacaagccactgtcttttataacctaaccgcaaaagggacattccatcacctttgccatattctgttcattagacgcacgtcactaggtccatgcagggagatgacacacagtgtggccactaggagagcaggagatctgggagccggctccaagctgcctgccacacagtcctagttctttcagctgtttctcacgtgacagggtactgtatttttgcccaagtggcgacacttttaaagataggcaaatacagcatgcggaggaaaccgtggttctgtaatgcaaccgcaggtccttaggacacccatatcccatttgttgacccacagcgagcttgtaggggggttaaatttcatttttgtttttatcaaatgacagcacacatcgtttaaaatagcacagtgtgtaattcattcaacaagctaacttattctgaagcttgtgatgcaatcatgaacaaagcagacaaatccctgcccttgcggacctattatttctggtgtgggagacaaacagtaaaacgacacacatgcgagataggatgtctgtgaccatgctgccaagaaaaataaagtacggaaggggtaagaaatggaaaggaaatttgtcatttagggtaaacagaagaggtgtaagaagtgacatttgaggctgggtgtggtggctcacgcctgtaatcccagcactttgggaggccgaggcaggcggatcacgaggtcagaagtttgcggcttgagagtcactggggccgagtaaagatggccacccatcagaggatgttgaaccaggcaccgtccatctgctgcagcagagtcctctggttgctgtgctgagcaggggtggcggggaagggttggggctgtggaactgatgcaggcagacttgggccaggaattcacacctcagcggcagcagtggaggggagtgagaagccgtcagattctaggtaggatttgaaagtagagccagtgatgtgctggcagatgtttgcatgggttttttgggggagggtggaaaatgatttgtggccatttgccagcagtcagtggtataaataatcctgctgtggcagatttcaagtgatcattatgacatctcagatccccttcccggtgagagccacctccatcctagagtcatcggctcattgatctgattgaaagccaagagatactggcatcacccagagaatgtatgtacctaggaaagaacacaggagcaggctgaatgtactagggcactctaggaaaagctgttcaagttgtaatgtaaacagttggttctttgctgaatgagttgggtgattaaaatttgcatttatgtggtttctcagcccagtggtaggctttccgtttgaatgccttacctgtttcactttgaatatcctcagtcagggttgctgagtgtcagatgtatgcacatgtgaatggattgctaggaaaaaacaggagttctttgtgttcattttatgttatgttaaaatggtgagtctgtgacattttacatttttccagctggcaacataacatacatttaaaaacttcaacattaaaatggatgtctaatttatactttttgttttatagttttgaagtgattaaagttatccatggcaaattgttggatatggtggggaaagtacagtaagtagtaccattttatctgcttgttagagaaacttcttttaatagtatcttctgagcaatacaatctggcacttactggtttgtcttttttttcttacaaatagaatacctattatgttggttgggaataagaaagacctgcatatggaaaggtatgtagcttttataaagtcaaatctaagatgatttagtcactgaagtatcattttaattattgttctgatgtcaagaatatttttagctgtagcatttttatccgttcagaggtgttatggtcgtgtgcagcagaagcaaaagtggaatagaaatctcacattcctctagaaaagagagagcaaactttataggaaactacctttaggttatctgccactttgcataaagcaaattctaaaaagacatagtgctcatttatgcagcaagtggtttttgagtaccagggtttgggattacagtgaggagcaaaggaggcagatgtcccctgcccaggcagcttcatgtcagagaggaagagactctacagcctgcatgcaagagaattgagctttcaggctctttcacaatttcccctggccttgggtgcttacaacctagctgtaaaatagtcaattgttacagatacgggagtactggaaaataagatcatgttctctgagctggaaggtttgctggagcatggataatcccataaagcaatgtctattctgttccccagctcaggcgtaattaaaacactcctgtgttacattcttgatgctaatgttaggccagggcatggttctgcttcatgagaaagaaattgaccaaaatggagcctgtttcataaatcaattatacatgttttatataatgaagagcaaagtactttaactagaattttattttttctttagggtgatcagttatgaagaagggaaagctttggcagaatcttggaatgcagcttttttggaatcttctgctaaagaaaatcaggtaacagattctataaacctcattttgcattgcgttctcatcagtcgcagggatgtgttccttgcagttggcatttgacctctgtcttgatcactcctgtgtaacatctggccttcctccatttctaataccaagttttgtgttgctttaggaagatactacttaggtgtttataaattcagtcagtattctacttacagtggaacctaggatatttgtaggataaacagaaactattagtaaaggaaatactaccttttgtaaacatatatttttggtttgtattaatagctggtacagaaataagtccatacaggggaaaaaaaaagaattatatcactttagtactaattttgtaactacccaccccctggctttttttctgttagatgaaaccgggtcagacgtacgtgttaattgttaacatagaaatgatgaagaaccatcttataagcatttagtaccaatttcaccccgcagatgtgccttcaaaggcatgttctgggaaggatgtagattctgcctccggaggcttcacagtcctgtatgagcccttctcttccattgctctaatttagacccccggcaccaagcttgtctcccgcccccagtgcatttttcacctatacattttttttgctgcccttaattttctaaagatacacatctgatggtatcatcctctactcagaaactgtcagtgaactgccccttctctatagaacccttcgcctggtcctgaatgcagtcaataatttgttcttttctagtttcttctctcaccacgttcttgtactttccatcacatcaaactgctcccttccttaaacacaccatctcctgtccaccccactttcaaaatgtctcacctttcctcatgctcccctccggtttaaaatagcccttctctaagtatctacttaggttcatgtggggttttatattttgaatgtgttttcaacatgtggtggtgtttgatcctcaggtaagatgacttggttttcatttctctgaggaaactctagtatagtagggtggtgcctcctccctgggagggccgggcgccagcagccttggcactcttccttccctgccccgcccctctccgcagcacggaggtttgtagtcctcaaggccccacctagatttcaccttcttgttgaccccctctggatccatccagctgaaagaaattgtggtttcttctcttagccctcttaatttgttctgagatctgagtcagtatcatttatataaatatccttcataatgtttagcacagtgggttatccgtcagcccaagtatcctgtgatagtcaaattggctttgtcctgtgttgggatatggagggatagtgaatccatgtggttatgtcctcttatgtgcggatgaaaaaaactgattaaacagatgtgtgtaattcgttcccaagttccagatagcaagggatttatcgaagtcagctcagtttctgagtatacacagaattcaaataagaattgagatagttaagagatacctatattttaaaaattgaattaaatccattgagtgcctatggactgtatccttcagatcatgtagttaaaccgcctcattttagaagtgaggaaattaagtttcagagaagttaaatgacttttctaagatcacccactaccttacgtggtataagaactaggactgaattgtagatctcatccacatctagtccttttttctctacacactgcttcctgtcaatcaggtgatctgaagccggtgacctagattagacaagcggggtgggacctggggttggcttcagttaactaggaggacagacgcctcattcataccaacaggacagaaggctgaggatgggagcccacattcaagtgggtgggtcagcttggtggatggaggatgtggagttctttcatgaatgtggcttctgttttccagtgaagtgtgtaaaacaaggttttcagctgagcgtaagcacggggaacatttgaggagaagggacaaggcgtggatgctttctctggggagtgcccagatccagggatgcaggcgggtggctaggcagcaccaagtgtctgcgccaggttcctggtcatgggtgtgaggtcagcagtgagcggtgtgtgttttccctgggcagcgtttacggtgtggccgcgggcaccgtgccagcgacagttggtagggaagggagttgaagtacagtggcgccatggtggcctgctgagtctgagctgaccgagagggaaaggagcagcaagaagtggttaagggacaggggagatgtaataatagggtcaacaaatcaggccccttgtggggctgagaattgttgcttcaggatagctagagaaagagctgggaaggtggtgtggtgggacgctggcagttggtgtgttctggtttcgtgggatagtggaagtcactggagtgatgggggagggggattcttggtgattaggagaacagggtacttcctgtggggcttctgagaacaggggcagtttttcatgaccacaggactgcatttcaaggacagggtctgggagtcacggtggctcaggcctgttgtcctggtgcataaggaggcgaggctaggctttcgaggccagcctgggcaacatagaaacctccaatctgtataacaaaaaaggaaaaataaaggacagggtctgacagttctcctccccactcagtgtaggaagagttcctgctccaagtggccatgattcctgtctgtggtgaaggactggtggggttgaccctgggctgaggctgagggcaggaagacgggcaggagaggagaggccaggagatagggagggcagtttgtggattgaaatgaccgagaattacgccacagaggtgttggaggctggcatcgtggcatctcaggagcacggagggtgccttccccacttcaggcctcttagtgtcaaggatgtgagaggcaagggctgctgggagagtatgtcccgtaggaaaggaggaaagatagtgccagaagtgaagagggaccctgaggtccagaggacactggggtgggggtcatggggtggagtgggacaggagatggtggtgagtctgggagtgaggactcttcgggcgtctcctggtgcctgaaggaaacagggtcaaaagcacaatcggaggctggttatggtctgggtcaggaggggtggacagtggccttactgggcgtcggggggccctgaagttctggggctcaccagaacccctcctcctccaccagtaggagggcagggcaggcggcacgccctcctcagtccgtaaaatactctcggagttcggcttcacactaacactgtgattgggtttctttctcttttcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatgctccgtggtcgggagcctggtcaaggaggaggagctgctgagaggcattgttcgcccttgctcatagcttagctcgatgtccgtgtcagacaggagatgattgagaacagccttgcctgtcactgtcctagaacaccctggagtttagtgttctgtgtcagagtcttgggagcctccttcagacccagatgacgggcctccctctgtccaaggagcagctgtaaaggagaagagggatttcatttgtttggtggctgttaccttgtctgtaagtcaaacttggagttgagcagtgctttttaaacgattcccttttgcagctaaaatttcacagggctatttctaatacgtaagcaaatgttaccattgactttattaataaaatatagttttgctttgcagttgattgttaatgaaaaattatgttcttaaaacacatgccattaatttggatcttttaaatatttttgcctcatttgtcattccaggatgaaatttctgctttagaagacttccaccaaatacatttttaaagacagggtctcgctctgtcacccagactagagtgcagatcatagctcactgcagcctcaaactcttgggctcatgctcaagtgatcttcctgagtagctaggattacaggcctaagccactatgcctggccaaataatcaccttttaaattttgacaacacagtattgttacttattaccagggttattcttaggactaaaaatgtaagagcactgaacagaaaatggggacctagtccatccagttatgtctatgtaaatggaacttagaacagcatattgtactagaaactcaagttcaactgaactctcctgaggtggtcctttaaggactggacctcctgagtggagggagcatagtatcatttctttatgtgacgcagtgcacacattccttcagatatgccctggggacctgccatgtgccagacacttctctgagtgccatgaacacagcagagaaacctgcacccctgtgtgccgtcaatcctgcgctgaaccttggagatgccacacagggtaggcccccgtccagctgcccaaggcagcaatcccaagaagacagttgactcgtttacttgattgagcattcgtggttttgtttttttgttttggtttggtttttctgacacagagtttcgctcttgttgcccaggctggagcacaatggcacaatctcagctcgctgcaacctctgcctcccaggttcaagcaattctgtctcagcctcccaagtagctgggatcacaggcgcatgccaccacacccgacttatttttgtatttttagtagagacggggtttcataatattggtcaggctggtcttgaactgacctcaggtggtccgcccacctcggcctcctagagtgctaggattacaggcctgagccactgcgcctggcagagcattagtcttataatcagtgataaaacattgtcactgggcatgatgcatgtgcctgtagtcctggctactcaggaggctgaggtgggagattgctggagcccaggcgttctgggctgtagtatgccgtgctaatcctgtgtgtacactgagttcggcatcaatacggtgacctgggagctagggaccgccaggttgcctgcggaagggtgaagccatccaacctggaaacagcgctcagaactcctgagctgattagtagtg

SEQ ID NO: 12977 - DNA, 5416 bp, Human
gcccttaaattcttggatttctatcatagaatacaatttttcccatgttactaattgaggatttttataatgatcagattttaaattttatatcataaatatgaataaatcaaagattttggacaatttagccccacaaagtttttgatgtgactaaaattgaataaaaaattaaagtaagcattattgctacaagatttattgattgacactgagctctttctaagctatcttctctttacttggcgtcttcttgcctatctttaaaaatgaatacaacactgccatcttagtcttctggtcatttctctaaaattcatatagcagttgagaacataaaataatttctgcttctaggagcatcaatcccattttaaaacttagattactttacttgtgcatagtaataacataaaatgatctttccaggatagaggtctgtcacccagatcttaatttgaactttgaaaacattagctagcttcttcgaatggagttgtgtgattagaagtatgtgacttcaaatcaggtaaaaagaatggcctacaatcgtgcctttatccctacttactctcttaactgtggaccatctcctgaaacgcctatttgaaggaacaataaaaactcaaatcgacaaaatccactgacctacctcatttcatcttctttataatatttcatgaaacaattatgcattcaaaaatattgattccatgtttaccatgtacctatattttcggttaagattatgaatgtttaataatcttgaagtatgctggagacatcaaaaaaataaaaattacaaagaagcaaattctccatggtgacaaattaccttttgaataccagtacctataaatgcaactgtgattacagttaaaataagtttattgtaggctttaaaatgaataaagatacttcattttcagagtagtagtctataaatttatcaagaaatagaaacttgtgaggcttcaaaaatgccttaagtcaaaggtgaaacatcttgaccaaaggaatgatttatccataaatcatatcataaatgctatctccataaatctttaataaataatatatggtattttaagtattaatattcaacattttctgacctaaatccagctgccatatgaatgataaaatcagtaactttaaatgttttaaaaataagatacagacatatatgtacctttaaatatataaatattaataggcataaaaatttaaaatgtgtataattaagtaagcattttaagaaattatgtttaaaaggtcaacagtggttattactgttgttctttgaagttttctatatttttccaaatttctaccattagcatgcattatttgtttaatcagaggttttcaatacaaatccttgttgctttaaacgcacagattaatgggcccacttcactatattttcagatatgaaaaatgatgtgaaatgttaaggatactgtcaggaaagctaattgtcactgtgtgctgaggcttgcaaacaggcataaaaagaactataggccggatgtgctggctcacgcctgtaatcccaacattttgggaggccaaggtggaaggatcccctgaggtcaggagttcgagaccagcctggccaacatggtgaaaccccagctctactaaaaatacaaaaattagcacacctgtagtcccagctactcaggaggctgaggcaggagaattgctttaacccgggaggcagaggttgcagtgagccaagatcacgccactgcactccagcctgggtgacagagtgagactctgtctcaaaaaaaaaaaaaagaattataaattcaaaatgaaaataaaagtgaacttaaaaagacgacaatgagcaaacaaaagttaatgactcctattttgtttttaccttttctactaatgagattcacatttgattctagaaaaggcagaatgatcatgattaagagaactgaaacccaaaacagatgaaaagacaagaacatgcttttcctgtggcagcagccgggctgagaggagcgtggctgtctcctctctccgccatggcgtgtgctcgcccaatgatatcggtgtactccgaaaagggggagtcatctggcaaaaatgtcacttagcctgctgtattcaaggctcctattcgaccagatattgtgaactttgttcacaccaacttgcgcaaaaacaacagacagccctacgctgccagtgaattagcaggtcatcagaccagtgctgagtcttggggtactggcagagctatggctcgaattcccagagttcgaggtggtgggactcaccgctctggccagggtgcttttggaaacatgtgtcgtggaggccgaaggtttgcaccaaccaaaacctggcgccgttggcatcgtagagtgaacacaacccaaaaacgatatgccatctgttctgccctggctgcctcagccctaccagcactggtcatgtctaaaggtcatcgtattgaggaagttcctgaacttcctttggtatttgaagataaagttgaaggctacaagaagaccaaggaagctgttttgctccttaagaaacttaaagcctggaatgatatcgaaaaggtctatgcctctcagcgaatgagagctggcaaaggcaaaatgagaaaccgtcgccgtatccagcgcaggggcctgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtatggcacttggcgtaaagccgcttccctcaagagtaactacaatcttcccatgcacaagttgattaatacagatcttagcagaatcttgaaaagcccagagatccaaagagccctttgagcaccacgcaagaagattcatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcagcactaccagccaaatcagatgaaaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagaaaagaaacctactacagaggaaaagaagcctgctgcataaactcttaaatttgattattccataaaggtcaaatcattttggacagcttcttttgaataaagacctgattatacaggcagtgaggaaaaaaagaaaagaaaagaaaagaaaagaacatatatcagtgttttgattatttccaagttctaaggtccagatgaattacatgtgaaggcatcaaaactcttgcatttaggattacaaaaacaacctttggtaaataattatcttcaggaactatgagcaagacagttgttcatggaaaagtagaagataaagaaataccctatttttttaaaaaggaagattacagaatatgtggaactatgaacttaagttggtccctgacaagatgctaagtatacagtaagcattcattaaatgctagtctctttccttcttttcttttccttttattttgtgaccatttcctctcttttttggaactctaggactctcctaagatacatagtttaggagaacaagaattgaaatggtttaaaaattattattaaacccaaaatttaaaagaaaaaataaaaataaaattatttttaaagaatttggtttatagctgggcaaggtggctcatgcctgtactcccagcactttgggaggctgaggtgggaggattgcttgagcccaggagttcaagaccagcctgggcaacacagtgagaccctgttactacaaaaaaaaaaaaaaaatagctgggcatggtggcatgtgcctgtaggcccaactacttactaggctgaggatcacttgagcccagagggtctaagctgcagtgagccatgattgcgccactgtactccagtctgaacaacatagcaaggccgtctcaaaaaaatagtgctattatatacactttaaagttatttcttgtccagtctgtattcagatgtacttcatcatattgagagcaatattgtaagggcttaagagagaaggcactagaggaagatagacctggattcaaattgtaatcactaacctcgccataactctctctaagcctcaattttgtcatctataattagtagtaacaacagaatccacctcatagagtagatgattatacgagatagtatatataaaaaaacacatttaccctcaatatttgttagctatgcaaatctttaactagaaaaattagaataaacagatatatgtcaatatgctcaatatatatgtgaaatcaaggggaataaaaagaagggcaaggaaaagacaagtaagcttttccttaggaaagtgataagatgagaaaagagagctaagaagaggggaacgggttgatatatatagaaactgaggcaagctgagcttgtaacattcatttggtattataaatgaaagcacaaagaatcaataaacagtgagataccagatcaaaagggtgaaagcaagatggaaaataggagacaaaaatcccaaatgtatgcaacttctttttcatatttcatttcctttgtctttaattacagcagttatttttacattctaggttttaattaaattgcacacataaaaaggaaggttctacatggctataatatttgggagaatattaatactacgtagttgtagtatttgggagaaaaaaattggccgggagcagtggctcacacctgcaatcccggcactttgggaggtcgaggcaggcaggtcacctgaggttgggagtttgagaccagcctgaccaacatggagaaacctcgtctctactaaaaatacaaaatcagctgggtgtggtggcacatgcctgtaatcccagctacttgggaggctgaggcaggagaatctcttgagcccgggaggcaaaggttgcagtgagacaagacggcaccattatactccagcctgggcaataagcgtaaaactctgtctcaaaaaaaaaaaaaaaaaaaaaaagaatttaacccttctggttttaatactgtgatgttaaattaggagatgatttcattgattcaagaaaatatctctaggaaaacattgcttatgctttaaacataagaataattagaccagggcagggcatggtggctcatacctgtaatcccagcactttgggaggc

SEQ ID NO: 12978 - DNA, 44338 bp, Human
agattacaactttttggcaggagaagtacttgagttgaacggtctttccatatgttgtctcagaagagtggtaagagaaagacttgtatcatttacattcatggctcaatgactatattcattttgactaagatagctttctggatatagtacagattgaacaaatgcttgtgaatgaaagtgtttaatatggacttattgaccatttattatttttctaatctatttgttaagccctttactgacatttggtttttcctttggaaaaactgattctaaataatggtaatacttttaaaatatgtatcatgctaataccataaattaggttatacaccatatgtccaaccaagctttagaacactttttacaaaaatgggcaaatcaaggttcaggaaaggatattataaaaaaatcatggatacacattgagaagaagagattgtcaaaataaggtaaggaaaagaagatgaaatgaatcaaattgcatattcaataacaataaaactcccaggagaaaatttgggtaagtagtactataaaggaatgatttttttaaaacatgtcccaatatgtaactgaacatgtaaaccagcttggagttcttttctttgatataggaaagggaacatttctgaaacaaaaacgaaatttttcacaaaacatttttttccatagctcaatggcacctgttttgcatggagacaagcacatgcaagaaaaagttgtaaaagtggaagcaaatgtggtctcagaagaggattgagaaaaacttaggtaaggctctggtacaagacattgtgggaattaaacaccctactagagatctgggggaaagcaccaagagcaagtcaaatactaggataggagatagaatcccttttcttggggaggttcaagagtccaaaacagccatattcaggatgcagtttcaggctggcatcagcatcagaactaggtccaaattcaagatctggttgtagatcaggctacacagagcagaagctttagagtcagtcatggaacaagtaccaatggaatggaaataggaatagttaatcactgtctttaggaaatggggcttttgaaatgggccaagagagtcaggcaggattgagtggttgtaagtattggcttggtcttcctcaggcccagaagaccaggaagaagtgattagccatggagactatacacttccacatggaaaatgcttagagagaatttggtttggttcagaagaaactgcatatcctccttcatcaacaatacttgaagttgagttgatagcagcagaagtgtgatttcaaaccccctttactagtgaagagaaagcattccctatttcctctactgagttaggattgtttatgggaccatatggggcagcctgtagatgattctgtgttcattgtgcacagtggggatggtctgggatttgtcacagactgacatcggagaattggaaaagctaaagaaagatatttcagttttataatgaaggtccagaattaatttggaggccagagggacctagaaaagaaaataaaaatgagaattacaaatgagtggatctttgccattggtaaaaatctgggtcacttatagctgtatttttccatctgtgcttttgtctgtgggctttgatagcatagtcgtctaataagtgtttcatcatctgaatctgacaatagatatcattccagaatacaattgttatgtaacaaaaattctgtatgttggagaaaaaaatcaaccaacacaattttaagctttgtatgtcttttgtttgcagggagtcaggcgtaaacaagcatttgtcattcgattcttctagtgcatttccagcatactgtgccttgggcatgacacatcagaatctgatgtttatcttttattacctgccagacccctctggaaaagcctctatggaattcatcatctgcagtctttgttgtaggtacacatataaatacatgttgaatgcatttgttgaggatattgtggtttctaacgctgaacttaaaaagtgttgagatgaataatgaagaggaccttctgcaggaggtatgaagctaatcattaaaatgtttttaaccaaaatattgacagtaaatctttttaaaaaatgtcaattatttgaatgccagtaagaataagggcagcataattatacttgttatatgtccactcaggagaagtttatgaagaattgcccttctgtactacacagtgaatttataaagataataaaaactaaacaattcaaaatattcatctaggaaagctcatttggtttgaataatcatttaagttcaataggcactgagtttcagaagcataagtatgctataaaaaaatttatttctattttggttgttattgagagaataatctttgtttttctcaaagctttggcctctttctaataaatatgctttgagattaaatgactaaaggtggaaacctgttttcaaattatatttgaaatgcacagcatgaataatgatagccacttatagggtctagcatatattaaaataatcagttgtcaacatataacatttctcctcacttcttaatgtgtgtgtacccaaccttcactcttgtatttctgactgaccattctgaaagactgaagtgcagacttggaggcaagctgtggtaaaatttgggaggatgtgagttatctttagtaggttaagaaaatataatgcaagaagcatacctactatgtgaagagtgcagtggaagaccagtgcattatgtatgaaatagtggcatatagagaacaaacctggtccccacttttgcatgtagtggagaagatagctaacatctaagaatgggttcactgatctgtatagtgaatacaagcagttgttttgaaatagagtcaagaacaaatgcactttccctaagggaaactgggcaaggctatgtgaagaaggcactccctgaggaggagctgtggcttatcctgtactgtcatgtcactgttgtaggcatcaaatggtggacatgtttatgtgattataatgaatttagctaaaagtaaattcatagctgcaaaggaaggcttatagaaagaaagtaaaggtaattagcatatacatcattagctttttgggattttgatttctaactatgtaacttcttggactagttttacttactacttctgatcccatggcagaactctgctttcttccccagctcccacaattttagtccaggattccaggtgatacagctcccatgaaagtccttaaaagccatgccctcctcaagaccagtctagaccaaatgttgattgtttactcttaggagagcagaaaaatgaacaatatgatttttaaactgcacaattctcacagcaagagacattctctgtcttttgaggaaaagttccctcaaagttggaatagagcattgtatttactagatgtaataaaggtgaatcttggctggccacttgacccaactccactgaataagctcttttatactctcctgtataggttcgcattctcaggaagtgaaagaatatggaaggagggagagagatgacatgtgacattccttttccagctaacagatgtttggaaaaggacaagactgtgtttcatgctagatgctctggtaatgtgagcaagagcagcatgaagttaactacaaaacacagcagctgaacaaaagctcagtggattccgaagggcagattgtgtatatggagaaaatccctcagaatacttacttccccagtctgaagaaattctttgtcagaatattcagtaaaatgaacagttattaatcttaggtttggtactcccctaaagaatattttactgagattctctatttaaaacaatgctgtaaagtcatgcattcagctacattcttagcagtggcagacaaaaaatagattgaaaacacattcttacttcttaaagtagatcctatgggtgtatgaaattgtgaaattgagtgaaagagtggcatatcataacaattaaaatctgtttatcaagaaccttgtgtgtggtgctgagctgggtaatatgtcaagtgagtaagatctgttccccaccctgcagatatttataactcaatacagagaacactgacacaggtagacacagttctgacgtttccatatcacagaaggaatgaatgccatctggggtgaagtcagagactcatcctgctctgcagcctgtatctgttgggggcatgaagtgcagccccatgggaggctctacctgaccttctagaggcttgcttcaagaggctagagatttacctaccccagctttccctgctttatgctattgtctgtgtgactctagagacctcctgattcttgttttgtattttccatttgttttgtctctgagaattcagaagatttgtcttctgaagatttcaaggtttatagttcattttataattatttacctcaaacttacctacttccagtgtatcaactagctctccatttaagaattctcagtggagagacaagacaaaaattagatttgagtttcaagggcagtggattaagctcgcacttcctgaaatgagaatgcctgcattttaatcttggctctgctacttactagctgtgtgacatggggcaaagtattggacttctctgtacctcactgggacattaatagtgcctacaggaagggattttgtggagattaaatgagttaatacatgtaaagtgcttagaactgtgcttacaatatagtgagaactcattaaaaaggagtcattcattacatatactttattatgttatgttgacctctaatagctctcctgttttcatttttacagccttaaagagttttacatgttttcctttacatgatagaatttgtttgcttatgatagtaatgataacaattatatataatatacctttttacataaacatatatccatccacttctagcctattaaggctttcctaaggcacaatgactagaactatttttagcaatcagttacaggcatatcataatttttttaaagggtagagcaccttcccctctcacatttaaagtatttttatattcatatttgcagtatttttatatgctgcagcagcccattagctgatatcttcacgaacagttccataacattcttggatcttttttcatactatattacagagcccattatcataaatatatattatatatacatgaatatttaaattttttctacatgtctttttacctttgaaatatttttgttgcttttctgctcacccacaaagccttcacaaattatttttgtcctgtctacatggataaatatatttttagccatacgatcttaatttctctaaaaaatatggagaattcttctttgatttaattatgaacatactaaataaaacaaaactttttgcttcctttattattttagtgttctttattatttagcttcatattatcaaaatcacatggtgttagacctttgtaaaattatgtttttccttctctgaaaatgtttggttaggtatatttttcttgtgtagaacttctattgtagattttgcataacttgcccacagaggtgagatttgtttatgggttgatacacactgttgactattagccaatttgttagaaataaaaacgagactcatagcttttcatatgggagcagctatatcatttacattctgatacttctttcacacagagctctcagtaatgatcgttgctctatcattctcggtcacatatgaatgttccacctaatctgccaacttaggtctaggttattatcttgtaaaagtggtgaggattaaacagttagaaagtgaaaatttgattgtagaagtggaaattaaccaggttgaccctgacatttggctaatctccccacaaatgtgcttggagatgagaaactcaacactttgacaaataacccattccattttgggcttattatattaagtaaaattctgattcattgcaaattccaagcaatttatctggattttccttctgtgctttgttttacttcaaaagatagagatactattgaactctcacttgaaatgtggagttttttttttttttaagacctggatttccttagttttctgtattttgtcacatataaagtttgtaagtagcatgaagagatgaaataagagttgtaaaccacacatatttgaattctgctatgttctagctatgaagccagtcaagttgctgcatttatcagatcctcagttgcctcactgaaatatatatctatatatttatatagatatatagagagtgagagcatgcatacacacacacacacacacacacacacacacacacagagagagagagagagaacattttagctattcttcagaaaagcaagagaaataatgttttctcagtatcttaagtggggtaatcataaccgtggtgaaaaggcctgatattgagggtaactactgtgaaaaaaccctaaagaaaaggtaaaatttatagagtaaagctacagaggcattgtagagcaggctttcactagcacaagcccatctaagtaaagaagcacaggtctaagcccttctagagaaaactttgaagaagtccatgccatattttatctaggaaagctgttttgactgaatcatcctagtgggttaccatcaggtcttgctgacatccaaagaagtctcatttagaatcttttataaaggagaagtctgagtcaaatgtcctttctggccttatacttcaacatggtaggtcttggttataattaattaattagaaattatttactcaattactactttatgctaggcaatatgttaggcacaaggatacatctaaatgccaccttctaagaatcttcagtctttgacatgttcttcttgtcatcctttcctgacttgacttcttatcccatctgtcttggattccatatcccattattttagcatcttccttgcccaaatcctcaacttatttttgtcattgtccttctgagtttgtgacctcatgaaaccttaaaccatggtgtcttcacatttccagctgagctttgctagagaaaataattacctgtgcagattggtgtcactttaaactttaaaacctccaattctttctgggcccttgatatttttctttcttgagtcggctctttctcagtttccactataactatgtgaaacaatttccattctccttaagcctttagtcttccatattcctactctatctgaacacttcttaccctaaagggaaaattggaagcatcacaaccctccaccttttcttatccagaatggataagatagattaaggtttaaaatcagttttagattgaaattctgccatttattgggtgaaaatcttcctgaggctcagttatctcatctgaaaggcactcatgaaatgttaacaattctttgctttctgtctttctcctcctaatagtcctcttcctcctcattttttctcttccttccttgtctcagtcagtttgggctaatataacaaattgccgtaggttggctggcttaaattacaaacatttatttctcacagttctggaggctgtaagtccaagttaaagcctctggcagatctagcatgtagtgaggcctcactttctggctggtagatgtacatattcttgtatcctatatggtggagagcagagacagaggaagtaagcactcttctatatttttttccccataagggcactaattgtatcttgaaggctgtagcctcatgacctaatcacctctcgaaggctctacctcctaacatcatcgcattaggtgttagggtttactgtatggtttgtgggggacacaaacatgccgttcttaactctgctctttcttctaacgatctaccccttttccttcctctgatagaggaaaatgtattaaagttaattcctttatttcaatcccagattccatcttttctgtcctcccagggacctccctttattttttttctactctctcctacatctccttttttgtttcctttcattaagcatgtatttatatatgtgtatatgtatgtatgcatgtatgtatgtatgtatgtatgtatttatttatttatttatttatttatttttgagacagggtctcactctgttgcccaggttggagtgcagtggtgcaatcttggctcactgcaacctccacctcccggattcaagtgattcttgtgcctcagtctcccgagtagctgggattacaggcgtgcaccaccatgtccagctaatttttatatttttagtagagatgggggtcttgttatgttggccaggctggtctcaaactcctggcctcaagtcatttgcccaccttggcctcccaaagtgctgagattacaggtgtaagccactgtgcctggctgtcttagcatttaaatatatgcaagtcttctctacctaaaagcaacgtaaacttttcttgaacctctatgtactcccctggtagacatattttctgtcttctttacttcatacttttgagttgtatttcatattttcatttgataatatttcttgtgtgcctgctgggtgtagatcctgggctaaacaactcacattccttttcaactcactggatctagctgctgctcacatgcttccaccgtgactgtccttaccaaggcctccagtgacttgggttgcaaaatacaaagggcaagtattaataacaatcttatttatcatttcagcagcatggtccattggtacttcctttttatgtttactcattaactatggtgggtttttagttctatttatttatttatttatttttactgtgcaccatttaaatgaacatctcagttctcttttacatctcttattttctcagtccctgttctttcccttaataattccaaccactgtcaaggctattttttccttccattttgtcttttacattttgacccttatggtcaatgcttgctggacacctccagatgacacaatcaccttagattccatatgcccaaaacagaactcataatttcctttctcaagtctttgctttttgggtttcctagtcagaaatgtggttgtcatttttcattcctctgtctctgacacttcctatatccagctagttaccaagctgcgaaatccacttcccaagtatgtctgcactatgctcatttcgcccgcttctccagagctattctcctagttcagatcaatgtaatctctactccagattacccaagtgggtattagagatataaatagttccttgttttatggtatcctgacctagctgtagtgtttctcaattctacaagggacacttaaatgtatacttggcacttaagagatcataatgcctgggactaaagtaattaatgccttttagtttggagaaaaaaaacttatacatggacgaaagctctactttaatgatactgaaagttatttaatgaagcattaggtgagatctccaaagggatactatataatttaccaattataatgaagacaacataactatgagttatttgaagggacagaaagtttaataaggattctactttcattggagacttaagaacatcaatcatccattaaaaatagagctactatatatgattcagcaatccactactggatatatatccaaagggtgtggaatcagtatgttgaagagatatctacactcccatgtttattacagcattattcacaatagctaagatatagaattgacctaagcatctggcaatagatgaatggataaagaaaaagtgatatatatacacaatgggatagtattcagcctttgaaaggaaggaagccttaaacaggcaataattagcttagcccaggcattatgatcccttaagtgccaaataaaattttctgtcatttgttaaaacatgaatggacctagaggacattatgttaagtgaaataagccagacacagaaagacacatacttcatgatctcacttatatgtgatgtgtaaaaaggttgaactcagagaagcagagagtagaatgtggttaacagagggtgggtggtgaagggattggggagatgttggtcaaagaataaaaaattttatttagaaagaagagtagtttcaagagatctgctgtaccacatggtgactacagttaataataatatataagaggacctcaaaaagttcatggaaaatgtgtattataaaaactgtgcgtggattttaaaatattttgaaccaaagtaaattcatgctaatttgttatgacatgtctgaacaggatatagtttgaggcattaagcataggacatcagtttgaatacagcatgtatcagagcagcatgaattctgctaaaatcaaagcaagaatgaacatcaaatttatggtgaagctggggtggaagaatggtgaaatccttgatgctttataaaaagtttgtggggacaatgctccaaataaatcagcagtttgaaatgggtgactctttttgagaagagattaaacaatgttgaagatgaaggctgaagtggcagatcatccacatcaatttgccctaattgttcatgccttgattgaagacggctggcgattaacagcagaaacaatagccaacaccatagacatctcagttagttaagtttacacaattctgactgaaaacttaaagtacagcaaagtttctacttgatgtgtgccaaaaccattgtacccagatcaattggagataagagaagagctttcagtggaaattttaaaccggtatgatcaagattctgaagaatttcttcaaagaattgtaacaggagataaacatggctttaccagtatgatcctgaagatactgcacaattacagcaatggctagcaagaggtagaagtggtccagtcaaagcaaaagtggaccagtcaagagcaaacgtcatggcaattgtgttttttgagatgctcaaggcattttgcttgttgactctctagagggccaaagaatgagacctacttattaggaaagtgttttgagaaagttagccaacactttagcagaaaaatgcccaggaaaccttcactagagagttctacttcaccacgatgatgctcctgctcatgccttgcatcgaacaagggtaattttgtgagcattttgatgggagatcataagcatccagtttacagcactgatttggctccttctgtcttccttttgtttcctaatcttacaaaaatctgtaaaggggattcatttttctttagttaataatgtaaaaaagaccgcattcatatgtttatcttccaggaccctcatttttaaagggatgcactaaatggctgctatgattgcttacaaaagtatattaaccttgatagagcttatgttgagaaataaagtttatattttatatttttatcttttaattccatttccatgaactttttgacataccttcatattgtatatataaaaattgctgagagaatagattttcagtggttttcaccacaaaaaatggggagataatatatatcctaatagcttaatttagccattccacaatgtatacatatatcaaaagattatatttgtatcccttaaatatatattaattttaacctgtcaattaaaattaataaacattttaaaaggaaaggagatctaggtcaccttttgtagcccttctgtccccaaataagaacattaatcattttgtaatggatggctacatcaaaccaccctgcaggttaatttttggttgtggccagaaaagtaggtaactgtcttatcaggacaggctagataatcaacaggagcctaggaaagaaggaaacagtgtgaccccaagaaatgataaaactagttttgtacagatggagatagggtttgtatgtgaaaattcccagctgtgaaggctggagagattgttgagagcctggattatgcagagccttagagaataccaatttgagttttccctgaaggtgaagggagaattgtggaggtattttcagcaaagaaataacaaaaccaaaattgtgttatagaaaaataacatggcagtagtatgaaggatgaatagaagaagggtaacattggatgcacagagaatggctagaaattgtggagttggtcaaagaatacaaaattacagttaaataggaataataaattcaagacatctaatacacagcattgtggctatagctaataatataccttcttgaaaattctaagaaagcagatgttaagtgttctcatcaccaagtgataagtatgtgaaataatgcatatttaattagctagatgtaaccattccataatgtatacatactttaaaacattttgtggtatacatacatacaattttatctgtcagtttaaaaaattaaaggaaaacgccaaaaaaaccccactagacaatcttataaaaatgggcagttttaaaaagacacttcaaaaaagaagatattgaaaaaaattgtgtcaatccaggtgacaaaagatggaaaatggaagagctttatttttttctttttgagatagagtcttgctctgttgcccaggctggagtgcaatgacgagatctcggctcactgcaacctctgcctcccaaattcaagcaattctcctgcttcagcctctggagtagctgggattacaggcacccgctaccacacccggctaatttttgtatttttactagaggcggggtttcaccatgttggccaggctggtctcaaactcctgacctcaggtgatctacctgcctcggcctccaaagtgctgggattacagacgtgagccaccgcgcccggccagaagcgcttatttttaaatggtaaatcacttgaaaagaattgccacgtgtatttaactctttctactttctcgtatgctactttcacatttttactattataatgaaggtggcactgaacatacatgacgtatcttggattattttcttaaaccaagttgctaggagtaggaatacaaggttaataggtacggatatttttaaagtaattaatacaagtttgtgatgtagtctttgaaataacacttctgtaaatattttaagcacattttctttcttttttctttgaagaacacacttaaaggtaactgaaggcacattctttcctctttgacatattcttttaagtttgataattatcgatccctttttccactatttctaacagaggttaaaacttgatgaaattttgatttgcttgtttgcgttttcatgcacctctctcattaacaaaatcagatgtttggtaaatgcattaatgcctacacctcggactataactattatataggggtcaaaaaaagttttttttttttgtattgacattaaaaaggtaactgttagagaaaattaaaactaaatcaataaaatcattgatatttagaacctaaataactcattattatattggaaagaaatttattaggtcaaattagggtctacatttaatgcttggcagtattcctttaggttaagcgttttttagttaatttgatcaagtcactgagttgaaatgcaaaatgataaacttatattaaaccatataaacaccatttcaaaagaatcaccatggtgagaaaaacatgaattatgaaaatgtcttgtaatgaacttgaatgtaagaggaaacattttttatggccattcccatgtatgagacaaaaagccatctgacgaaacgatagtggaaacatttttgaattgtgaaaagctgctctggtgaaaatatcaaaagaatgaaaatcaacctgttgtagcagaaatttgggattgtccaaattaagcatgaattaaatgtatatatttatgccatgcaatcaaaatgaaactgcatatctgtacttacgctcatgattcttccagcctggtttacctcactccctatcttcagctgaaatgcgccctcttctgtttaaggttagcctatctgaagactgaaatactctgcctgtgtagtaacagcattactgtagagtccaagccaggctatttggatcacactgccccactctaagaatcctcggactgcttgatatgccttcatgattctgagaggttcccctattttattgtgtttagaatctggagcttcttagataagggaatagtgcctgacccaatgaaagtcacctctaggctggccagggcctgtgaggtaatctagaatgagttatctttccaccagaaatcctcagtaatgcatagtgcccaggcaatatttgtggctgacctctgtttagtacttaccatgcatcaggcattgcttttccaacataatggtgccaccagggagagctgcaccactgagtacttgataaatggtcaaatatttctaaactgattggtaaacagtggctaacaagagcctcttaatggtccactctacccaaacttttctacctgtcctagtatttccctggggctcttggacctgtccacagcccatcaattaaagagttaaagaactagtacctggccctacaggccctccaggaccttgctacagcttcctagcaccccagcaatggttgggaggatatcctggtgacagtgttcattaagagtgtgccaagtacttggtgctctggagccaactggctgggttcaaatctgagctttgtcacttatgagacttgtgagcttgggttagttgattagtctttctttgactcaatttttctcatctctgaaataggatggtaatgtatttatcacatgggatatttttcagactaaataaattaagacaaagcatttagaagagatctagcacataataggcacaatataagtgttggttatttttattagatgtactaatggctaaatatttttaccatcaccctttagtaccacactagataccactgttggggaaaagacaggtggtcactgctgatacagttgtgcctcatatctctagagctgctgcatattctgaacagcattccggtagttttgagacctagttgtgtggtagttgagaaagtttatttctttacttcttaccttacattttaaatcaattggcagtatttaacaatcatgaaatttcaaataaaaatccagatttctggcatgttttgaaaatttgtaaaactggcaacacgagggccacgttttaatatggcaacaattgtctggactcctgtgttggctccttcctgggaagggctatcaactactgcgttcgccctccagcccattgtgtttttttgtaatctgtctgctatttgagtttgctctccttgaactaggctaacctgagcatatctctttctttacaacatggaggcccttaactgccacagcaacactttattgcctctactagattgtaatattctttgtgaatcatgttttatgttttgtttatttttatgtctttgattttgccttatccatagtaggttacaacttcactcttgggactaatgaaggttaaactggtggtgatgtgaattaagatgggttttgcttttatacagaaaagagttataaaaatacaattgaaaaagaatatataattgaagaagttgaacaagttttatgagttacacagatcacactatataataaaaacagaattccatttaagtcaattatcaagctatggtgatgtaggaagcacctcaaataaaatacttagatttgaattcctattcttcctcagatatgaccttgaacaaattacctaacccctgtgggttatttctgctttggaaaaaatgtaggtgataataaatattccctgtatgttgtgggtattagatgaaatataaaatattgtctggatatggcaatgcttttaaaatgttaatatttttataggtattattttaaagactttatttttttgttgttgagacagagtctcactctgttgcccaggctggagtgcagtggtgcgatcttggctcactgtaacctccacctcctgggtttaagcgattcttatgcctcagcctcccaagtagctgggactacagacaccaaattagccatcaaatctggctaattttttgtattttttgtagagatggagttttgccatgttgcccaggctggtcttgaactcctggcctcaagtgatccacccacctcagcctcccaaagttctgggattacaggcgtgagccaccccacctggctggatattatttaaaagactttaggcaaattaaatttaacagagtttgattgagcaaagaatgatttgagaattgggcctccctgagaaccaaaataggttcagagcgactctggagctgccacattgttggataacatttatggacagaacaagaaaagtgatgtacagaagacaataatgagtcacagaaacagctgaattagttacagctgggagtttcccttatttgaacatggtttgaacagttggctgcctgtgattggcaggcatctgaaattctaattggtacaggagtaggttatagtctgtttataaagttctaggccaaacttaagatatgtaaggaggtagctttatgtaaacaattcctccctttgggtcaacctcttaagattgagaggttgactgaaaccttaggcattgacgtcactctcacaccattgtaaatggacttatttggtctcaaattccactgggaaatagcagtacagtggattttgtaaggtgggaatatggaaacagaatgagagaaaaataacctgattgtttactttaggttaattttttgtaagggttagagcagaggggacctctttattatgctgggatctcctgttttcagaagaaaaaaaaactgtactgttttggaatctatcttcttccttaaagtttcactgtgattatgttgtattagcatgagtgattttgttttgatttggtctgttctgttggggtctaatgcaagagttcagtccagaacaatggtcttccataattttgtttaacaattctcttcttttggtcaggttctcacctagatgagagtgtgaccaaaacttagggctttggtgctacttcctattaccattattttgggttttctgtcttagcacattattgataggttatagtgtcttcacgatcaggcatttctttgagattttgtcattccagtcaaagataccatctgacattctacacatggctgtctgcaaacatttaaaactttggagagaatatagcataccagggagaatactattgtgactgtcagaatgataatgataatgactactatagtgactggcaggagcataccaagaatttggagtatgctccttagccaaggttcctattagttcctattaatcaactaaagttaaatagatcaaagaataagccagatgaaaagtctacatgttttaattaagcagcctgttcattaatctcttgtaactgaatctctacaaaacccagtgtatttattcatgtacaataagaagtgtaagccactgcacagatttctccctgttcagcctgtaggtaatctagagcaattttattatctagcacaactttagcaagagaatttaaagaagtctgctgcacagccacaggttttgcagtaaaatctgctgtacagactactgtaagggatacatttctaatcattacctcatttactccaagccatagaaaaagggaactaacaaatgatgcccatctagaaaggtgaaggcctcttggcaatgttttatttaacctaggatgtacgttaaaagaagtggactgatgttctgtttctgactgattatggagtaacaaaggtgtcattaaaattcctagcctacactggcccttcatcttgcatccatcaagagataaggttgctcatgtataaggttgtctgtgaaatctaacacaaataaaaatatacttcacacacataggccccttttcccactgtgttgttccaagaggcataagcaaggcaaaagttaagaaaggttaagaatctcacgatggaagagaagtcttgttccatgatcttgggaaagctttctatgtctaggatgccatctgcttcaagggagaaagttctctggttagctttaccttaaggtctctaacaagtgtttggtttcaagaggctggatgggccagactcaaggttcaaggtcccagtattttactgcagtgtgagtggcaagggaagtctttctctgatggtgtttccagaaggcccagtctctaagttttagaccatgaagggtttgactgtacccagtcagtggatcataaaaagctccttttacctaatgaaaatacactttggcacaatgcattgaagcctgcattgtagcatttagtcatataagaatttaggtgcagaagatacataaggttctattattagaggccttacagtgactatttcataaatggtcaactcatgttttgattggaagaggaactgattgttatcagtctgcagtacctttgaccaagacaattcagtccattcagttagacttgcctaatgctattatagctgtaacaccttatgttttacaacttgtccagtgaaacaagtacctttattgttggagatttctctaggaatgttccatgagagaaacacatttcttgataaccgttaagctattttagctattgttattgcattagccttcttgcatgagaaagcttgtatataactagaaaacatgcattacaaatgacaattgaatagaagccatctgtaaatgttcaaatggcccatcaagtagcaaaaatgtacctgaagttttttttgtcttcctaggattatggatttgacaaagcaaaataaaccactttggcaacttagaatagtcatgacaccagtatatttttaaaaatataatttggatgcaatctcggctcacttcaacctctgcctcctgggttcaagcgattctcctgcctcagcttcccgagtagctgggattacaggtgttcaccaccatgcctgaataatttttgcatttttagtagagatgggggtctcactatattggccaggctggactcgaactcctgacctcgagtgatccacctacctcggcatcccaaagtgctgagattacaggcgaaagccaccatgcctggctgagtgtagagctttcaatgatggcagttttaattacttgagaaggaccaggcagctctccagactctccatgagtccacactcgacaatgaattcatattatcttaaatacaaatttcgtttcttcaatttaggtgcatagcactgcttatcaaatgggttattgtaggcaatttgacttgaaccatgaacctcattcaaattgcatattttaacaacatcagtactggctgatctagcatggaaatctgctaaagtatttccttggtattcaattagttcttgtgctacttaagttggcaattttataaactggtcaacttcttcattagagcttttagtattcctatcccgtccaaatgtatatcattctagagttatcagaaacctgtgttcaagagtgtttatgagcattctttcaaacctttccatgaacctccttgaggacacaacattttaggattttacttgattgtaatgagctttaagaaagttcatcagaattaataaactgtgaataagacttaaaatggttatggttaaagatgcaattgacaaggaaatttggctctttctgtatcctataataatttaacataaataaacataattattgctgataacatatactaagacatatcagaatattaggagtcacatataattttgaaatacatattcataatatattcataaaatataactcagagaatgttaagtaccatttattttatgatgctttccattttatttaacatatcaaataagcctatttattgtctcttttttggatgcttcagggaccttttggaacatcctaaagttagtttgaaggaaaaaagagttaattttagaatttgaaatttgattttaggaagcctatcaaatatgccaaaggttttaaacactatcaaaatagaatcacagattacggcaaaataatagtaattaatttagcctaactgataattaaaaggttttcaaaagcaaaaatccttattcgttgatgaagaggagattcagttttccaaataatcaaaagacataataaagacagcacaaaacaaaatctgtctctcctctatttttctttgcattttactcaaaaggtggacgaacatctttcactcttattaatactacaataaattcttattcaaaggagaaaacagaattttacttttttcccctgtgaactctgcagagaattatgaattttacttttgtgttagtatataatcaatactactgctaattttaagaaaaccttataaacaaatacattcaccttcaatcagcttttgaacacacaagatttccataatcctttttatagcctcttgcatttttttctattttcccccaaccttgaatatccatttaattttatttatataattttttcattttgaaagaacctttaaataacctctaaactagacaaaattattttttctcaacaaatacacattttaattttctcatcaaaaacaatcttgcttttcttgtacactttacatatagaattatttattttattgtatttattttttttaagacagagtctcattctgtcacccaggctgaagtgcagtggcgcaatcttggctcactgcaacctccacctcccaggttcaagccattctcctgcctcagtctccctactaactgtggttacagatgtgtgccacaatgcctggctaatttttgcatttttagtagagatggggtttcactgtgttggccaggctggtctccaactcctgacctcaagtgatcctcccagcttggcctcccaaagtgctaggattacaggcatgagacatcgtggccagctaaattatttactttagtagttataattacatatattaacttaaattttaactcttagtaattctaacttccagtgtaaaacctaggaagttaatgattttgaagtgttttatatcagtatctgcagataaaaaccatttcataattgtttagaaagatgtttcctcaattatttttaatagatctaaatatatttacattttcaatatcatatacaaataagatgctaaggcataaatttatgttaataattaatacttcaatattttaacttcttagaaatgactcagatatttaatgagtatttatttctgaatttattcttattttttatttttattttttgagatagatcttgctttgtcacccagattggagtacagtggcatgatcttggctcactgcaatttttgcctcccatgctcaagtcattctcccacctcagcctcccgagtagctgggactacaggcacacaccaccgtgcctagctaatttttatatattttgtagagttgcatctcaccatgttgcctaggctggtctcaaattcctggggtcaagtgatgctcccacctcagtctcccaaagtgcttggattataggaatgagccattgctcctttccctatttctgaatttaacgcagctttaagattttaagtttctgaaaataattttgaaaaaataacgtaggtattctccctaatgtcctgagtggcacctaggatggctaggaaggccagggcccatctgggtccctaatttacacaccaggtgtagagtcaaggactgaggacagagctatgaaaaggatgtctggaggatccaacccctctcagcatggccagcaggcaaagctggaggaggaagggcagggccatagtgggcttggctgtgtcctgctgctagtggcccaggtacagtggacatacacgtctccaggcctcaccatgaccacctctccaggcctcagaattcaaaggctcaaaatcaaagatataagctcacagtaagatgtgtgaaaggcttcaggggaacccagtagccagccttttcagtgtcagcttacagacaatcaagcacgtatcaaaatttgacagaagcagcaattttatgaccctaaaacatatagcaaaaacagcataaacctttctgaccagtagacccagaaaaaaaagtctgaattatatttagtattgacaattctgaagacattcctattttattttgccaacaatgtaaaaacttgcttcatttgacaaatattatataagatcagaaagaaatatctgatacacataacacttacagacatatagacagacacggacaagggcagaagttaaaattttcagaaaaatttttcatttactagtttccaaatagtttttctttcccccaattcagactatcaatattccaattacctgtttcattgttctaagcaattgttagctagaaaaccctaaaatttcacttctaaaaggatgacttttaggtaaaacaaggtagaaattttatctctcaaatgcatacagctgagactttagacctaaatattgtaccatcttttgctcaaatcaaggagggaggatgtggataaatgcccagttaagacaggatggataggaaaaggtactttagaggagacttgttacataaatgtaagtcaatgataagagtctctagtaacttagtctttcctctcttcctgctgcacagaggcagacacccttaaaaatggaggtttcctttatagatgtaaatttcctttacagatatgtttcaaaatagccagctaaatgccagaaaggtgaatttggagaccaatttagttcaataggcagtctttttaagttagccactattttttagctaaaattactgagttcaggttggagcccattaattaataaggcgaggaaataattctctatgtgtggactcggtatggatagctctgaaaaagaaaaaagcctactttacttgagggcctacctttcatgaacactttatataattctctttttatctttggggcaggatagtaactaagccaaaagattagcagattcaatttttcttatcaattagttgcttaagctttttgtttgccttttgaaaggcttttaaaagaggcaatagaaatattaacatttttaagaatgttctgcacatcaataggtgtccctggatatgcctaatttgggagccttcatttttaaatgcagttcttaaagtgtggtgttggtgttgtttatttggagcattccactataattttaaattatctttataagattttgccatttttgtaagtacttgcagcttgtgggacctaataattatacatgtagaggtatgggatagacaaaagtggagcactcagttcatcagaaattaaggattccatttttatattgaaaattggttttggctctcacatcttgatcaactaagccgaagatttttccctacctcatgcattagaaaaagaaacaaaagggatagaacacaaaatcctggtgaatttctgaaagccagagttcacaccttctgcagtattgccatttactgccagtttgtctaaccagtcagccatctaagaattctaactggatataatccaattagttattgagtctaacccagtccagtgtctgtcatgacttctgtacccagttaagataaaaaatgtgcccatacaaattcagatagtcaaaacacaaacgcatggggatctccataatctgagagacaacttacccatgatccccagttgattcgagagagcaacagatacaatggagctggtgtaccttgcttaatcactcagtgctcctgggggttgctggaagctctacttcaaatcccacttctgaggccatctgttaaaagaaaacctgtagaaaaattaaattttaaactcagttaaagaacaattcaagagtcaggcagccctcagaacaagaatatgttcagagcgactcttaggctgtcgcatggtcagatgacatttatggacaggaaaagaaaagtgatgtacagaagatttccatcttggtacagaagatgggaatgagatacagaaacagtgtttgaacatgttttgaacaattggccacctgtgattggctgaaacactgtgattggtagaagagtagtttctagtctgcttagaaatttttaagtcaaacttaaaatatataaggaggtagccctaggctcaatttaatttgacaatatgattttatttatattagtgtttacagatgagaatgtcaaggccctagaaggacttgctactttgtggaaaggtcagaattacaacccaaacctcaatcatctgggctagtaagttttttactgaagcatcattcacattgcacctaagtgtaattaaaagatcaaggattaaggagaataaaaatactcgaatggaggtgggataaatgaaggatccaataaatttgttttattatagctatgtttatatgctgatcaccctagtatgtaaaagaaaaccaaaggactgaaaaggactgaatgaaatgtattcttcatttgaaacccctactcccttttttgagcatttttatggagtaaaaggtatgtactgtgccttagtttttgggctttttttttttttttttttgataccgaggctcactcttctctcactcttcttgcccaggctagaatgcaatggtgccatctcggctcactgcaacctcggctgcctcttgggttcaagcaattctcctgcctcagcctcccaaacagctgggattacaggcacgtgcaaccacgcctggctaatttttgtatttttagtagagatggggtttcaccatgttgaccaggctggtctcgatcttctgacctcgtgatccacccgccttggcctctcaaagtgctgggattacatgtgtgagccaccgcgcctggtcagtttttgggctcttattggtgaaattctcagttagtaactaggtaaattttttttttttcttaagaaactttctcttttgatcgggtttatatgagggcaggtgaatgtttttaaaatgacctttcttttgtcttggatctctggcttttaggaagcagaatggcatgttgaaaaacaaggtatttttagaaactgcatctttcattcactcttgtggcctggggcaagttattctgagtctcatttttcttatttgtaaaatggtgagattttattaacttaaggggtaccatgagaaaacatgcttgacaatgtgcttaattttaacacattgttatttaattgtttattcagttgcaggttagagtttaaaactgaaagagatgttaaagtttatgtcacccaattccttcaatttatatatgaaaatattatatatgagcaaagggtcaagctaagacaaatttagtctgctcatattgcattgataattatatacctggctaagtatttcattttctaaacaatacttctttaaaagactatataaataaataaataaataaaaataaatatatacatatgcatttaacaaaagtaaaattatagactatgcatttctagcaaaacaattttagacatggtgaacatgtacaataaagctttatatttctgccagattctatcagaagtgtgttgggaaaatttatgcaagtattgaaattaaatcctaaattacttacaaaattaattattatatattaagtatcatattatccaaatataaggttatttggagtgaaaaagaccacaattttctaataagtgaaactttaaagttacagaaaagcctttgttctaggaaatataactttgttaatataacaataataacaatgcatcataattacatataagcaagcaaaaaatgaaaatctttctttttctattttagccttgggagaatgaattggttttatagatgaagtgatacagctgctccccagcagttactcaacatatattcatataacttgcccacagatgtgaaacctctcggagcctgcttttcaaaaagatactaagctcaaagtgtttacagcatactttttgaccctgaccctgtcactttcctctctcctcaaaccactatgaggggtttgtaaaaaaccttaaaaataccagtgtcagctttttcaaaatttttcatattttttttcagtgacagcttttgtgtcttgggactgcaggggtgactctgtgcactgttagtgctgagattcctgagctccccagcaccagcctgtgcctcactgcctagctccctgctgggcatatcctgtcatgtcaaggattataactagattgtgaaagttaggttattttgttttgaatgcatttccttagattttcttaagctataaaatggtttggatatgatgtttgttttacacatataaaatacagtcacaaaatagcactttatgaattcaagtacttttttgaagtgaagtaaatattgatgcaattattaattgcattattaattttttcctttttcataaggaaaaagagagcagagaatacaattcttcagatgcttatgccttcagacaaaaaggttagaaatcctaaaaaatagaaatcataaaaagtaaactttttagttaaaataggttttgcaaaattattgaggaataaataatataaaattcccaaagtaaaaaataaacatagaaatcttgagtaattagacacgattttaatttacttaatgatattttctgtatcacatataaaaggagatagagactatctggcctatcagcacaacgctgggcttttaaattgtgagttattcaggtgagtgtggaagtgacaaaattttcatcattataaaagtcttctatgctcattaaaaaattgagctattcaaatatactctttcgacatccaaatatcattgtttgaataatctgttatttggctttttgtttattaattatcaacaggactcaacaagagatgaaggcaatgagactgaagccaacagcatgaacacattaagaaggacaaggaagaaagtcactaaaccatatgtttgttcaactgaagtgggagaaacggatatgtccaattcaaatggtatctaactactctgagtcctcaaaaatggtgtggtcagaggcaatctccatttggtctttcttttcataaaacatcttcatttcttttttgggagaagcaaaaggacaaataaaagttattcctacataagtgtcataaaagatggcaaatataagcttacaacgtaaatatataaaaataaccaatcaaaatatttacaatgtaaagagggttagaattaggatgacagtagtagaaaaaaaaaagaacaaacagaggaatgtatgagtaggaagagagacagttttctgctctgaaaatgaatacaaaaatcattacagaggatttgaggggccataagaaaggtatggaaggtgttttcataacacattttggaactccaactagatttcaacagatgtgagacactgctaaaactagaagttaatttgggcaacaggctcaatcctaggaatcattgtgtcctaaggcaggacagtaggaattcccagcatatggttacaataaaaagcagtcagattttagtagattttattatttatttatttatttttaattaattaatttatttttttgagacagagtctcactctgtcacccaggctggagtgcagtggcatgatcttggctcactgcaatctctgcctcctgggctcaagtgatcctcctgcctcagcctcctgagtagctgggtttacagggcatgccaccatgccacgctaattttttatatttctagtagagatggggtttcaccatgttagccggtctggtctcaaactcctgacctcaaatgatccacctgcctcagccttccaaagtgctgggattacaggctacagacatgagccacctcacctggcctgtttttaaattctctataaacaatgcactttcttggccagtgactagggtagaccactcccattgcccctcatttaatatgtcactgctagaaatatactattttctcaagtattcctctccatattatattaagagacagttgaaaacagtggaaacatattttaacatttttccttattactacagagaggatcagaaaccaaatggtgtgccacaaattagggaacacaagcaaacctatcatgggacctggctctgctgagtctcatctgtcatatgatgacaaggactctcaggatgagacaacagtgataaaacctttgccccccagaacaacaaccaatgttcctggaggtgaatttaacccaaactctggtaaggatttactggtaaggattctggaacaaactggtatgtggttctagccactaaccctaagtctgtatttgaattagagagaatgtaatgttggttgaggaatactagcccgggagtcagaacacttacaaagatttttatacctatcttttataaaatactttgtagttttctttaccctttaggctgttcatctggaaaatagaggggttgcaatggaagatgtcttgccttttctaaaagtaaaatcctattattctaagtttctggcttattaatagtgatgtaactattttggtacatgagtgtattggttaaaactcacttgaattaaaatgctggaaattagttacaaaagcaaatctaaaagccaggcacagtggcttacacctgtaatcccagcactttgggaggctgaggaggggagatcacttgaggcctggaattcgagaccagcctgggcaacataggcagaccctgtttctacacaataaaaaaattagctggtgtggtggcagatgcctgtggtcctagctactcaggggaatgaggtgggaggatcacttgagcccaggaggttgaggtgagttgtgattgtgctactgcattccagccagggtaacagagagagaccttacccccctaccccactctgaaaaaaggaaatctataatgacagggttaaacatacaagatttggaaagatgagaatataccagagtgggacgttagagggatagtgtctaccacattaccctcatttctgacaccaattacaagttttggaatcccccaagttaatcttagttttggtaatttgctggaaagacttactgaactcactgaaagctgttatattcaaggttatggtttattacactaaaaggatacagattaaaaatcagccatgggcagtccaggcaagttctaagcacagaatgttcacttgtcctttcttagtggagttatggacagacagcactattctcttggcaataacgtgaggaatattgccaaccaaggaagctcacttgagtcttggtgtccagagtctttactggggcttcatggttaactgggcatttggctgacttcactctccagccgctttggggatcaagcagttactgcatgacttgaagtcaccactataagtaacattgttagagtttctggcgtggcctagaaccccttggtaaacaaagacactcttgtcaggcaagacattctaaatgcttggagattatctcccagggaccaagggcaaagaccagagctctctttgggcaaggttaaatcctttagtacacacagggcctaaggaagagctagagcctggaaagtaaacacaaacttattatctttttaaaaatacaagtgtactatctcacagttttgtatgttagaagtctaggttggctcatctggtttccttgtttcaggttttccaaggctgaagtcaaggtattgccatctggtttcttatctagagactccaggcaacagtacatttacaagttcattcagattgttgagagaatccagttctttgtgactgtagaagtgaggttcttgtgtcctggctggttgtcagctggggtggcccttatctcccagaatcctttctgtggttttatatctcagagatagcaatgcctcaaatccttctcatatttagagcttttctgaattccccttcttccacatcccttttctgccttcagctggagaaagccatctaatttcaagggcttagatggataatccaagataatatccctattttaaggtccataaccttaattacatttgcaaagtcccttttgccatgcaatttaacatattcacatattccagagattaggtatggaagaaattttcgaggggttattctgcctactgataccgaaaagaggcagggaaatactgcatagaagagggcagtcccctggcaaaggccccaccctcaagcctggaaacccatggccctgaataggaacagacatttctgtttttgttccaaaatgttgccttttccaagaccactctggcccaccatgtccctatcctatgcccatataaaccccaagctccactgacagagcaggagaacagaatggcagagagggaaggagcatctgaaggtggggaggagttcagctggggacggtcggagaggagatccgtcgcgggacagccgaactccaggggaaagtcatattcccactccatcccatttcctgctccccaaccatcccactgagagccacctccatcactcagtaaaatccccacattcaccatccttctagtccatgtgacctgtttcttcctggactccggacaaggagccaggtacctagagaatagggtgtaaaaggccgttacccggaatttccactgagctggttaacagccgtccgtggatggcaaaactaaaagagcatggtaacacccctaaacactgctgtagggccgcaacccaaaagcgctcaccttggctcacctgcatgttccccctcccataagtggtttgagtgcagtggccgagtaaatgagtcatgtccctgttgcatgctccgcgaggaggtcagggaactctcccatctcactaccacaccgtctctcataagtgaatttctctctactttggctttatgaatttctccaaagtgaagagcatgagcactaacaacctctgaacatcaggcggctgttgatacaaatacccacaggggccagacggttaatacaaaagatgggctggtgtaagaacatagggagtggttctggtcatgagaaaactggagcagagagcaacagactatggcccaaaggctaaattcagcttgctggtcagtttttctaagtaatgtttacaaattgtttatagctgcttttgtgctaaaatgacattgtgctaaatgagtagctgcaacgaataccatatggcctacacggttgcaaatatttactatctggtcctttacagaaaatgcttgccaccccgtgaagtagaggttgcctgcccatctagactacctcagagttccaaccagttgttgctatggagaaatacctacccagggttgccagatctagtttcaaaataaatttgaactcaagatttttacataaaattttctaatagtgaagtgctgtccactatttcaaaaaagtttctaaacactgggaagactaatcagataacatctgctggccacattgactcctccacagtttgtggtcattgttttatatattctagttttagctacaaaagagagagggatttaccatttctttgtcttaagccagaaatctggagaaagatcttgtatcatgagctctctttgcactgtcaattgtgacttacagcatgggtaccattactaactcaacttctttagctcagaagctccctttttggctcagggtgtattaagttctctataggccttcagtactaaaaatttaaactgcaaaccaatacatatacataatttaaaaataaactcccaaaataagtgtaaggaattttgatatggtatttcttctttggaataacttctctaagtttttccaaaactaatactttttttttttcaaagaaaagccccctttccctcccactttttattgtattgctttttttccctgctttgtacctggttattctgccacctgggctttccaacaatgtctgcgctaatatgatgtggccagaaggtagcacaaacagggtggctctcaccatagccacaatgatgaaagatggctggaccttgaaagagcatggtacattatgctaggtgtgcaataagctgaatgtattccagagttttctcgcaagtgcacttttccctttctttgaattggtatttctgaaagcccaaacatctcttcaatctcccttttatatgtgaccatggcttgctctctatatataactgatatatgtcctcattgtcactgaacacaaacaaaatttctccaaggcctcctagttgctatagagctttaaggttttttttttttaatattttcttattttttccctaaacattcacagcattaaaacatcttctataaaaacacattgatttaatttattaatcctctgagggaatagaaaagaagaaaatctcctaggaaccacactgtaggaaaaacaaatgagctcctgaactggcaattatctgcctgctattcatcatgtgcaactgggaaaggctgaccaaaaggtttaattgtaaataacaagtatgatttattgaagaaaataaattccgacaatgatgcagcaagatcagttgatgccttgaaaatgaaatgggattggatagcgttctcatatttggtgaaagaattgaacttttaaatgaaaaatcgatgcttaggatatgtactaaaatatatgatgacaacttttacttattaattagacaaagtcaaatcacacaggatgtattcattcattcactcactcacttatttaaaaaatatttgttgagtgactatgagatgcctatactgctacaagtaccaagaaaacagcagcaggtaaaactaagccttggcgctcaaggagctgataggcaatggagaatgacaggaacatgtgagtatacagtgtggcaggtgccaatttggacactgaagaaaacagaaacagaatgatacactgttatgtgttgaatggtgttcctccaaaattgttaaaatgaaatcctaaccttcagtacctgatagtgtggctgaatttggagatacgttctttaaagaggtaattaaggttaacttaggtcagtagggtggcccctaatccattatgattcatgtcctcatatgaagaagagtttaggccacagacatgcacagagaaaagaacatgtgaaggtgctggaagaagatggctgtctagaagccaaggggagagagagtttagaagaaacaatcctgctgacacctttggtttcggacctctagccttcagaactatgagaaaataaatttctgtgtaagccgcctgtctggggcatttgtcatagtagctttagcaaactaatacacgtaccctactcactgtccagtcacagggcaacttggagacttcaaaattaatcaagggttagagctgtccatgttgtgatcaagtttcatacaattaatacttcaggtgattatggttttttttttttccagccctttcactgtgtgaatttatcccacccttgtatttgatggcatgtttattatctatacttgccccacatcataatataaagttctatgagggtagggctctttctggctgattcctaggtacacgttcagtatgaatagtatgtgatgatgaaaaatatctatgatgagtgaatgaatattattattatttatttatttatttatttatttatttatttatttatttttttgagatggagtctcactctgtcacccaggctggagtacaatggcaccatctcagctccttggtggagctgcaacttccacctcccaggctcaagagattctcctgcctcagcctcctgagtagctgggattacaggtgaatgccaccatgcctggctagtttttttaaaaacattttgtagagacggggtttcaccatgtaggtcaggctggtcttgaactcctgacctcgtgatccacctgcctcggcctcccaaagtgatgagattacaggcttgagccactgcacccagccaaatattattcttattttaaaataatatgtattcattgtagaaagtttaggagacacagataaagcaaaaaactagtaagactacctgttatcctattactagtgaaccaataaaattaccctttctccttttataggagatgtcttctttatagcctatgtataattgcttattatgtttagaatactcattatctaaaaatttccatattattattattattggttaagacagtccctctttgttgcataggctggagtgcagtggcgcgatctttgctcactgcaacctctacctcccaggctcaagcgattcttgtgtttcagcctccttagtagctgggactacaggcgcatgacaccacacccagcaaatttttgtatttttagtagaaatggggttttgctatgttgcccaggctggtcttgaactggcccaggctggtcttgaactcctggccccaagtgatctgcccacctcactcctgctggtattacaggagtgagccaccatgcctgacccaaatttccatattttaaaatgcctatacattttgttttaaggagcattcttcatcttgggctgaacacccaatatttcagtgtaggttgggaatacagcaaggttaatttagcatgaaatactttaattgctacagtttaattgtttgttttaaatggaaggtagttataaagcctccggagtttcagagtagccaaatgtatcagtgatagcacattatcactaatatatttgcatatgtggaaacagtaatttgtttttcccatgcttcatacttaaaatctacttaatctatgtttctaaactgtcaatctttatgcttagttttaaagcctaattatatcttgcaaaagaatactcaggtatcactttaaaattatagctgctcaacatcaatgatgtgagagattgatgggtgtttggatgcagacttgatcatgataacatttacttgggctagagtaattgtactcactttatgcatttaagtagcacttacatggtgcttactgtctgccaataactgttaataacttgttaatcctcataacaagcctatgaagtaggtcatatgttattgatgagaaagtcaagtcataaaaaggataagattgttgctagggcaaaggcaggattggaagggaggtagatggacttcagtgttttgtgctaacccaaactacactctgctgcctctcctaaaagttctgacagcaactaacatttataatgtgtactatttgcctgaccattctatgtgctctagacatattaatttaatttgtggtaataagccacccagcatgaatcaaaagtctgcattctagtttcaattctgcagtggactgatggtgcggtttggagtaactcattgtaccactttgggactcaagctaacgagttggttagattagatgatttatctccaaagttctcttctagctctacagttagaattttcaaactatcttaaaagtctcgaaaagaatgttttttatgtttctaattttaaattgagtatgcagtccagacttttcatctcctacactctcattcttaaaaaaaacccacacttttgtttgcttatttaagcaagttttaaatttgacagaaatatgtatatttcttagagttagatgccattaaaaagatataaagccctttgggcaaaaaactcccagaatgagacaaaacccctgaaaataaaaccaaattcacttttaatcatatagaaatttaaatttagaaattaacagttagttcaagaagcccaaatatgtttaataatagtcacctacagacaggcttttatggtccctttttgctgtgaacttatgcaaatatgttctaatttccataagcaaagggattttcagtaagtatctacgtatgatatcgctatatccttatgcaaataatgtcaattttgacctcgtcctaactgataaatgatctctcaggttgtttagacacagtgttcttgggaagacggtaaaggcagaataagaaaggtaagatatccaactctaagccagtgacatgatgaatatataatgtttttgttaataatattgactaattcactagtctccagtctccttttgcttctcagtccatcatgatctcgtgagttagaacctatttttttattttgcagattgcatgagggacagcagtcaaattttgaccccacctcaactctcttctagaatgaaacacattagacaagccatggccaaaaatcgcctccagtttgtacgatttgaagcaacagacctccacggcgtgtccaggtctaagactatccctgcacacttttttcaagtgagttttacacagttgtgactaaatgtaatttcatgaccattagcaagcaaacagttcttattactctttcttattttcttgtaatcttatacagcaattcaagctgaaaatcaataacttattttgtttcttcccttgttcctcccaaacacattattgctccccaaggagctaaacatgtactctcagctctcaaacagcaatttctttacccaatagaaatacaaaactaattgagactggtaattttagtcctgccttgaataattttgctctacagaattattttttctcccttactgcaattatgaagattatattttatttgacatgagaaaattgcaacagaagacccaaaagcaaacataaaaaggaaaaaatgattaaatagaaaatatttgctagataaaaaatgtattcctttcagctccaaattctgataagaaaatattccattgttgttggatgacttaatgaatattattaaattcccaaaaatgatgatatcaagaaatattgtgtttttgttgttttgagacttccttaattttttgtatcagtttttgtcatgtgtttattttgatgactgagttgttgtgttaattaaatatcaaatttcttagcaagggacatcaggtcggtactatttaagaaagtgtgaaagttaagcatcctctaggtttaactgtttaaaaatattacacttttatcacattaacatcagattctaatttttaaatttgtttcatgttggggaaaactggacatcttcaaaaactctttttaaataattctaacagattcaaacttgtttcttaaggaattatttggacctgcttgcagatattgtttccttgtcattcaggcaagaatacatgttgtttaatttttataaaaaatgaggattttcttgtggacaagcccagaatgtaattcaaatgagtctctttcaatcataaggaaaagtaactggcactttaactacttgccagagctcaatgtaaaactgtttgctattcagtttttgtcaaattttaatcatttattttactaatggcacctaaaagtccatatataggacattactctagtttctcagtggaatccttttacaaaaataaaacagtatgctgcttatacttgctaaggattgatataattgacataaagagaaaaattctgcatacttttttttatccaactgctactgaaaatatttttcattattttgttcaatatcccacatacaaaaaacacttttattccttgagtttagctagagaaaaagtttatcatgagaattttaatgtaactcattatacaccttctcaatggctatatttattcttagtcccagtttcctaataactaacttccctatttcattacctagttattattattttgttctcatttaatgatcatagagtatctatatttttttaagaagccactttaaatttatttttgaaacttgtgaaggtataaataatgagtattagcacaattaatatttgtaatttaagagaaaataatttattttggaaaatttgctgtgaatagacattaaaaataggtttaagaggccgggcacagtggctcatgcctgtaatcccagcactttgggacgctgaggccgacggatcacctgaggtcaggaatttgagaccagcctggccaacatggtgaaaccccatctctactaaaaatacaaaaattagctgggcctggtggcaggggcctgtaatccagctacttgggaagctgaggcaggagaatcgcttgaacccggaaggcggaggttgcagtgagccgagatcgcgccattgcactccagcctgggcaaaaagagtgaaactccatctcaaaaaataaaaaataaaaaaaagattcatctgtgcaaagtaacctaaatatcgtgtgtgtgtgtgtgtaccttattccatctcaaaaaaaaaaaaaaaagattcatttgtgcaaagtaacctaaacattgcatgtgtgtgtggtgttttaaggtttaagtcttacaaccaacttatattatctctgttctatcaatcaaaagggcagatttttatttaaattatatgcaataatgtaggctttttctatatctgatctagccaaattatgatatattgctacaggactcataactaattcttggcttatttcaaaagatgacctttactatggtccaagtttcatttgtgataaggatttaagttattctgcaaaaattttattgggtccatagtgatctatattgaagatgaagttgttccagtgctttatatctataaacactacttaagacaatatattatcatgaatatattaacatatattcatatacttcccgtaactaatagagagtagtttgcattctctatgtccaagaaaagaataaagcaaattacagtgccagaaaagagtgttcaaaaaaatatgaattaaataatcaaaagaataaagtgtgactttttactatggtttgagttcatataggactattggagtgaaatggcaaccagctgttctctactactcacagccaagtgaatacaaacacagatttaaattgtaggaattcatagaagtctcatgaataaaatatattatttctcattttagatatgtaaagaactaatatacagaatttcaaactaaaaaactgacaagcagggaaatgacattattgcttatagtgaaaatatgaattaaaggattccatgctataatattctaatatcccacagtaagcgtgtgtgtgtgtgtgcgtgtgtataaagtttacatgtacaggtccatgagtgagctggaaaattaggcagacaccaaatggtgtttggctcactcaactttattattggttaaagtggagttggatcagttcagtcaaatagcattcaaaaatatgtgtagagatggtggaaagtggaggcagtggttcatgggcaaatgcggaagagtgaaccagtaaattactttggctaataccagcccctctttgatagccatgcttcttggggtctggaggtagcataagaaatagtctggcttccttccaccatgtaaggatacacaagaagaagccatatacgaagcagaaagcagccctcaccagacaccaaatctgctgttgcctttatctcgcacttctcagtctccagaactaaagaggaatgagtttctgttgtttataaggggaaaaaaagagaaagaaagagaaagaaagaaaaggaaagtgtctggcttgcagattgttagagtgttttattaacctcatgatcttcactgacttcatgggaaccaaccttttatactcagtgatttttctccatctattaatgtaaccttcaaccttgttgatatttctaatacataatttccagaaattgttttatgtgtctgttcaacttaataaccttatcacttccctgttgcctggcacagagcaaaagttaaataaatgaccaaattcactgaaccctagagatagatggctagaaagtaccttagcagtcatctagtctaacacttgttttactgatgtggaagctgagggcacataatccaatgacttgccgaaattcaccaaagcaattaacgaaagagctaggatgagaaggcagatctgttgacacccagttcatgctgacttgaaggctacaacattttggaagctataactttggagttataggtccacattcatggacaagggttctgggactctgagacagtgaggtttttaattcttaaatgggttgtaaaagtgaataaagagaggaatgcagctgtcagcgtcctggctcccctggtgttaggacaaatgtgctgtgtgccacagtactgaccatagtctgcaatttgagaaggattgagaattgtttactgtagacttttgagggtcagttaactcaggattacaataaaataagcaaaaagaaagccttatctgaagaattaacaactgtacttcaggaagcacttttgatgatgataatttcaaataattccataaggcttttcctttgttttttgctgtaacggattttctttatcattatacctttcatttataactgctattttcagatctaagagcatataaggccttcaaggcttaaaacaatgcattgtttataaagttgcctttgggggttttattttaaaatgtttaacatttatctgatatcaagttagtgttaaccaacaagtgttaaacatatatatatatatttattatatatatatatatatatatatatattttcattagcaaggctttcccgccgccccccgacccttttgtttgttttcaaaacctaatttcttcatttttttccttctttaggagaaagtgagccatggtgtttgcatgccccgaggttatcttgaagtgataccaaatccaaaggacaatgaaatgaataacataagagccacatgttttaatagcgacatagtcctaatgccagagttatcaacctttagagttttgccatgggctgacagaactgcaagagtgatatgtgataccttcactgtgactggtgagcctcttttgacttccccaaggtacattgcaaagaggcagctgagccatctgcaggcctctggcttttccctgctttctgctttcatctatgatttttgcatttttggtgtgcccgaaattttaaattcaaagattatatcttttcctgctttaacatttttaaataaccatgatcagcccttcatgcaggaacttgttgatggcttgtatcacactggagccaatgtcgagagtttttcctcctctaccaggcctggtcagatggaaatctctttcctgcctgaatttggcattagctcagctgataatgcatttaccctcagaacaggtgtcaaagaagtggcaaggaaatataattacattgccagcttcttcattgagactggattttgtgattcagggattttgtctcatagtctctgggatgtcgataggaagaaaaacatgttctgcagcacttctggaactgagcagctcacgatcactgggaaaaaatggttggcaggactcttgaagcactctgctgcgctcagctgcctgatggcgccttctgttagctgccgaaagcgttattccaaggacaggaaagacctgaagaagagtgtgcctacaacatggggatacaatgacaacagctgtatatttaatatcaaatgtcatggagagaaaggcacccggatagaaaataaactaggctcagcaacagcaaacccttacttggtgctggctgcaactgttgctgccggcttagatggacttcatagcagtaatgaggtcttggctggtccagatgagagcacagacttttaccaagtggaaccttctgagatccctttaaaactagaagatgcccttgtggcactggaagaagatcaatgcctgagacaggctctaggagaaacctttattcgatattttgttgccatgaagaaatatgagttggagaatgaagaaatagctgcagagagaaataaattcttagagtattttatttagaatagagctcacaactactcctttagacatgtaattgttacttaaagctaatctaccaaaacaaaaagactgaacttttgtaattaacaacagcaacaataacaagattacgaatgcttttgacttttttttttgtccatggaatatttgacagatgaagtaggactgctgagaagattctgataacagaaacaaacaacaaagttgtggtgaagctataatatgcaaacttaccagatcttgtcagtcatttcctatgtgtatgttgacctggataagaatatccaattttgggtggcaataaatatattcgcacattaagaaaaaaaagacttaagcattagaaagcaaaatttaaatgactaaaaaagaaaaaaaagaaaaggagaaaaaattttaatggtacacataggttatgatttccagggagacaaatatactaatatagtctcgctaatcaaataatattgtgaatccaggttgtatgcaccattatggtctttctaaacaagttaaataaacttttgccaaaatataatgacaggtaggcagttttcccctaagtctcttctcttttcacccttctccactagctcctgaaaagcttatgaacttcaaggttataatgtcctcaagaaacaaatccctaaggaatagaattggagctgagaacaacgaggtcagattttaaaagtagttaaagcctttcttttaacaatgcctcatatagaagttcaatacacaaagtatagatagaaagatgtttgtgtgtgagggtaggtgggctctgtctactctgcttcattctttgaaactagatgttcctctgaaacctctagtgctctgtggagtgtgagaacaactgcctggctagccagggctatgtttggagtttaagtttgttattcaaattactgaatctgctgctcacagaggttggtacctccccagagaatattacctgttccaggcctttgtttgaatgagataatattgtaactatcacaaaagtttagctgcttttgggaagaagtccaaaatccacttactagcaaatgaaacattattctactgcttaggatcaaacagcagattttatgttcaattaaaactgactgtagtctcaatttagatagcaattgcacaagcagaggattagaatttggctcagatcctcttattaaaattcatattactcagtagcttaaatagtgaaagtcagtctatccttcactaattactcccttcttttttcctttgagcaggagaagtgtgtttggatacataagaagaaagttcccagcactttgggaggccaaggcaggaggattgcttgaggccaggagtttgagtccagcctggaccacatagtgagacccctgtttctacaaaaaaaaaaaaaaaaatgcctcgcatggtggcacatgcctgtagtcccagctacgtgggaggctgagaagggaggatcgcttgagcctgggagtttcaggctgcagtgagccataatcacaccactgcactccagcttgggtgacagagtgagacactgtcttaaaaaaaagaaaagaataaaattcatggatgcatatggggtagagagaaagatagtgtagggtagctgggggaaggaagggaacctgtcctgaaacctccagaatgaaatcccacacattacatcatgggagggataaggaagactctcatgccaattttctagctgtctgctagaaaattcccctctgttcattttcccctctgttctcagtaataaaacctcaatatgttctttgaaagcaatgaaaaatgaaatgatatttctgagccttcattaaggttggatgtggtcatgttattaggttcagtgcaaagaggtgaaagtagaagtgttgcatataagttctttaggacattttcttttcttttcttgtattttttttttttttccgagatggagtctcgctttgtcacccaggctgaagtgcaatgtgggggggtcttggctcactgcaacctctgccccctgggttcaagtaattctcctgcctcagcctcccaagtagctgggatcccaggtgcctgctaccatgcctggccttttagtagagatggggtttcaccatattggccagtctggtcttgaactcctgaactcaggtgatcagcctgccttggcctcccaaagtgctaggattacaggcatgagccaccatgccctaccacactttagaacatttttttaaatgacggatgctgtgtgctctgccctttctttctcttgctgccttcacccttcctgctgagtggcctacagataatgtggctaggattatgtccttgggaagggaggtttgctccacaggtacagtaataaggtggaatctct

SEQ ID NO: 12979 - DNA, 24715 bp, Human
tcacagtcaacgttttggtgatgagctggtattttaagatttgatgtaaataaacccttgttttgcttttttttttttttaaatatataaagaggagtttataatattggggacttggcccagctattcggaaagctaaggtaggaggatcatttgagcaaggcggtcaagaatgtagtgagctgtgatcgcaccattgcactccatactggatgacagagtgagaccccgtctcaaaaaaacaaaaaggctgggcgtggtggctcatgcttatagtcccagcactttgggaggctgagctcaggagttcgagacaagtctgggctacatggcaaaacctcatctctacaaaaaaatacaaaaattagctgggcgtggtggtgcatgcctgtaatcctaactacttgggaggctgaggcaggaggatcgcttgagcccagtaggtggaggttgcagtgagctgagatcgtgccactgcactctagcctgggtgacagagcgagaccctgtctcaaaaaagaataaaaaataagaaaaaaaattgaggacttaggtatgttaactttatgctttaccttttcatgtgaagtgaatttgtcattttccctagcatgaaaaccattaggctgttttagatttctttagttttataagatgtggaaagaggatcagttcattgtgccttgactgtagtcatatccattttgtggaaattaaaaccctctcctatccttgtaaaactaggaattcggtaatctaaatctaaaacaatagctcagcatgaacctgaagtgctgggggatttcctagggaaaggggctcagcccaccggataagaaacagtaactggaaggtttccggatctgctccagacatttcctgctgtctctagagccttttggcccaggtgtgttgaaccggatgggagcaagaaagggagctgttgggtagaagagaaagcaccagggaatcttacagcacagtttactcagcatcatgtttgacatattgaatgtgtaaaatttttactttatattctctcgttcagtcaatttacaaactaaacttaagagatactggcattagtagttagctatacttttttttttttttttgagacggagtcttgctcttgtcacccaggctggagtgcaatggcgcaatctcagctcactgcaacctctgctttccgggttcaagcaattttcctgcctcagcctcctcagtaactgggattacaggcacccgcgacacgcctggccaattttttgtatttttactaaagacagggtttcaccatcttggccaggctgctctcgaactcctggccttaggtgatccacctgcctcagcctcccaaagtgctgggattacaggcgtgagccaccatgcccggcctagtggttagctatacattaacagccatttaccaaggaaggactggaaaagttaatcctgatgtatatcaatcactattggcagcttgatttcattgtggagattatcaggtgacagtgttcttttttgatctttataattggtggcctagaatctgatctgtcctggttatgaacaccccagggataggatctgtaccgtccagtgtctgctgaatgggctgttttctaaccatgcctccttgcctctggagactcttgttggttggagcagtagttggcactttaatgtttctatgctgcctatgtacctcaggcagcagtcaccagtccataatttctaaacttacatagcagatcttctaatagcaaaccttaaaaagggcaagggagagaggacttaaaaatgaaagaaaaaaaaagatagggagaatgaagattttttttaaagctgttttagatcagggtaagaccaaaaaaaaaaaaaaaaaagattcacacagccctagtgtgcctggaatttgtggttgagtaatactttcctgttatttcttttttaggttgtttttcaccattcagaacattgcctgaagcaggtccaccatgccgttagtaacgaggaacatcgagccaaggcacctgtgccgtcagacgttgcctagcgttagaagcgagctggaatgcgtgaccaacatcaccctggcaaatgtcatccgacagctgggcagcctgagtgagtgcctcagagagcctgtgctttgccctcaggggtcgttggtgctctttatttagtttccttctcctcccgcgttcctatttctcccccatctgccttccctaggtaatgcgaaaatgtatcctccctctcctccccaaagagaggctcccttttggtgtagcttcttctcttcaaccttctttatctaccaccaccctctaggttccctcctccctccccctccacctgcttcaacagaaatctgtgggaagggtggcaggaagggctgcagcaaaaactgcagacggaatgacagagcagaattctgtgtgtgtaaagtgggaggttcacagagcagtatcttgggtcggggaatgtgcctgtaattacacgagctgttcgatgtagcctgactttgttgaagcctcaaatgtgccaatagtttttatctacccaacacccccaccccttttcttcccaaagaggagtaaagcaaacatgccttcggagagattctgactgacttgtccaccctggtacacatttaattgtgctgcaagcccccaggtccaagttcagggtacagattacttctgcagtctctggggtattgggagttttgcaagctgtgtgaacatacagtgacacaaatagtagctggagccattcttccttaggaggaagatgggggttagcccagactgttttggagctgaaggaaagccagctcaactatatatatttttttaattggcaagaatgaatgagactgccttgggtggggtacatgcatgtggtttggatttcattctgaatcaagttgactttgtttgcttgaagctgagatatgggaagggcagatgcttggattggctctgcatttatctagtgccactccagctcccataagaacctccgtcaaaatgccattttagtgatcttccttagcaaaggcatcttggtgtgaattatttcagatagtcacccctcctatcgcatcactgcccttagtgaaggcagtggaatatcaagaaagcctgcattctcccgtatagcaataggcccagcctttaaaataggaggctgaggagacagaactctatgaccagatgatgtatggagtctgagattcctaagccttcacctacctcagggatcatctcagttgatccagggcttagagaaacctagatggggcatcatgaagaagtgaaaccctgccagtgcctgtcttacacaaaggaacactgacagtagcacaacagcagtgcagctgacgaggaagcacatcaaggctgcagagacctcactgctttttaaaggcataatttctgcctctctctgtctctctctgagaaggccaaatgggtggaagtcaatcaatcacacactggttccttcttcataggacaaagaacatctagctaatgatgcttcttatttccacttactgaagttacgctctctctcagctatttttccagggtggtgttgatggatgccattgctcacactcccacttgtgatcagaccactcctatcttggggaagctgatctgagggccaaagtcaccttatgcccaaggaaacaagattttcttacattgtgggggctaactgatcctttattcatccaataaacttgtgttgaacatattttatgtaccagctgctgaggggatactcaacaagaataagaataagaggcaataataagaaattgtctctgccctccaggactcataatctacaaggggaggcagaaataaataattcctaagaggagagaatgggaagagagtgagaagggaacccacatttgttgattgcctactttatgccaggtttggataagatcttgacatagattatctcatttaatcttctcagtaatcctatgagattaggtggtggtattcccatttttcagataaagaaaataaggctcagaaaaataaggtaacttggccaggcacagtggctcatgcctgtaatcccagcactttgggaggctgaagggtgtggatcacttgaggtcaggagttctagaccagcctggccaacatggtgaaacccgtctctacaaaaaatacaaaaattagccaggtatgttgtcacacacctgtaatcccagctactcgggaggctaaggcacgagaatcgcttgaatccgggaggcggaggttgtagtaagctgagattgtgccactgcactccagcatgggcgacagagcgagacttcatctcaaaaaaaaaaaaaaaattaagttaacttgcctaaagagatacagccagtaagaggcaaagtcactgtttaaactcagacttcctacagatttctcagctctgtcccttactcgctgtctctgccaatattgccctggtttagacttcattgactttcacctaaactattacccaagcctccctctaccttctttctctgatccaacccccttaaatctgttcctatatccctgccagagtgatctgcctaaaaatcaaatctcactttttactttttatgattctgaatttctgaagctttgaaagttctgtgttaacttttgtaatgtaacaagtgtttttatagtcagagtacacatcgcaactatttctctcccctcttcctcactgtggaattatttaagttccttggcctagcattcaggaccctgcaagacctgccttcctttctagcctcattttctacagtctgtcttccattttacaatttttttttttaatttttgtgtttttgagacagagttttgctcttgttgcctaggctggagtgcaatggcgagatctcgggtccctccctgcagccttcgcctctgcgttcaagtgattctcctgcctgagcctcccgagtagctgggactacaggcatgtgccaccacacccagctaattttttttttttttttttttttttttttgagacggagtctcactctgttgcccaggctggagtgcagtggcgccacctcggctcactgcaagctctgcctcacaggttcacgccattctcctgcctcagcctcccaggtagctgggactacaggcgcccgccaccatgcctggctaatttttttgtatttttagaagagacaggatttcaccgtgttagccaggatggtcttaatctcctgacctcgtgatccgcccacctgggcctcccagagtgccgggattacaagcgtgagccactgcgcctggccaattttttgtatttttagtagagacggggtttcatcttgttggccaggctggtctcaaactcctgacctcaggtgatccaaccgcctcagcctcccaaagtgttgggattacaggcgtgatccaccacgcccagccttcattttacagtcttttaaaatggaaaaagggggcttggcatagtggctcacacctgtaatcccagtactctaggaggctgagacacaagtattgcttatgctcaggagttcgagaccagtcctggcaatatactgagaccctgtcgctacaaaaattaaaaaattatccaggtgtggtgctgtacacctgtagtcctagctggttgggaggataaggttggaggatcgcttgagcctgggagttcaaggctgcagtgagccatgatcatgccactccagcactggccaacagggcgagaccttgtctcaaataaataaataaaatgaaaaaggaaagcaaaaaagaatgaattatcagctactagtaattctcctgagacagaccatgctctctcatatgtccatacagtgctcttgctatccccactggctgaacagcccttgccatctttgtctgtctggctgcctgtagctgatccttcaaggcccagctcaggaatcttctcttccaggttgggctaagagtgttcctctgagctcccgttacatgcctatattatcctatcacattgtatcacaaatcacctatgtctcaattaaaaattattggctgggcacaattgtaatcctagcactctgggaggtggaggcgggaggattgcttgggccctggaatttgagacagcttgggcaacatagtgagaccctgtctctacaaaatataaacgaaattagctgggtgtggtggcgtgtgcctgtacttgcagctatttggaaggctgaggtgcaaggctggggtaggaggatcacttgagcccagaaggtgaaggctgcagtgagctgagatagcactgctgcactccagcctgggcaaccaaaaaaaaaaaaattgttgaaggtagaaatcatgtattgtttgttcttgaaccccagtgtctaccttgtatagtacctgtcacccagtagaaactcagtaaatgtcgaataattcacgcctatatatttcccactattccgtgctattgatgcacaaagaatgtaggaatggaaagaatactttctgtgggtagtgggggcacaggtagggataggcggggtcaaggaagacttcacagaagaggttacatttgaatgggaccttgaaagatgactgggatttcatctagctgagaggagtgcagggaagggttcatatgtgcttcaggctcatgaccttggcctcatgtgcattgtacctgggtggaacttctcaatttagtagtgaaagtctgattatggaatggataaagcataaaactaaaaattccacagccatagatggctctgtgacagcacatccagaattcttattttttctcagaatagtgagattggcatttcgcatattcggttgctgtatcttaggaaatacaggcacagccagccagcactttgtatcagtattgtggccactcgggagaatggaacccccacttgggtcattaaaaaatcaagctagatattgggtttctaactgactgcggtgtgggtgagggggtggggcatgccattggggagctccaagactcccactcagacttcaataagagcagcttcacatttttaaacatcagttttacctgttctacttccacgtaacatttcatttgaagtgttctgctaaggaaaaaacaaaattgaagactgcttcctagaatcttttgcaaaatgtggtatctgtatgaatgttggataatgatggatattgggtctgtcttggtaatctgagtgagtgaaatttaactctgaacaagacactttggtttttcctagttcagtatcacacttctgttttcagaagttggagtaatttttagcacttgaagaatagatactatcaaattactgattggaattatatttaaaattttcctctaagcttaaaacttagggtatttaggctgggcacagtggctcacgcctgtaatcccagcacttgaggaggccaaggcggatcacttgaggttgggagttcgagaccagcctggccaacatggtgaaaccccttctctgttaaaaatacaaaaattagctgggcctgcgcctgtatttctacttgggaggctgaggcaggagaatctcttgaatccaggaggcagaggttgcagtgagctgagattgtgccattgcattccagcctgggcaacagagcaagtctctgtctaaaaaataaaaaaaaaaaatttgaaaatcaaaaacttagggtatttagaattaacacttttttttttttttttttgagatggagtctcactccgttgcccaggctgaagtgaagtggtatgatcttggctcactgcaacctttgcctcttgggctcaagcgattctcatgtatcagcctcctgagtagctgggattacaagatgatgtgccaccatgcctggttaaattttatatttttagtagagacagggtttcaccatgttggccaggctgatctcaaactcctggtcttcagtgatccacccgcctcggcctcccaaagcattgggattataggcatgagccaccgtgtctggccttaggtatttacactcttaagtcatgtaatgtggttgaggagtataaggaagaatctcattgtaacaactcacatttttagctcacttaatccttatggtaacttgatggggtagatattatccccactttacagatgaggaaactaaggctgggagattgtgacttgctgatgagtacacgagtataaatagaaagagctgagactgattccaattttctttttttttttttttttttgagatggagtcttgctctgtcacccaggctggagtgcagtggcacaatctcggctcactgcaagctccgcctcctgggttcatgcaattctcctgcctcagcctcctgagtagctgggactacaggcgcccaccaacacgcccggctaattttttgtatttttagtagagatggagtttcaccgtgttagccaggatggttgtgatctcctgacctcgtgatccgcccacctcagcctcccaaagtgctgggattacaggcatgagccactgcgcccagcccagattttctggtttgaagtcaactgctccttccatgtctcagtatagttctaagtctgcctcgggcctgaggtgatgagatagtggggaagccttcacaccacctcacttcctcttaaaacagagatcttattgttaccagttttatatgttgaggttctgtgtaagattttttcttgaaaaccactgtgccacactgagcctctacttctactatcactatccccttcacttaaggagcaggaaatcctaggtactcttggtgactcttggtgtaagttgattgttttttttttttccccctccagaatagctggatggttaatagatatttttcttttttcttttcttttatttcattttatttattattattatttttgagataggctggagtacagtggcatgatctgggctcactgcaacctctgcctcccaagttcaagtgattctcatgcctcaacctcctgagtagctgggattacaggtgtccgccaccacgcccagctaatttttttttttgagatggagtctcgctgtctcacctaggctagagtgcaatggcgcgatcttggctcactgcaacctctgtctcccaggttcacgcaattcttctgcctcagcctcctgagtagctgggattacaggcgcctgccaccatgcccatctcatttttgtattattagtagagatggggtttcaccatgttggccaggctggtctcaaactcctgaccttaggtgatctgcctcccttggcctcccaaagtgctgggattatagtcatgagccaccacgcctggcctaatttttttgtaattttaatagaggcagggttttgccatattgcccatgctggtctcaaacttctggcctcaagtgatctgcccaccttggcctcccaaagtgatgggattacaggcatgagccaccatgcctagccttcttttatttttaacagatatttttgagcttggtttgttttccacacataatgttgcatatttctctgtttcaaccttccaaacacaattttccattacctagacaagcatgatacagtatggttttcataggaacttagccatattagaacagggatcaaataaaatcctcaacctgcagagtagaaatgcttgtcagccaatttgagttctttgagctcaggagcgtcccatagttgtttaggtcacaaacgatcactatgcaaggacttgcttcttccttgattagaagtccttattgacttaaatttaccagcaattcaaaatatgcagttgattggtcttatccccactcttcaggttgtactgggaaggtgagctgcagttcaccctgaaggtgtggttttggcctttcaggctattttttctccctcaaatatggactaagcataaatgtagttttgaagctaaaaattagagcctactttaaatagttctcaaaaaaagattatcatttgattgggcacagtctcttatgcgtgccttcaccttgcaagaagctcagatggtaggcccgggcgtggtggctcatgcatgtaatcccagtactttgggaggctgaggtgggcagatcacctgaggtcaggagttcaagaccagcctggccaacatgatgaaaccccgtctctactaaaaatacaaaaaatgagccgggcgttgtggcaggcacctgtaatcccagctactcaggaggctgaggcaggagaatcacttgaacgcgggaggcagaggctgcagtgagctgagattgcgtgccactgcactccacctgggggatagagcaagactctgtctcaaaaaaaaaaaaaaaaaaaaaaaaagctcagatggtatatttatttgtatgcaccacttttcattcctagtaagaatgtgcctgtggcttggaatgacaatatagaggtagtgtcaaattgctgttatgtttctttggctgcaaattctccttgcattccagggttgaaagtacggaacttttctttttctaaaaaacaagacattgtggaaagagaccactgctatgttgtttttcagagagggcttgaaagtttcagcttttcacttggttcctgagatgtagatttgaaggattgtaacctagagcagactttgaaagttataggttacaagccgggcatggtggctagaacacctgtaatcccagcacttcgggaggccaaggtgggcggatcacttgaggccaggagtttgagaccagcctgggcaacctggcaaatccccatctctaccaaaaatacaaaaattagtttggcatggtggtgcgcatctgtaatcccagttactcgggaggctaatacatgagaatcgcttgagcccaggagatggaggttgcagtgagccgagatcacgccactgtactgcagcctgggtgacagagggaaactctgtctccaaaaaaagaaaaaaaaattataagttataaaacataaaggaaccttcccacctcttaaaagaagttgtatatctctgctatggcttgttgataagctcagggcccctcaaagataacacaactgatcatagttgttcactgtattttcaaggctccattgaggaactaatttcctatttttcatgttaattttagatacgtagaacgtcctctgaactcccaatctgtttttcagaaccgttttataaggtacttttacagaacagcaagaggctaagggctataggcaaatgtgtagtgtttattttatttggagtctcgctccgtcacccaggatggggtgcagtggctcggtcttggctcactgcaacctccgcctcccgaggtcaagcaattctcctgcctcaacctccccagtagctgggattataggtgcctgccagcacgcctgtctaatttttgtatttttagtagagacggggtttccccatgttgcccaggctggaaatgtgtagaaatattatcttttcttccaggcttaattttttgcattacacctttcagttttattcagcctgttttgagtctcatgactgttcacgtctgtcaagaagactctattagttatagaacatatgcaggcttcctaaactatgaagagtatttctctgtctctaagagcagtcatctgcatatagcccaaaccgtcttagggtatgtgtgtgtatatgtatgtgtttgggggttagggaacacgatctttagtagccagtttttgtgaccatttacgttacttctatgcactagtgacttggtttctttgctctttccaggtaaatatgcagaggacatttttggagagctctttactcaggcaaatacctttgcctctcgggtaagctcccttgctgagagggtcgaccgactacaggttaaagtcactcagctggatcccaaggaagaagaaggtaagaaagctgagctcagcatttgcaggctctgctgagcagttttgtagaattttttttccctgatttatttaaaaaaaaaaaaacgtgaggagagaaatcacagagacctatagagttctgctttgaaatcacacaagcctgagtgctggaaagaacctttttagctccaccacacccccatgcactcctttctcccattcccccaattccttctttctcaaatttcccctccctcaatcgtattttgctaccataaaagtacttggaagattcattcctcctaaggagaggcctgctagatctggccacatagtaaacctttgtgttgcctcattttgttcagtcgtgaaacgactgggctgctgacagccttgtggggcttccccagagggggagggaaaaaaaaagcctggctgcggacagccacagccaagaagtgcagcagctgaggcctctccgactggtgtgactcagtgtttgctcaaatagcctgtcgtccattttctaacgccttccatcttctctcagtgtcactgcaaggaatcaacacccgaaaagccttcagaagttccaccattcaagaccagaagctttttgacagaaactctctcccagtgcctgtcttagaaacatacaatacctgtgatactcctccccctctcaacaatcttaccccttacaggtaatggctggctagttcctccctttttcaacctatggtttaataacgctagatttttttttgtctgaagcggttgtttccatcagaggattgtatctaaaagcttactgcctaccccaaagttgtggtagtttctgtggcagcagaaactaaaatttacaccataaaaattgtcacttattattgtttggtttctgaaattcatagtgaatataatacatattgaaagtttactgtaaccattgcatgctacagaatttaatttcatataagccaggtccatcttggattccatccaaggaatttagttattatagaaccaaaaggactttgttacaaggcggtcctacagcatggatcatggatcccaggggcaacattctagcaaggctcccacttacttggaaaccactagattaccagatgtttgggtgtgttagtggggccagcctcttggcctggctgctctgggcccaaaggggtctttccaaagcttaaggagtaattcgcattcttccaaatgagcatcgttcactttgttttgaacatcctttggacatttccttctgtaaggacctactctgctgtgcctggacttgaaaaagaaggtagccttatagacaaagcccctctcctctagtggtttggtagttttgtcatcctgcaaaaaaccactgaagaggggcagaaggtgaatatttatcttgcttacacccatatatatctttggagcaggtaaaaagtaattacagatagctggaggcagatgtcttctatcagacatgtgtacactgcaaggtagagtgtgtgtgtgtgtgtacccacgtgaaattcaaggacaccagtcagattcagggagccttctcacacagatataaagtacatggcatctgtccttcattttacttgtaaaattatgtttgccccttggctttcaaagggaccagcatagcaggacagaggtttgactctgcagcctccgttattgagtctagttgggtttgggcagaggggttgtggggcagaaaggggtcatacaactgataatattgtagcgagtataacatagggtttgtgtggtgggattgcataaacaaatgatattaggagaattttattcttcagttaatggtatttttctttttagcatacagtgtcagaattagcgtggcctctcagttatctgaacttggcctaacagaaatgagtggtggtgtatctaactcaggagaagatttaatatagaaattattaatgtttgatttggaagtgctttctgtgttgtgataggattggagggtagggaatagaattgcctttccagttctttttagttcagaataatgttaagataaatgttcactcctaagcacatcctttctggatagtgagaggaccttatccatgccaaaatgcaagattccaactaggaccattgaatctggcagatagcccttatatggacactaagtagtttactctgtcccactggcacagccattaattagaagctggtgattaaaccttgtggtcttacaacagctggccatcttttctcactggagccctcttgtggttggggtgtatgtggatgctgagctgttctagaagggagcaagaaggtggagtgctgtggttggttttctgtgtgtgcagagaaataacagctgtaaaccacacacttttcacgtatatatgtgtacatatgcatacacatgaactcccacatgtgcacacaggtttccggtgggtgggaagctactgatgctttctagagagtccttggggaactggtgggaaaagaggaaccagtggtagaaatcccctctgatgtaccaggaaatccgaatatcctcagggagatctctgtggccatgcagatcatcagaagtaatcaggatccctgctgctatcacctgtacttgccctgacaatgcacattcatctaccaggaattgaaagtaaggctaaggttcttaaaaagtctgataagtagagaggtgccattcgggggcattgaaatgctggtatgggagaggaggtatgcaatcgattcaaatgacttcttgattccttggtgtaaaaactgctaactggtaggtgtttggaatattggatttggttgggagctcatctgtctactgacagctacttgtcttcatttctatcccagggacgatggaaaagaggcactcaaattctacacagacccttcatacttctttgatctttggaaggagaagatgctgcaggacaccaaggatatcatgaaagagaagagaaagcatagggtgaggggaaaggggcctctgttctccacatcagtaggcacgattgtggagggggataaaaaggaagccagtgttatgtgaagtaatcatttcaagtggctgcttgcttggatgccaggtgaaactcttaaaaaaatgtgtccacaccaagcacaaccaagatgaaagtacaaatcataccaaaaatgtgtttgttccccccagtgctattaacaattgagtatattcaggctgagttttagaaattgacttttctattcaccatttatttctcttgcaatttgcacctgactctgctggacactcaagctaggctagtcccttctccactagttttgcagctcatttctcagagatcagcacaaggttctgcagtgtttgatttgcaacaggagcagtttaatgccttcgctacgggctgggcggggctagggtggggggatatatgtaggttttgaagattctccctccccatagactcttcctggtatgtatgtgacctaccagttgcaacctcagtcccattagcatggctgccaggaggcccaagagagtgccaggggcaagagcagctgcacaggcggaaaaattcttcattgatttttgttttgttttgttttgtttaaactatttccttatatgtgccccagataactgcaggtctcattacatctcatctctcttgactgacctttggggctgagcaaataataaatagctgtttactaacatctagcaattagagcttttcaaaaatgtgaatgagttatccaaagaggaagtggggttcccgttgctggaggcatttgagtgtgggattgagcaaatgtttcacccggggatggtttggattagatggcctctgggtcacttcaaacccagtaattctgtaagttctgtagttattgtatgttgtctaggcagattatctcttagatacgcatccatgaagatgggtagaattttaatgaagaacttggaaaatgttctacaaagaccttcctgttccttttcattatagaaagaaaagaaagataatccaaatcgagggaatgtaaacccacgtaaaatcaagacacgtaaggaagagtgggagaaaatgaagatggggcaagaatttgtggagtccaaagaaaagctggggacttctgggtaggtaatgcctttgtactgttggtagcattctttgaaggggctggggacaacagtctgacagctctggtgtgacacctttcacaccccctgaagtctgtctctgtggcttagatcaataccactgttaatcagctactttaaagtgcatccatctggtgatgaaaatttgctaaataaatcaagagattcagcgatttaaatgaggtgattggagtggtctggaaaagaaagcccatggctcctagtgcccttactctgcgagatacacatctaagggccccagaggaaagattggaaagggaagaaaagtggtcttgggaatcctttgcctccagagcattgatttgaaggtcatgcctaagaactgggcatttcactctcagggctggggagggctaggcaagaaagctgttcacatcaccaaagcaacttttcagtcagcctttgtcagtcatgggagagaagctagccaagggactgaatgcagacctcatagacagtgtgggaaaggttgcttggccagtattgaggctatatatctctgtggagaaataagaggtgtcagtctgaccccatttcccaataccaaatcacactggaggtttaaagggggaaaaagatggttttaaagcttggtttgatgcttatcctggtgtctgacctggttgacattcaaagccaagtcaccatgactgcttggcatgaatgtcgccctggttttttctctaaatacactgcatcatggctgtcagagaaccatgccagcccatgctgggtgtctaggaatgataaaaggaaagagttgagttgttcttgcttttagaaataactctaccatgaaaatcttgacttttaaaaatcttgacacttctgacacttgttcttcgtggattaagagctctgctttaaagagtgatgaagatggtgaaaggaaaaaatgaacctttttctctactgggaaatcagccctgagggtaccttcattaccttcacctcccagtaaagggggacattttgttccacggaccaatcctgttcagacaggcacttgtcataggttcaatgactctaaggccagaagcttatgtgttcagaatgccagctacccatgtgtgtcttctttttgtggagtaggaagatgaggatttgccttccattttcctgttgtccaggcggtttggagttggggcttcatggttagtctatctggacatgcctgttggtgaacctataaagagacgtgccaaggctccagggctccaggccttggggattttccacatcagagcatcttttgattcagttagttttctccaactctgttctccctgaggtctgttttagatgagttctttagaccccaacaatggtggaaagagggggaggtggagcagagcaggccagattttgctagctgatgcttggtgtatttgtgcttgtttgaagttttgttgttgttcacccagaacaaattcacccaaggcccagtgcactgagggacaggttttcatgagacaagccctagcacgctactttaatcgtcagctcatttggtttgataagagacctggcagaaagaccacatttactaccacatagcaccctgcattcatcctcagcttgattttgcaatccagtgcctccttggccttcgagctctccagaggcttgctgacctcaaaatcagtctgtgtgccagtcacgtgtttgcagctcactagcctctgagacttggcttcacatttgtcacaggacagactttgggattcaggtatatctgcacctgacactggggagagaatttaaaagaactgctgggtttgacaaggccaacactgggcaaggaacagcatggttttgataatctgggttgaatcctgttactacaaacaattcagcataaatatctgggatatatttgacaatagaatatttagtcttaaaataaaatttcagtgtaacagaaaatatgtgggaaatatacctattttacttctccctaatagcttttgtatcaaatgcatttttgtagtaccttttaagaagaaaaaacccactcaggctctttaaatgacagtttttggcattcggttcattgtcaggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcaggtaaatggtggtacctactccatccactattggtagttatacacttgagaacaaaagaatggaccaggagcagtggctcacgcctgtaatcccagctctttgggaggccaaggtggtgggaggatctcgtgaggccaaaagttcaagaccagtctgggtaacatagcaagacttcatccctactaaaaatcaaaaaaattagccaagcatggtggcaaacgcctgtggtcccatctactcaggagactgaggtgggaggatcgcttgagcctgggaggttaaggctgcagtgagccatgatcatgccactgcactctagcctgagtgacagagcgagaccaaaaacaaaaacaaacaaaaagttaaaaccctaggtcaagaccactaaaataacttcaaacaagactgtctagataatagaaataattaacactgtatgtatatgttgcttaattctcataggagtcctcttttgaggtaggcactgttactatccccatgttacaatgagtaaactgaggcacagaggggtcaatgaaatgacccaaaggtcacagccagtaagggcagagccctgattggtcagttgaactccagaacctatattcttaactactcctgttttgcctataccgaaacaaatggaaatcaccagcttctttcttgttttttccttaactttattttatttacttatttatttatttttgagacggagtctcactctgtcacccaggctggagtgcaatggcgcgatcttggctaactgcaagctccgcctcccgggttcatgccattctcttgccttagcttctcgagtagctgggactacaggcacccaccaccacgcccagctaattttttgtatttttagtagagacagggtttcaccatgttagccaggatggtctcgatctcctgacctcgtgatccgcccacctcggcctcccaaagtgctgggattacaggcatgagccaccatgcccagccttttccttagctttaactcatcatgaaatgaagtggtacaatctgctgtccatgatatagttagcagttaccttgcccagttgtctaggaacctagcatagagtcacttcctcttagtgcttctggttagtttcactgctgtgtcaaatctccagaaacaatgaaacaaagggaaaagggggatgaaactccaaattcgtccattttgatatttgtgcatgtccctggcagaggtgtacagtggaagtgttaggcagtaatgactgaaaagagatctgagaattgttcagattgcactgttttctccgttacttttgtcctttctgatgcctgataaatgagagctttgaaaggtgcacttttctccttgggtacttcttaattagaaattgagtatgttgaggacccctcggatggagacctaaagctgtgctgtcctccttctctcccctcattcttcttggccctagaaaccattaatcccaaatctccttctgcttcccaaatcacttcctgctggtggccctgtcagatgcagctaaggctggaaggtctgtggaaaattccaaaatggctgcttttctaaggagtagctgttagtgcagggtagatacaaaggtggaaaaagaaaaccttcagcttcacacatggcctgagaccttgcagctgcagccgagcaaatctgatcccaggagaggtgtagctttaatcctctttcaggcctgggtcaggagtctggtggcacattcatttcccatctctgcagattctcggattgagattcattctctctcaagatttccccacatgagcactgaagatgcattcacctaaatctatatcccactcaggtgtggtcagcctggcttgggtttcctgccctctccaatgctggtgaatgttaatagcctgagaaacagagcctagtgtgtgggtggtgtttgaatttttattccagttctttcttgcatgcacccttaaactggctccaggattaaactagcaactgccatggaccatccttcttagggaaggggagggagggtgccttccccttagagctggaaaggcagagggggccgaagagatgtctcagctagcctgtacctgatagaggaatctcaagtccacttcttgcaggtagttttactcaatctgtctatcctcctctactggtgggaagctcattaccttaaaaggctgcttatttcattattggtctgttatgaccatctgtaggcttttctttctgtttaagtgaaagtgaaatggtatagtcaaccaagataaacctcggtctgtagacaaggctaactgtagataggtgtctgcattctaagggtgatggtgagtctttttttctttggccttttagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggtaaatttcaatggtgggtttgggactgtggagccttgtctttctgaagctgggatgactgattgggggatgggtgagggggtccctgtgcccttcccaggaaacggctttcattgggtggggagagattgggacattaggcctgggagcagcctgagaaaaggcttcaccctaaaaatatggagatttagatttctttccaccttggtttaaagtaaaggattcttttcttttcttttctttttttttttttttttttttttgtgggggacagagtctggctcttttgcccaggctggagtgcagtggctcgatctcggctcactgcaagctctgcctcccgggttcacgccattctcctgcctcagcctccggagtagctggtactacaggcgcctgccaccacgcccggctaatttttttgtatttttagtagagatggagttttactttgttagccaggatggtcttgatctcctgaccttgtgatccgcccgcctcggcctcccaaagtgctgggattacaggcgtgagccaccgcgcccggccaaagtaaaggattcttaagctgggatctttgaagtccttggaaatatatgcttatgtgtgtttgcatgcatttttttttccttggggaaggatccccatttttcatcagtttctccgaagggttttgtgccttcgaaaaaaaacaagaatcactgtcctagtgggtccttgttcaactggactcagcaactccccagccttctccactgctctgcccttcgtgtcttccttccttgccccctgccctctttctaactccttttttctcccattttcttttatctcctcttttctcctcttccctcccctccccttccctcccccttcatcatctcaccctcctggaacattggagcatttattctatcaggggccaggtctggtcccaaggtgttatcgtggtttgttctgtttgtgatcctcaaaaaacttctaatctagagaggacagtctatggcagctgagccccattataattgatggaattgggcaggctgagggtctgctagatggaatgtggtggctgctccccacttcaaagccttatgagaagtcctcaccagcctgaaagtgtgtaaaccagaaaggacagcaggctgcctttcagacacacctgtgacatcagggccatcaatttcataaactcatcttcttctgcttttccataacaaccttctttttctctatcctttccaataccacttacccattggtggccactccctcttacccagttccagatggattccaaggctgaggacacgccttcctcacccttctgtctctttgccactaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtcttggcagagctttctcagttgtattgctactccagacctcaccataggttggggtcccagtaggaaggctcagggtctgtgccagccctgtcagtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatca

SEQ ID NO: 12980 - DNA, 187916 bp, Human
  misc_feature (1)...(187916): n = A,T,C or G
ccctcagggcctcaagggacctctgcctgaggaatcagcatttggctttgtaagcaccaggagtactcctggaagctccagggtaagcaaatggaatgaggcggtaattactttggcaacagtgtggactggctgaagctgggagtctggtaggcgcggacacccctggagactttgggcgaagggtccacggggatgcctgtgaagacaggaggccgaagtgtagggaggccgaaggcctcgggggtcaccaggtggactggtagaggaaaacacggagccatgggatgtgaggcctcaagactgcaggcgctgtgggccttcatttgcagttgatgctccgtttgggtttctgctggttgactgtgagacctgactcctttccccaacaatgcagacttcagccaaacctttccctgatctgggcctctacatctcaaaagcccacccctgtgactgggggatgggattattttcttcacacctgtcaccactctaccttctaacactgggttctgggcaacattgtggatggtggcaaaactgggcagagatgtaagaatgtcataactggagccgggtaagccagggtgctggaggggagggcctccccaagccagggtcctggcgaagacgtgatttgagtccatccagggcagtgccttgttagcaggcacccccaggaagagcctggggccacggccaaccgcccagccacggcctcctgggcaagaaataactgcttctcatctctgtacttcttgagtgggaggcaaacagtcacagccatgaaacatctgtggggtctcactgcggacgtgggggactcccagctcctttttccatgccgtgcttattctcccaccccttctcggatgccccatgatgtggaggggagcccttcgccccacacttctgggacaccctcctgacgctcccctctcctccccacaaccatcctcgcctccccacaaccatcctcgcctcccccgccgtccgggccatgacagccacctcagagctacagcgcacaaggagcgtttcggtcctcatgatttcccagggagggaaacagacactcaaatacctgcaaaccaaattctgtcttagctatagcgatatatttctcctttccatgaagaaagaacagaaaaaagaaaaagaatttatttaggagaggaaggaaaggcagtaatgatgatggtggaaaggaaacggtctagttcgcccaacaacggaatctgaaagtggtgggggctgggaagtggggtaggaaagaagttcttagaggcaacgcggaatcgcccttcccagggctccccaggagcagaggtcctgcgtaaaaaagacttaaaaattggagcactggatgccatggatcctttggattttgattccagttgatccctggagtaaggtcctaaccggggtctcccgaggtcgtttcgccgtccaggatggagcaggtctggcccctggaagggcgcgcgggctgcttggggacgggggcgccttttctcgcgcttcgcggtttcctctctcctactgcaggcagcgcgcgtttgcagcgttttgggaccgaactgatgcttctgggaaacgaaactaaacctctctgaagtttccagctcgggctttttttgtttcccgctatccggcgtggcccagtccgggcgcggaacgagggcggggccgtggccaccgcggcggaaacgacccgggccgggggcgggcggcgaggacaagggggctctgtgcggcacccgcccagcttgcgccctggggactgcggccgggcggcggggctggacgggagtggacggggctgggcgcgggctgggcgcgctgggccggccaggcggcgcgctgaccgcggtctccgtgcgtcccgcaggcggggagctcgcaccgccgcgcccgggccgcgagtgatgataacctaagaggccggcgcgggcgggcgtgagcggcggaggagccgggcgcggcgacacgcggccatggagcgggagccggcggggaccgaggagcccgggcctccgggacggcggaggcgccgagagggcaggacgcgcacggtgcgctccaacctgctgccgcccccgggcgccgaggaccctgcggctggcgcggccaagggcgagcggcgacggcggcgcgggtgtgcccagcacctggccgacaaccggctcaagactaccaagtacacgctgctgtccttcctgcccaagaacctgttcgagcagttccaccgcccggccaacgtgtactttgtcttcatcgcgctgctcaacttcgtgccggcggtgaacgccttccagcccggcctggcactggcgccggtgctcttcatcctggccatcacggccttcagggacctgtgggaggactacagccgccaccgctccgaccacaagatcaaccacctgggctgcctggtcttcagcaggtgagttgggcgggcgggcgagcgagcgcgcggtggcgcagggcagggcgccccgggaacttggtgttgggcacagtgattggcaggggctgggtgcttagaaggcagctccactcagggtggagggcccggctgcgcgggacccggtgccgaccgaagccacagcgccgccaaggcctctctgtgcctccgccgcagctaaaggggcgccctggatgcggggacgcgtggggatcccctgtcactccgtgtcggggccagaatgatcccaaggctagaaaccgacggccgctggacatcctcatccacagccgctcccacctgaagtgaaaggcaggaaaagccagcctggccccctggcctgaagtccctgcctcagtcttcggccaggcacagtggtctctgaacagccggcacaggacagtaaagctcagtctgctaacagctcggctcaggacagcagcaaagtgaaactgccgccaagtgctgatatgtctggcacggcccaggtaccagggcaggggaaataacagcagtgtccatcctccactgtgagccatgagccgcgagccaggcaccgcccggtagctgcctgcctaattttcttcatcttaacctgcttcctgggggaaagaggctgtggggtgtttgtgagccctgccacgggcagtaccaggggtgaccctgcgatggaccactcctgctctttttccctccctgagttttagagtctccggcggacctgtccagaggcctgcggccttttcatcctttatgctctccaccccaggagagccccttggtagatccatcttggagctgtgtccagcagcctggaccacctcaaggccctgtccctgagaaaggtgggtcgtcttagctttcctccaaagctcagcccatcgttacctcctgcctcaccttgcttgaccccggaacagggactgagatgggcttctgaatagaacattagcggtatctggcttccattatgcatggggagactctaggaagccctatgctctcttagtggcagattgttcccctaaaagaggagggtcagagtggctcctgcctcttaaacgtaggcattcacgaatgccttagacacaggcactcatagcttggatgaagccatggatgcgtgcctctgtagttgagtacctttcaccctcccagcaacactgcagtggttatgctccatatttttgtaaacagagtaaacgggttcagagaggttaagtaaacctgcccagtgtcacacagcagcaaggtcgtggtactgggatttgacccaggtcttcccgaccgcacagctttttgaatatttctttgctcgtgcttctgaaacttttgtaagagtcactgaaggcgcttgttaaaattacagttttccaaagtgtctcactcagcaggcctgggattgagcccaggaatgtattagattagcgtgcacgtaactcttatatgatggcccacacttttcagaaacaccactctgcctgctcccaagccttgctctttggccagtcagcaagcgtgactgtcattagaccgggctgtgggatttcctggcccctgttcaccagaagcctgagcagggacaagagcggcaccccttacacaaatgccctccgtgtcccctgagcgaggcctccaccacatagccctggtggggctcaacagttttaagcctttgcacagataccacttcctgttattactgagcccgtaactcctgtagcctcctttttagaaatacttatgcctcaggagaaatacagtttattttcagttggcaaagtgctttgaatccattatgtcattcgatccttatagtaactatcacacccatcttgccgatgaggaaactgaggttgggatctaaaagctattctcttgtctctatgaccttgtaaggcttcatgggactttgaaactttagcttccatttggactacacccatctacgttcccctccccttccactctgcccttgactccagatatcttaactctccctcagactctgtcttcttccttactgaaggaactgtcagcatttttcattcacttcccagctgccttgaggacagtgggcgcaatgccctacttctgtttattgttccctgggaaggcaggtcaaattcttccagtcccagaaaggctggaagaggtggtgccaggccctgggaatagaaggaggaggaggctggtttcacccagagtttactgtagggacagatggcaccatagggcatgtctaccaggtgaagtcctgggtggggctcccagccccgggatgcaggctccatgtctggcgaggcgtcccagtgcaggacaagagtctgggacggtggtgtgaggatcaggaaaatggtgccaagcaaggtggggcagagagtgggtgctgcagtgagagatcgggggcggggggtggacagggtcatggcacagaggttgagaacaggttctagggtacactggggtgaagcatcgacatgaagccctggctctcaggacctggcacccagacagcacagagcagccaaggaaatgacttctgtgtcaggccaaggtctgtgcagtgcgtttggttgactgcagagaagatcagacgcacgactgtgaactgtctaggtctgttttgtgtggcgcttcctccaagtgttgctgctctagctgctgtgcataggagtgtcggtccaagcgtgcaacacattgttcacgcagagtatgagcagactttagctggaagtcttacctgctgccactgtcccagaagtgacttctgggacattcccttgtatgtggatgtgcagcctgtagtgcgtcatcgtttatgttattatttatgtgctgtttttcagtgacaccatccttgggcccctttctgtgagaatccccttagagcctgttagaaatgtagcttcctaggccagggtgtttgagaagcagtcctgtttcctccttctgaacccattttctcctaatggatttcacacgctatttaggaaaaccctcttgagccacgctcagcaggttgggggagcactgggtgattctgggggggttaggtcctgcctgtggcgcctgcaggggggaagggccacccacccagcgtcactaagctgtggtccactgtgatgggagggtgtgggaagcccctctgatcatatggacctcggtgctggctaaggctgttcagagaagccatcttcccacagccccgggtgggaagaaaggggctgcctgcgcttgagaccctgccactcagtgagccctggtgagagtcgagggggatgtggcctccggctttcatttgaggcttggacttccctttagctgacatcggtctccaacactgagtgtccagctggaacagggtgggcatccctcggggccgagagctgagggggcagcagagcaacctcaggggtcctgctgggcagggctggaggaggagaggggaagagaagggcaaagggactcagcccaggctgggagagtggcgggcagttctgcaggcaggaagcagagatctcctatcagaggaagactttgtgccttgcagaaagctttctcatccacctcttccacagcaggggtgaggggggaaaccttaaatcagcagacctggagccctgctcccagaaatggagtgtgccttgcaagggtgctgctggaggaggacctgggccagtgatttcatctgtcccccaaagcctgcctaggctattgttatcttttttttttctcccttttgcttctatgtactttgtgatgactcgaatataatcttattgacacctttcagtgtctgtctccaggatgatgtaaccagcagtatttctgcaggaaataaccggaggcgacttttccctgaatcttctgggctctgtgcttgggtctgagggcagcatctcagtgtctttccgtcatcttttgggaaacaggtagtcaggaggtgctctctgcttattttggaattgccctacttttggtctcttcccctcactttgattttcgctccattttcccagcccaccagggttatttctccaacccgtgtcccctgcccttcatgctttgttgttttggaagagctgagcagatgagaaggtgagcttctcactcaacaaagtcctccttttgttttcttttctgccagggcttttgtttctcttgtctcccctctcctactccttctccgtgcctctttcccttcccttccaggtgagcctcatctcttcctctgtggcacccttggctctttcatggcatattccctccatccctccctcttaatgcaacaagacagcagtcaacacatctttcccctgggaagcacagcatctctgtcatttgggtaaaaggtttgcaaaagcagagacaccaggacaagacccaggagttaagaatgcgcagggaccacgccagttcttcttaagcagggttgacatccctgtaggtaggttagcgcactggacgcttgcggaatattatttccacattgccattcacatgtttgttggaaataatttttcggtacctgttacatatcatatattactgggctcatgaggtcaagttgcagtggaaaaagaacgtttcttttcctaaaaccttggttgtcatccaaaggcaggcttgttcatgaggcagttctttttttacttgttaatatgagccaaatgttctatatgcacaattccattttatcctcccaacgatcatatcatttccacatccccattccacagatgaggaaactgaggcttcaagactcaatagcttgcctaaggtcacactgttaggagatggcagtaccgtgatttgagcccagatctaccctgctctgaccccgtgttcacagttattaccttacttggtattcccaccccaagaacaacaggcctctttaaaataattattctagaaaatttcacatacatagaaatgtgcacatgtgacaaactgccatgtaccattgtccagtttcaacaattagcaactcatggctaacattattttatctgtattcccacctactcccttctcctctgtcattctgatgcaaactccagacatcatgacgtttcacctgtaaatgtgtcagtatttgtctttagaaaagcatgactcttcttaaaactaaactataaataccattatcatacctaaaaaaaattattattttttaagacagagtcttgccctgttgcctaggctggagtacagtggcatgatcacggttcactgcagcttccatctcttggcctcaagtgatcctcctgcctcagcctcctgagtagctgggaccacgggtgcacgccaccacacctggctaatttttcttaaaaatttcatagagataaggtctcactatgttgcccaggctggtctccaactcctgggctccagctgtcttccttccttgacctcccaaagtgctgggatgacaagcctgagccagtgtgcccagcctaatttcctaatactgttaaatacccagtctgtgttcagatttccacttatctcataaatgggatgtgtacttttcaatatgtatgcttgaattagctataaatgaggcctactcagcaggtggctgataaatcttttaagtcacttttagtctatagattttcccccagaaaactctattctctttctttttttcccttgcaatttattttgaagaaattgggttatttgtcctatggggttttccagggcctgaatactgctgattacttctgtgtggtttcaggtaacatgttttttttctattgtaattcctgtggattggtaggagggtctgcacacttcctcagtgtttcatcaggctcaggtttgaatttttgttgttgttgttgttgttgtcattgttttggtctccacattcctaggtggtgttctgcacttccattaggagacacgtgtgcttacttgtctttttgtgatgttgacagccattgatgatcattgcctatatccattgatttgttagaggttgccaaatggtggtgtcctaatttattataggaaatacttttataaagagacacttcccctcatctactccctggtttcccagtggtccagcctgtatagtaaaagagaaataagtgcttgatattggatcactaacatctaacgctaactctattagtccattctcaggctgctatgaagaaatacccaagactgggtaatttataaagaaaacaggtttaattgactcacagttctgcatggctggggaggcctcaggaaacttacaataatgacagaaggcacctctttacaaggtagcaggagagagaatgagtgcaagcaggggaaatgccagacgcttgtaaaaccatcagatctcgtgagactcactcattagcacgagaacagcatggaggaaaccgcctccatgattcagttacctcaacctggtcctgcccttgacacgtggggattattacaattcaaggtgagatttgggtggggacagagagccaacccatatcagtaaccagttagctttctaaaattcttaagctttttactttgaaatcattttagacttaacagagaagttgcaaaaatagtacagatgcataccccttacccaccttcttttaattttaacatttaactgcactataattttcaaaaaccaagaaaataacattagtacaaagctattcactaagtcacattctttatttagatctaaacagttttccattaatgcattaataagttttggtcagtatgtttacatgttgatcttgtgtcctgccacctggctgactcacttattatatctaataattgttttgtggcttccttagtcttttccatatagaaccattcatcagtaagcagagatagttttacttattccctttcaacttgataccttacatttctttttcttgcctgattgccctggctagaagctccagtataatgttgaatagaaatggcaaaaatggatgtccttctcttgctcctgatcttagggggaacgcatgcttttttgccattaagtatgatgctagctgtttgcatgtatgtgtgtgtgtgtgtgtgtgtgtgtgtgtgtgtgtgttttaaccaatactgagatttcaagctgtggggttttatagatgctctttatcaggttgaggaatttcccttttgttcctactttgttgagtgtttttgcatcaagaaagaattttggattttgtcaaaggctttttctacgtctgttgaaatgatcatgtagcttttatgtgtagttcaattaatatgacatatactcattaattgattttcaaatgttaaaccaatcttgcattcctgggataaaacttacttggtcatggtgtacaatccattgttatattttgctggattccattgactagaatgtgttggagaattttgcatttgaattcatatgcaatatttgggattgggggccgtatgtgtgtctttgtctggttttgatatcagaaaagtactatactggtctcatagaatgagttggggagtgtttccatgtttccactattttctttttttctgttttttttttttttttgtgagacggagtttcactcttgttgcccaggctggagtgcaatggggcgatctcagctcactgcaacctccgcctcccaggttcaagcgattctcctgcctcagcctccgaatagctgggattacaggcaggcatcacaatgcctggctaatttttgtatttttctagtagagactgggtttcaccatgttgatgaggctggcctcgaactcctgacttcagatgatccatcctccttggcctcccaaagtgctgggattacaagcgtgagccactgcgcccggcctgttttcttttttggaagattttgtgaagatttggtattaatccttcattaaatccttggaagaattcaacatggaagacaacttcagtctgagcctgggcttttctttgtgcggagttttaaagattactattgcaacccatttacttgttatgactcctttcagatttactatttcttctcaagtcagttgtgatagttgtatctttctaggaagttgtccatttctttgagtcacataatttgttgtcatatgcacttggtatgcacttgtaatcctttctatttccatgaagtctgtagtaattattgtagtgtggtctaatagggattttctttccccccattccttctctattgatgaactagaattcttagaacagctgtttttctttcttattgatttgtatactccatgactgatgtcattgtagtctactggaaatttgttttattctggggatgatcagtggatattaatgtaattgatccttttgctcacactgttccaggctgtggcttttgggagctctttcaagctggctgtcctgtccttcacaggccccaggctttcttctttctgaactctcccttactctctgactacatgggctgttccaggctcatctattttggctggcccagctctagaaccaaccacttctcctgagggctatataacttttctaaaaaatatattattatgaatttgtggatttaaatataatttattgattttagttcattgcagttattactgtaattgatttctttggtcagtaggaaccaatcaagttgtctcctgagtctttttttttttttctttttttttctgagacagggtctaactctgttgcccaggccggagcgcactggtgcaatcatagctcattggaaccacaagtggtcttgtttttggttgttttgttttgttttgttttagctgattcttttggattccaccaggtcttgccatttttaatgcagttcttctgtacctttcagtggcctttgaagccccacctgcctgttcctgggtgctatgccatggcctgcatggtgctcatttaatggtcattcattgtggtgattgtcaattctcaggttccatccttcctgcaagtaaggggtcaggggtctcatctgggggggagtacttccttcccgacgtgttggtagacatttaacaatcacagtgactggcagtgtccctggcactggtactcacaaccggggttactggctgacatgtgatggccccacctgcccaggaaggtcctgccccattgactaccctttcccaaaggccagtcaggccttcactgagaagcatgtttggaagaaccttttaaagacagggcttccccacgttttgggaaggttgaaaaggggctgggtgactgttagactcctgctggtcacaacatggtgcttcagcttcttgttgaactcctgcagcaggggagcccactgtgcacatttgtacaagactcaccttgccatatttagcacactgacagaacttacaggaagcatgaagagctattttgatttctgcttttttagaagactcttagcctgactttctatgtttacttgttttgcattttcccggagtgcagtttgtatgaattaccctgcacataccttgtggttatttttccactggggatactgtattttggaacattttgcctaccaaactatttttattaggcaattaagaatttttgtcctcattttaagttagagacaattaaaacgcccttgtaggggctagaggaaaacttctcctttgccctctgaaagtttgctggaaatcaactgacaaagggcagattaacaggagaaaaggcaagcacatttattaacatgcatagcacagaagaactgtgggagaatgattgcccaatctcagtggagtacgcagggttatataccctccttctcaagggaaagggagatgggaagtggggatgattgtacaggggtagtaaatgagttttaggggaattcactgtgcttgaagaacacaccatagtctgggccacagtctttgaggcctgcataacagacagtggtttgtgacaaaagcctgtccagctgtgttgacagacttcagtttttcttcccacaatatgaattcagttaataaaaacctgttttcctctttggagtgtctggattttaggtttagggagagaagggaacttcggaggagttcatcttgggctttgggtgagacagaggattgagaggtgaggttggggggcggttagagagacgctgagggttctacagttcagcgcatcaaagtgccatattttgcgatattggttcctgagccccaacaccctcaatgaggtcagacccttgccagcagttagatgctaggcagaatgcatttctcttcatcccagtgttcttatttaaattggagggaagatggcattcaataggagggagtataacattactttggagggaggatggcatttaacaggagggaggatggcattcaataggagggaggatggcacttaacaggagggaggatagagggaggatggcatcaaattggagagaggataacattaaattggaaggagggtggcattcaataggagggaggatggcattaaattggagggaggggaagagagaagatagcagcttctggtgtgctgtgaggaatacatgaaataatgcagagagggtgggctacagtgccaggcaggcaggcaggtaagaatttgaaaagtttagttgcaactcattagtattcctgttacaactgctgtcattattgctattaagatcttttgatcaaaataaacttcctcagtttttttaaatttctaaaacagttttatttttagagatgaggtcttgcagtgtcgcccatgctggtctcgaactcctggcctcaagcaatcatcccacctcagctcccaaaatactgagaccgcacctggcctgtccacattgctaagacactgaattgtgcctccaagcccaaagaattttaggtgtcatttagctgtatacttgtaccatgaggaaatggacagcttttggaaagaattttgaaatattgggaatagatccgatccccactgagaattttgaggaccactaaggatccagagataccctctgttggctcaaatgtcttctgaaaaatgtacctcactagaagaagcattctggggaaatggtaacatgaaagcattctttgtttaaatggcaatgtggcgtatattgtaaatgaaattggatttggtaataaccttttagggggaaggtttgttttgaaaacataaaatgaagtaaattcattggcccatttaacgatgtctttgattgatttttgcttatcaacagttataacaataataattaaaaaaaaaaacctaaagtaagtcttggttttcaaaaggaaactcaacctaggccacgaatggagagccttggaacagagccctccatgcaagtcttctcagaaaggtgcttagtaggtgctttggaggcccgtgagctcttgcatagtagggaactttagatccgctcagagacctgccttatttctgtttcagcatcagatctgcctgttgtatagtaatctaggacttttctagaaaggtcctggggtgcgaacggacctcagcgtgggccaggccagacttgacaaggctccctccccaagttcggcggagtccccgagatccccactcacccctccccagcctctgtttgctttgcttcccccaagaagtgatgtctggcatggaaaccactgcttctaaaagaatccagtacacgaggggttaacgaaatggcaggaaacccaggctgtcaccgcacatttgaactgagtcatttgtagagtttaaagcatttcactacttttatgtcctgccttttgtttttgtatacttctaataacagtttaaaaagtcaggggcaggaaaggtaaatgtaagttccaagttccatcctttgttcagatgtgatctttgggcccttaggtgctctgtgcaggaggggaggtgagcgcggccaggtcttggggggtggtgggcgtggtctcgccctgcccgggccgcggagtgagtcaccggggctggggggggagggagggagggagaatggagcagcgctgggtccgctgccgccggacgctctacacagttccagttctccaaaactggccgcgtagaatggcgcctggggactcgcctcgcctgtgggctggcccccagggtgtggccacatccctttttctgggcctttcccttcagggctcggctgaggcggtaccagacacagccggggcctctcctgttgctttttgccaagttggaaatcagttttgttccccgtacaaaacgcatccacgctgtctgtctcggtcatctccagtgctgcaccttggcccaggagcatggttgactcagaaaaccgagagcattgtgagaggaaagacgaggcagggagagagcgagctggggaggcccctgttcctgctgggtgctccccactgactctctctctctgaacaagccaaccatttttgaacataagtcaaagcgatattttccagaatgtctcatacacataatgggctacaattgttcacctccactgaacagtttcaaaatatacgtggcatgtaattattttctcaaaaagggtaatcttatcgacctgcgtgatttaattatatttagttatgtatgtcttgtccctcataattaattggtagaaacctaggtaatggcatttcatagtgccatcgtgtcattgtcattattttatttattcgtgttgccaggacagactttagtcaaatcagatgtgtgtgtcttttttaactctcattgtgacttgcattgtaatattttccatgtacacatttatttttttttttggaaagaaaatcattgcttttaagcaggatggaaagtttgattcattccatagaaatctggctgctgcctgtggtctttcacatccatggggagcatgtctgggggccaggaggccatgctgacagagaccctcaggttctctctggcatggaggtgagagccagagttgagctcagtcctgcagctgcgccgtgctcctccttgatcacggttaaattcctccgtttctggtcttttctctttttctcctttcagtttcctatcctgtgttaattcctctgtaaagcgtctggccagacttaatgggaattccttcataatgcgcccttgggacttggagaaggcgtagaaggagggagggtggtgtctgtaattcttggctctgttcccaactactgcatgcagtgacatctaaactcagttcctgcttattcagtcctgtactaaggatgtctttttattttctcttgtctggtgctttgacatctggagccttgctgcctccggagggacaggccctcccagggctagataattcctagagatagcaaacagcattgctgcagcatgccttacgtgtgcaagccacccaatccaacgtccacaccctcggccccctctgtgtttcatccactgtgcacctgctctcgtcaccccaggtccagccaccaagcagctagggacagccctttgtcccagggtccaccgaggttattcaaactaatggattctaaacctgcttaccccgcctctcctgttctttcccatggaaggcacagaaaagactctccctcctctcaccaaggtctctgcctcctaggacgctggtctcccctatgttccccctcccacagcggtaggtgtggcgagctccttctctggaggactctgagtaacaaatcctcttttcaatggcagtcctctcctgacctgtcagccccatagtgcttgaataataatagaacttaaattgtaaaacatccctggagctactgccctcccttaggtcccatgagaaagggnnnnnnnnnnnnnnnnnnnnnnnnnnnnnnnnnnnnnnnnnnnnnnnnnnnnnnnnnnnnnnnnnnnncaattctaattcccctttctcttggaaaaagatggggagattattctggagtgaattgtgggcccagtgtaatcacaagtctgtaaaagtggaagaaaagcgggcagagagatccgatatgaatactacttaatttgccattgttggctttgaaagtggaggacctagagtcaaggagtgtgggcggcctctaggagctggaaaaggcaaggaaacattctctcccgccgccctgccgaaaccatcgttttgacccagtaagatccatgtcagattgacctccagaattgtgaaatgacagatttgtttagccggtgcagtggcacaagcctgtagtcccaggtcctcaggaggctgaggcaggaggatcacttgagaccaggagactggggttgcactgggctgtgattatgctactgcactccagcctgggcaagaccccatctctataaaatgaaataaataaaataaaactccccaaatttgtgttacttcaagccaccaagtggtcataatttgttgccgcagcgggaagctaatacatgtgttcattgcagagtttaacaaacagataccatgtttatttttttgtttgttttgcatcctcattttacagatgattaaaaaaaaaaacactttttagaggccaggtcttgctgtgttgccaggctggtcttgaacttctgggcctcacacagtcctgcctcagcctcccaagtagctggaaatacaggctctatctgccatgcctggcagaaaccaccttcttaactacagctttttgtgtgttaatattgattaagatgatttccgttaaaaaatggctgtaggccaggtgtggtggctcacatctgtaatcccagcactttgggaggccaaggtgggtggattgcttgagctcaggagttggataccagcctggaaaacatggcaaaacctcatccctacaaaaaatacgaaaaattagctgggcatggtggtgcatgcctgtagtcccagctgcttgcgggactgagattgtttgagcacagaaggttaagagtgctgtgagacgtgattatgattgcactactgcactccagcccaggtgacagagtgagactctatctcaaaaaaaaaaaaaaaaaaaaaaaaaaaaaaaaggctgtagctgtttgaattagctaggaatatatggaatagctccaaattgcttagtgggatcatgaagaccccgtgacccgcaaagatcatgatacggtggaaaaaaggtgctttttaaaattgttgttcaaatacttagtgataaaacttcacgtatttctctagcaccatatacttgcctgaatttttatgaatttgtatggtaccattcttagctagctctgtgaagagcttataaattcttcattgttcctgtgaggaaatgggagcccagagagggaggtttcagtccaaaaggggcagagcctgggagcagaacaggtggccctggggctctggggtcccaagagatgttactcagggccactggctgagtgcctgcgcgtgctgctcagtcagagcctcctgtgtccctttgatctttgatgtgtgtggatgagatcaagttgtttaaatatttctggcttttgagaaagtgtctaacaccagatagttatcctgataaaagccaatacccagaatttaacaaggatagctgacaaagatgctctatggatgctttttagaaaaatgtatatgttattgatcctttttagtgtagctggttcattacagccacagtcttcagatgtttttgatctcacacctctatcagtaaaaagtgggcatgtgcacccaaagtgggggtgtgtgtatttatttataaattaccggcatgtaatgcataaatatcttatatctattgaaacatacaaaatataaatgaaaataaaataaaccacaattacaaacaaaggtggtagtgtttttctgcactcctgtgatggtgtatgtttttgtgtgtgggcatcactttaggcaccactacccagaacatcttccaggagctttatgttgtgatgtcattttagatcactgaaggaacattgcacgtgtcaggcacgtgtccggcacatgtcaggctaggtgattctcatgctgtctcttttatccagggatgtttaggaaggcttgaagaacgctcagcagtgtgggaccaccaccatggtctaccctcatgcccaggggtggcccttctgcgctgagcatgtcagttctgaaggttgaggcatgaggggtggggcgctctgactcctccacttcctggaagtggaccacgtgctaacttggggcttgtcactgtcacactgagcagctgagctgtgctccactggcacacacagccttataaccttaagcgtgttctatcttgtgctttacttttaaaaaattgttttattatggtgaaatatacataacataaaattagccatttaacccttttaagtgtgcagttccgtggaattcaataccttcacattgttgtgagcatcaccgccgccctcctctccaacactttttatcctcccaaacggaaactttgtgcccgtgaaacactaactcccccttcccccatgcccagcccctggcaacaaccgttctgcattcagcctctacgaagtggactgccctgggtgtctcacgtgagcggaatcacacagtacttgtcctttagtgaccggcttatttcactcagcatcgtgtcctcaaggctcatctgtgttggagcatgtgccagagcctcctttctgaggcggacaccattccattgcatgaacccaccaccacatcttgtttatccattcatctgttaagggacccttgggcgcttccaccttttggctgttgtaaacagtgctgctgtgaacatgggggtaccagtgtctgtttgagtgtcttgcctttttcgtccttggagacattctgcatggattccgggacggctttgttggggtggtgcctagggcagcatgcaccctggggaccctcccacggtagcatttgtgctgctctcaggacctctagggaggtggccccttaactcactatgctgctgctgccagtggagaggtgtcgggccctggctgggtgtttactcccctccctgtagtcctttggccagggagcccaggagagttgctgtcagcatgggtggggtcgggtgccctgtctgtggtcttgttgcctagatgtcatcccacactttctctcaaccttgacacttcttgtaaggccctgctctctggtaacagggacatgactgtgagctcgaggcagagtatgcaaaacagttccggggaggctcagtgtgtatgttggtggaggtggccgggccttatcacagttaacttcggccatcacccaggtggcctgacacacacacacacacacacacacacacacacacaaacacacaaacggtccgtgctgatttcctgattttgaaggcttcacttggtcttcttggccttttgttgaatatgtcactgccaccttcgttaatacattcagtctgtgtcccttgtgcgtgcccagattcctggcagtcagcagtgagaagctgcctgccagcgctccccgcagttcccaagaggcaccagccagaggggctctgtgagaggcgaggtcttgcttggtgagtgtccacctcatcacacactttctcctggtgtttgggggggatttgtggagaaccactttctccgggtatttggtaggagtttatggaaaaccttttcattcatccctttgctatggcccttgttcaggcctgtgccccttggataaaatcagaagcacacagtgactggggatgggagggacagggagaacagccatgcctgaaacctgtcatttaagacaagctgaagccacctcatgtgccggtgcaggctgccagcccctccttgtctcattttgcagacaggggctaagcatgtccccagacggcaagccacagggtccacaagtgctggctgtttggcagctcgtgcacagccaggtctgccctcctcactgctcgcccaccgcagcctctcagggtggtccagccaggaggggcaggagccctcttcttcctttgccactcagggtgcatggggcgggcaggaggatcaggttggggggctgcaccctgagtaagtgcttgttctccctacattttaaaagctcacaggaaaatggagagtttttcctgaaagaaaacaatttcaattatttggtttacttttgattacctgggcaattaatatccctttattttaaaatatgacatcataaaatcaaatggactaggaacatggtgataaaatagaaaaatatctcttaaacttcctcagtttaggaagacccataaaattcccttttacttgcctcataatttaacttgaggttgcagtttatgagtcctccctttcgtagaggctccagctggcaaagacgtgccgtggagagaaacgcaccacctgttccctcagggtcccttctactgaatggcagattctcccctcgtctttatgaaaatgttcaaattgcagtgttgtgacacataccccttgtaaataacaaatatgcgagcaaagtgtatgacagaggtatgttttaataccgtgtgctttgtggccttgtatcattagtttctgaaattttgactccttcatgttcttggggtgacagtaaaatcaggtgatctctctattcgatttgtcttgaacacaggtatccactgtggtgggcgctgtctcagttttggcggtgggtgatagtgtcatttcagacaagcactctaaaacagctccgcgagaccatgggaagcaggaaatcggctaaaagggagactccagcccttccagtgcctggtccgtgttcttgaacttagtttcttgtgttaaccggaaagtgcatccaaaaatagcttctagagttagtggggtctgcgacgggagctgtgggcatggcatgattttcccagatagctcagatgggagtttccctgtggcagccgtgcgtctgtctttctacaggggaccagttttcccttgaatacccccaaaggaccttttctactctggatgcctggataaactctgagtagatggagtctgggagggatgtttataagaagctgtattcactcataggtgtctaagagggctctaagcctctgtgcctgcttttgctgtgatgcgggatgcaaatgatgaattcctgcacagagaggagtaactcttttctgcaccaagtctgggctctggtttgggaaaatctatcatcctgtctatacagaggcacagttcagccagattcttggtgaatttatgatgctccccactccccgtttaaatcacatctgtctctctccacttgcactgaggagtttccttccatctctgaactttgacatatgtggagctgtgctcctgggagcctctgcacacactgatgtgggtttgggtggtgataggtggagtgccgagatcacaccccgggacggtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcatggcagccctctggtgccagggaggaggcacatggcgtgactgcgctggacatgagtttagcttaatttcgtgccaactgttggcacctcctggcagccactcagaacaataggttttgaaattctggataatggagggtgatcattttgatatttaagtaagcctgcttggccaggcaccatggcttgtgcctggaatcctagcactttgggaggctgagataggaggattgcttgaggccagaagtttgagaccagcttgggcaacatagtgagattccgtttctataaaatgtatacatacataaatagccagttgtggtgatgtgcatctgtagtcccagcgacttgggaggctgaggtgggaggactgcttgagcccaggagttcaaggttgcagtgagctatgattgtgccactgaactgtgagtgacagagtgaaattctatctcaaaaaaaaaaagtctgcttgattatggagtcaaagacgtttacctatctatacaatcagagataatgtttatgactgagacctaaaagactgttgacatattcattctattcatcctagtatgaaaatcatttggctcctatagaaatatcccccaaaatacaaggaaatgaaacccagtgttttattttctaggcagtgcactgaaacacggtagaaaactttaaaaacaggggcttctggttttagaacaagatggcgtagattcatttttccctgctcctccccgtgattacaagtaaataatttaacaagaaacagtaaaaggacgctggaaactaaaagcaggcagactgactggggcctcaggacatgagggggtagcaacaccatgagaccctggacttctgttttatctcctgtatccttccagtgtgggcacaggaaggcctgtaaccagaaccgccaacaggtatagagaaaacaaaataaagcaaaaccaaaaggctctgtcaggccaaaggggaagctcagtgagacctagtgggagcccaaggcccgctccacacccaagccaccagtggacagcctgatgctgctgtgtggaccactccctatccggtggctccaggagacccagacccaggggcttttgcccatccacccacaccacagcaacaggtggcccagggaactgccttccactcctttatacagagcatttacaaaaaacctacaaccaatttcacagttgaggatgaaagactgattctacaaaacccaaaacaaaacctcttacaactgaaaaatgagctcattacaatgacaggatacaagatccgtggctatgaattgactgcatttctgtatccccacaatggactagtgaaaactgaaatcacaaacataataccatttacagttgcaccaagaaaataaaatacttacatataagtttcacaatgctcatacaggatgcaggatgaacattacaaaatgctgatgaaaaatatcaaggaacatctgaataaatggagagacttcccatgttcatggatcggaaaatgaacataatagtgagtcagttttctctataattatctatagatttaacgtaactcctatcaaaacctcagcaatgttttttttttttttgtagacatacacaagcttattctacgtggaaaaacacaggtccaaaaatgtccacaagatttctcaaaaagaataataaagtggaagcactcacttctcccaatattaatgcttactgtggagctgcaaagtgtggtatcagcaaagggatggcacatatgtaatgaaccagagtgaagaacccagaaataagtcccaacagatatgcccaattagtttttgacaatcagttcagtggaggaagtatatagttttccaataaacggtgtgggagcaattagacatccattagaaaaaaaaaaaaccctaaacctcacatacctcatataaaaattaacttgttaaagattatagatttaaatgtaaaacgataaaacttctaaaagaaaacataaaacatttttgggatctaagactagacaaagaattcatagacttgacaccaaaagcattatcctttgctgtgggaaagatccaatgaaaaagagcagagaaattccagacgagagagaatatttgcaaatcacatacccaacaaagcactaatatctagaatacgtaaagaactctcaaaattgaacattaacaaaacaatgaatcctgtttaaaaatgggcaagacatgagacattcactgaagaaggtatgcagatggcaagtaagcacatgaaaagatgttcaacatctttacaaaacagggaaatgcaaattaaagccactcagagataccactgcgcatctatcagaatggcacaaataaaaagagtgataccaccaaacgctgctgagggtgtgagaaatgggatctctcctacgttgctgtgggaatgtaaaacatacccactctggaaaatagtcccttcacaaaactaaaaatagaattgtcatataatccaccagttgcactcctgggcatttaccccagataaatgagaacttacattcacagagaagctttgcagaaatgttcatcgcagcatttttttttaaataataacccaacactggaaataacctagatgttcctcaaaaggtaagtggttaaagaaactgtgatccctccatacggtggaatactagtcagtagtaaaaaggaacagactgttgataaacacagcaacttgcatgggcctcaaggagatttcggtgaatggaaaaagcctgggagctaaatgatgagaattatgaacagaaagaagggaacaacagacactggagtctacctgagggtggagggtgagaggagaaagagaagcagaaaagataactgttgggtactaggcttaatacctgggtgatgaaataatctgtacacaaacccctataacgtgagtttaccaatgtaacaaaccttcacatgtgcataggtttgttacctgtgtaacaaacccccaaacctaaaataaaagttaggaaaacctaatttcaaaaggatatatgctgcgtgatcccatttatagaacatttgtgaaataacattcttagggggatgagggacaagttagtgtttgccaggggttagggatgcaggagggggtgaacgtggccccagagaggtagcatgaggggtcttgtcccattggcgccatcttgattgtgtgtgggtactatttcggttgtggttgagaaactgcacagatgcacatgcgcacacacacgcacacgaatgcacttaaagctagagaaatctgaataagctttgtcggctgtaccaatgccaatttcccggttttgattttgtcctctggttttggggcatggtggccttaggggaggctgggtgaagggtgcatgggacctccctgtacatttctttgcaacttcctatgaatctgtaattattccgaaataaaaagcttaaaatatgaccattgagttattaatggtaaggagtcagcataagaagaagacatggaaatttggtgtgcccagtgcacatgttgcccaggtggggctcctgccaacggagtgcccagtggtgggaatgtgaggttttcaggacccagcatgctctgcagagcgggagagaggacgagcctgccgccttgctaaggagggctagtgtagatttaccctctttccagcagagatgaagatcttggtcaacggcatctctcacgggtatgaagataagcattaagatttatgagtaacttgagggagagtgggagaatgttgctttttttcccccagacctggcctctaaggagacttggctgtctagttataaagggtacataaaatgctctggaagatgagattacattaactcctggaaataccaaaagtactttattttaatgtacttgttcttgtagttatgagcaatttggataattacagttggcagggatgcgccgacgcacatacgctggagttacatattatcccagccttgatcctgggaatatcacagcccttcacctgtgacactggagtttaaactggagctaaggtgtagccagtgtcttctaaacagaatgggtattggatacaagcccgctgttaagtcattgctgtcacctaggtaaacatgcctttgtaacacagttatgagaaatggacaccaaagagaaataaatactatactgctatgggatattcctgaatgacccagcttgtggttagacgcattgctccaccagacaagtttacagtgaactcggggcaggtgtcttgcagttatatgggaagacaaggaagctctcaataggaaatgcttctgcaaacacactgctcgctcaccataaagaaaggctgcttctaacattgcagtagtaccctggagtaaagcccgtcctttccccattttctcaggggaaataagtactaaggaagtgccacatgcgatattatcatcaagcgccacaactctcaaagggctgcttctcttaaaaagccccgagggactctgttgcatagtgagtttaaagatgcagaaaatcaaaacttcatctgcacttgagtaataacactccgttgctggattactaaaatatgattctaggatggagattaaagggcgacacctcagctcccagccaagccctgaggttgtaattctatggtgggagaggccccttaggctttcatattaacagtgtggttagggaggttgccaagggtggctttgctggggatgtgaaggtgtcactgtcaccttgctgggcatagacaaggcacttggaatggacagctccagggctttcactcctatctccctaaaggaatctaagggttgggcagacacctagcgtgccaggtgcaggcaagtcacctgggtgagatgggcagtatattccaaagtgttaggcctcttaggctcttatttctgagtaataagcacttttttgagtgtgttggcttcacatttgattgaaacatcaaagcatcacagtttctgttatgttcaaattgggtcaaacaagtgccatccagacagggtatggactttcatacctttcatcatcattgctctacacgttggatgctggttcatgtttaatgaaatgtattaaagttgaaatcccaggatgccctagttttactaaaacagtgaatcttgtacattaatctgtgcaaactagctccatggcccggagccctggcagctcagctgtccctcttccatcctccacactgccaaggggcagtgagaggctccagcataccttccttccaagagcactgtcaccagttccccctccccacccgtcttccccactgcctggctccccttccacctgagcctgccacgtgctcctgagcagtttccccttccgttagcccagagccttccccatgccctcgagctgtttcccaggaccctgccagccagcgcaaagcaggaaggtgcctttcgggcagtttgctgtttgtggacgtgcttgccttctggtccattacccagtggcgctcgttcatgttagatgggaaatcctctgagggctgaaagacactttcggctttgatcttcaggtcagcaggaccagtcagcatcaacatctactacatggaaagccctaggtttatgcgtcctgcagccttgaaacttcctgccctgtgactaccgtctccgcatttctcccactccctgcgccgggagcctcctttctactctgtccgtgtgtttgagattgtttgttagcgtgagatcacacagcatctctgtgtctggcttatttcacttcaggtccctcaggttcatccacatcgttgcaaatggcaggatttccttcttttaaaaggctgcatagtattgaattgtgtgtatatacaattttctttatccattcattcctcattggacacttaggttgcttctgtatcctggttcttttgaataatgctgttgtgaaccctgttgaggggcaggtaggaaaaataagcctcaaggtctaatgcacagcatgaggactgaagctaatatggtagttactcttgtattatataccggaaattggctaaaagagtagattttgggtgttttcaccgaaaaaaaatgaggtaactgtgtgaaatgatggatatgtgaatttgcttgactgtggtgatcatttctctatgtatttcactacgttatatgtatatcaaaatataatgttttgtaccttatatgtatataataattttttttaagaaaagagagccccatggcaggtggtgtgtggacctgaaggtaaatactgggtcttgccttcgagagacttgcaggccagggagagggacagcacatgcatagacggtcttgctggatcggagacttttgcaagtgacttcagccctcatctcctactgtgaaccgacagtaacgatagtgcccacttcctagggttgctatgggcactggtgcccatgagccaatagctgcaaaggattcaggatggctcctggcacatggttggcactgtgtgtgtgtttgctagaggtagggacaaagctgcctgagggaacagggaggctgctcagctctggccgcgctgcctggaagacacccttcagaaggtgctgggcctgtccagccttgatgttcacttgggtagacaggagtttgatgaaatcgacgtgcgtgattgcctggctttggtgttcagcctgcaccgtgagccttaaatgcttctcattttgcagccagtgttgccactctgttgttgggtgtgtttctcttgccaagctggacctgtaggatggttggttcagacaacccgcggaaaggaagttggaaagagaagagaattagcaaagaggaaaggttagaaagagagagttgaagttatatagctgggaaaagaggagcaggaatagcatagcaactaagaggaagaaaaagtagaatactcccaggctgggggcccacacctgtaatcccagtactttgggaggccgaggcaagatgatcactcgaggtgaggagttcaagatcagcctggccaacatagtgagatcttgtctctactaaaaattgaaaaattaggccaggcgctttggctcatgcctgtaatcccagcactttgggagcccgaggtgggcggatcacgaggtcaggagatcgagaccatcctggctaacacggtgaaaccccatctctactaaaaatacacaaaattagccggccgtggtggcaggcacctgtggtcccagctactcgggaggctgaggcgggagaatggcgtgagccccggaggcagagctggcagtgagccgagattgcaccactgcactctagccttggcgacagagtgagactccgtctcaaaaataaatagataaataaataaaataaaaaattagctgggcgtggtggcacgagcttgtaattccagctacttgggaggctgaggtgggaggaccgcttgagcccgggagtttggggttcagtgagcaatgatagtaccactgcactccagcctgggtgacagaatatgacccagtctcttaaagaaaatataaaagtggaatactgattgggagggaggaggctgtgcccaaggatgaagtttcctatggccggccttgttgtgtgcaaagggccaggcttgggaccctgttcaggacaattggcaaaaactgtgctgaccccatagtcaggaaagcagctatggtccctgccctcactgcgaccagggagggagctgcttccgtgggctgctgctcctgcgggggctttattgagacccacttcacgtaccatacaattcacccagttaaagtatacaattcagtagctttttaatatatttgagtatctgggagagttttgcatccattgccacaatcaactttagaacattttaaattaactgattaatttttaagagataaggtctcactctattgctcaggctggagtgcaggggcatgatcatcactcattggaacctggaacccctgggttcaagtgatcctctcacctcagcctcccaggtatagctggaagcacaagctcatgccatcatgcccagctaatttttgtttttaaaattttggtagagactgggtctcactgtgttgcccaggctggtctcaaacttctgccctcaagtgatcatcctgcctcggcctcccaaagtgctgggattacaggtgtgagcaactgcacctggcctagcacatttttagcagaaaaatgagccccatattccttagctgtcacctcctaatcctccacagatttacctagtctgcgcatttcacaaaaatggatcatgtgtaatacatggtcctttgtaactggtttccttcacatagcatgtttgcaggctcattcatattgtagcctgtatcagtacttgatttttgttcattgttaaatggtatcccattgtatggatgtaccacatcttgtttatccatttgtcattgatggacatttgggctgtttctacttttggctactatgaataatgctgctgtgaacatttgtgtacaagttagtgtatagacgtgtgttttcatttctcttgtgtatgtccctaggaggagacttgctggagcacacgatacccctgaggtttaactggagagctgtttgcattcccaccagcagttctccgagggttccactttctccacatcctccaatgcttacctgtctgtttcagactctagccatctatcgggtgtgaagtcacatcttattgtggtttggatttgcattttccagatggctactgatgttaagtacatgatgtttgatgtgtttattggccacttatgtatcatctttggggaattgtctagtcaaatctttcacccatttttaaattcagccttttattatttagttgcagtttttagtagatacaagttccagtcagataataggacttgcaaaaacttttccccattctgcaggttgtctctttgcttccttgattatgccctttgaagcacagactttttaaattattatttttaattgacaaaaaattgtgtatatttatggtgtaaaacatgatgttttgaaatatatatacattgtggagtaatgaatagttaataacacacatagttagtagttaatagcatataatagcataataataaataatgacaatgtattgtatacttgctgagagagtagtttgttttttttttgtttgttcgttttttttgagacacagtctccctctgttgcccaggctggagtgcagtggcgccatctgggctcactgcaagctccgcctcccgggttcactcctttctcctgcctcagcctcccaagtagctgggaccacaggtgcccaccaccacgcccggcttattttttgtatttttagtagagatggggtttcaccgtattagccaggatggtctcaatctcgtgatctgtccgcctcagcctcccaaagtgttgggattacaggcgtgagccacggcacccggctgagagtagattttaagtgttcttagcacaaaaaaattaagtccatgaagtatgcaggagtaacataggaactgagaggaagaaaaaatggaatactgcccggcgcatgttaattagcttgatttagccattccactgtgatccattttgtaataatttttcactccagagtgaagagaagtgtggtaggggtactctactgtcaaactgctctttaaataaataaaagtgagggttatcacaagaaattcatggtgagcaggcctcagaccagtcatcttcggctctgcggggctggacttctctggctgtttagagacctcagtgttgcttttcagtgaggtcttttggggagaatggccagcaggcattcatgctttttattctttcaattaaagataaaaataaaaaaatatgggcccggcgcagtggctcacacctgtaatcccagcactttgggaggtcaaggtgggtggattgcctgaggccagcagttcgaaaccagcccagccaacatggtgaaaacccgtctttactaaaaatgcaaaaatcacccacttgtggtaatgtccgcctctaatcccagctacttgggaggctgaggcacaagaatcacttgaagccaggaggcggaggttgcagtgagccgagatcacaccactgcactccaacctgggcaacagagtgagactctgtctcaaaaaaaaaaaaaaaaaaagaataaaatagattaaaaaaatgtaattgacacataacaattatacacatttgtggagcacagagtgatattgcctatgtatacggtttgtaatgatcaaattgtgataatcagcatgtctatcacctcaaatacttatttctttttattgggagcattcaaaatcctctcttctagctattggaaaatacacactaaattactgttaactatagtccccctgcagtgctgcggaatgccacaacttatccctcctctccagctgtagtttagtatccagtaacatactcttttcatttcctttctttgggcagaaggctagatgttgcctgtttttgttttatttttctgcttcacatatagcgcacgaaagcagagtgtattcaaaaaaggaaatgtgtttgaaaaaaaaaaaaggaaacgaatttacataggacctgtaagcataagacaaaaaatggaatctggtcattgacaaccttaaatataaagatgccaattttagactgcgacaatggtccagaacatgacagatctttgtgatgactttgccttgcccggcacactcacaggcagctgcctttgctgaaatgaggccttgtgtctgctaggagagtagcactcagattttccacccattgctgaatgagtttcctgaggcttctataacagattaccatacaccaggtggcttaaaccaacagaagtgtattctcttacagttctgaggcttcaaggctgagaccagcgtgtgggcagggccgtgctcctgtggaaagctctagagaaaaatccttctttgcctcttcctgcgtctgtggtggccgccagtccttacgtcccctgtcttgcagccacgttgatctgatttctgtctctgtcttcacatggctgtcttctctgtcatgagtctctgtgtctctgttttctctgcttataaggataccagtcattgggttagggcccgccatactccagtataaccttatcttaactaactatatctgcaaggatcgtatttccaaataaagtgacattcagaggttccagatggacatgaattttgggggacactattcattcaacacagtgtaatcgccaaagtcacgtactggcactgtcctactggcactggagggtttttgtttgcttgtttattttaagcattccattttgctcatgaataatgagttattaacagcaggaggttcagaaggttgtgtggctctttggaaatatatgacaatgctatcttctagatcccctcacctgggtcaggcagtgaggtgttgcccataggagcctctataggtgcaggttccccttggtaccatgctttgcacatcgtgtgagctcagagtttgtggacagatagaaactcaggaaacacaaaatatcgatccatatggtatttagctgaatctgtgaagactgtcattgattgccaagaattatgaggatattgctaagtcagtggcagtcatttacactccacaaaaagccattttcacatctcgacacactgaacatgtatttttagagaatgactaaatgcagttccatcccctattaggaattccctgctcgcagcattctccaggaaaatgttgtcaaggagattaactgtccacatgggtgagtccagcatttttctgaggtagcacaaacacacagagcccattacagttccaggacttgcccaacaatgtgtaattgcagcggggagagaatctcatacggggtggagcccccgaggcccccgagccacacacagctttggaatgaggtgggagagggtatgggcagcggtcctagacatccagacactgtggagggtgctgggtatgcacggggtccagcctgtctgctgaggagcgggcagggcatggtggggaaggtggggtgagtggctgggacttttgtttgcatttcattgcagactcatcatttgccccaaatataattttggctttgaatcatgtagcgaagcagccagatgaagggaggcccggcacagccaaagctctgaagcctgggaagtattgccgtcccactctgagaacatagttcagtgaatcattttcctggcttcctttcaaagtctgaggaaatgaagtccttaggtttgaaacagtgattcccaggagcaggtaagtgctgaaagcctcatcaggtggcacgtttactaaagccacttgtttcttttgaaacaggtttaatatagaccatcttaaaatgtcatgacctcatgggacaatgcagggggacagaaataagttgtcacctctgagtttgggactgaagatcccagagccacagtgagggaagacggaagggggccgtggcgaactgggctgttaagagatcatgtggccagtgcagggacacaggacccccccggagagaaagggtctgggtctcctcctgagagcctgttcaggaatctccaaattcttgaacttgtggcgtggttttctttggaaaggaaggaaggtgtaaagaagcccaagtcagtttctcacttgagaaatgctgttgcaaaggggcagtgtggtgggaattttaacctttgccactccctctagcagaactgtgtggttttggacaggctggccgccagtttcagggcacaatagagggacacttccacccctttcagtgacttcccaaggtggctctgcagagcaccccttaggagagtggagcctggcctctgaggccattctgaatgaggggaaggtggggatgacccaggaaggccagcgctgcatggctgcaccccctctcctgcatttacccccaggtgcctgtgctggcagcggcacatcaccaggcctcctcctctccgtggctccattcacagctcctgctggctgaggccttggacctggatgcccaccgcacttctccccgcctgaaccacctccatctccctccagatggtgaccgaggcctcctagcttaccctaaccacctcctgcctccaccccggcccctagcacacacctgagcatcctccacccaatggccaaagtgattccttacaatagaaagcagactggggccctcctcttcttggaagcctcactgtcttcccttccctgggagtgagatccaaagtctttgcttgacccacagggtcctgtacctggtggcccactgtgtccctcccccgtaccctcactctctgcctcccatcccactacgccttggcctcttgggactccagagcgagccgtgccttagagccctgggctgctgccccttcccccagctctctcctggctcctgcctagttcaggcacctttcccagtgtcacactcccagggagatcctccctaaatgcctcatctctgtccctactctgtttatcttactacagtctgacccacgtatggatttgggcatttagatgtttctctacccaccctcctccgcattagaatgttaactcttgggagcaagagctttgttttctgtgtggcggcatgcttggttcctgctcaagaaaaaaaaatttttttgaaagaacaaataacatcaacactcaatactcatttattcacatatttaagacatttttcctgggtatcccattttaattcatccttaaaatggaactgatcttgcctccttagcctaagttcaggggaaatggatgcaaagctctgaaagtcactgatctgggtgctgtgaggtgacatcatcacaggtgacatcaccagccagccatggagaggtttgaacgaaccttccccctttctcccagacagatgtgaccaggctttatgaaaatttgtctgtaaagaggcacttttcaccacattattttaatacacttgtgttattaccagaaaaatgggaaagaaggaaataaaatttgcatcgactttccgcctccttactccatgttggttcttgcaaacagactggagttgtgtgtctgttaccccctcctttctcgcacatgttccagcgttatgcatgatgtggagcaaagctttattaataaggttgccaggaatcaccagccatagaaatgcctacctttttgagtgaacaattccatttctataaatctatcctgggaagataatctttgatgcagtcaaagatcacagtgcccgaggatagtcagtttttacaacagcacatgtaaaacacagcatgagtgctgccaaatccatataataattagatatcatggttcacttactggaatactgtgtatttattaaattatattttaagatactttctggttacatggaaatgcttatgactggataaagcaatacaaatgatatcaaatacgggatgttaaatttccctctaagccctgctttagctgcatcccgtatgttttggtgtgttggatttttgtttgcgttcatctcaaagtatttcctaatttccctgtgatttcccctgtgatccattggttatttaagagtggattgtttaatgtccacgtatgtatgtctttctcaaatttgcttcagttattgatttcatttctaagttcattccaaaagcctacttaatatggtatcgatcctttaaacttactgagttttgttctatggcttagcttatggtctgtaatacaggacacgccacgtgcacttaagaagaaagtttattctactgttgctgggcagagtattctacagttgtctgtcaggtctagttcatttataatatttttcaagtcttctatttccttgttaatttctgctagttctatttattgttgaaagtggggcactggattctctgttattgttaaattgtctatttcatccttcagttctgtcattttctgcttcatttgttttgggaacttacagttagctttatttttgcttataattgttatggccttctgatggattgacctttttttcattataaaatgtctttcttgatttgtactatcatttttttgttttaaagtctattttttgttctaatactaacatagccaatccagctcttttggttactttttgcacagtgtaacttttttcatccttttactttcaacctatttgtattttttaatctaaagtgtgtctcttacagatcacatatagatggattgtgctttttaaaaaatctattctgtcagttctgcctcttaattggagaacttgaccatttacatttaatgtacttactgagttggtaggatttaagtctgccatattgctatttgcagtctttatgtcttaggtatttttatttgtctgttcctccattactgccgccttttttgtcaaatagatatttgcttgtgtgccatttttatctccttgtcatttattttatcactttgggggttattttcttagtaatcaccttgtgggttttaattagcgtctaaatttccagcaatgtaggtcagattaataccaccttaattacagtgccatgaaaactttgttcatatgtagccccaccatcctccctccactgggctggtgttgtcaagtcctgtcaattacatcttgtataccttgtatgcccatcaacatagatttgtaaatgttgctttatgtcttttaaatcaaggggaaaaaagagttacaaagaaaaactacctttgcattttatatttacttagtagatacttttactggtgctctttatttcttctgatctattcaagttacagtctagtgtgctttcatttcagcctgaaggactctgtttattgtttcttgtaggagaggggtctgctagtggtgacttctctgtttttgtttatctgggaatgtccaatttcacctatgtattttgtgtagtttttgctgaatatagaattagcgactggcagtctttatttcagcactttgaagatgtcacctgactcccttttgtccttcacgtccttcatgatttctgatcagaagtcagctgttaaacttactgaagatcccttgtatgacttgcatcacttttttctttgtttcttccagattctttctgttcattaccgaatgtagggctttgggcttttgacagtttgattatgatgtgtataagtttagatctcttttgagtttatctaactaggaattgtttatttagcttcttacatgtgcagatagatgattttcatcaagtttgggaagttttcagccattatcattatcatcattattattattacttctttttcttgagacagagtcttgttctgttgcccaggctggagtacagtggcacgatctaggcccactgcagcctctgcctcctgggttcaaatgattctcgtgcttcagcctcccatgtagctgagattacaggtgtgcaccaccacatctggctaatttttatatttttggcagagatggggttttaccatgttggccaggctggtcgtaaactcctgacctcaggtgattccactttttgagacaaagtctggctctgttgcctaggctggagtgcggtggtgcaatatcggctcactgcaacctccacctcttgggtgcaagccatcttcccacctcagcctctcaagtagctgggactacaggtgcaccttcgcacctggctgatgtttgtatttttattttgtagagatgggattttgccatgttgctcaggttggtctcaaactcatgagctcaagcgatccacccacctaggcctcccaaagtgctgggattacaggcatgagccaccgtacccaacccagtcattattttttcaactgtactttcttctttttgtctctcttttttctttctgggactcccattattcacacatctgtttgcttgatgatgtcctacgggactctgagactgttgctatttcttcattttttttctgtctgtttatcatactgagcaatctcaattgacctattctcaagtttgctgattgttttttctgtttgctcagaaatctgctgttgagatcttcaaatttttatttcatttattgtacttttcaactccagaatttgtatttggttcttttttgcaatatctctttattgatattctctatttcatgagacattattatcatacttttctgtagacatggttttctttaattttttggaaatatttattttttctagtaactccaacatctgagcttgcttggggacaatttttcctgtgtgcatggactttcttttcttatttgttggcatgtctcataatttttttgttgttgaaaatggcatttaaaataaaacaatgtggaaactttggaaattgaattctttttttctccccagggtttgttgttgctgtttgttgctattgttgtttatttattgacttttatgaaccagttctgtaaggtctgtattctttgtcctgtggtagccactgaagactgtgcttgattatcttagtggtcaaataatgatggacagagtctcctaatctttgctgatgttatgtgtgcatgttttgggcacaccttcaactctgagccaggtggttacctctctgtcttagccttcattcctgcttgtgcagaacctcatgtctgccaaagctgagggctcatggccctctcatgtcccttctgagtgtatgcatagctctgagcatgtttatattcctacacatgggtgtggtcttagagattcccaggaatatgctggagtttcaaagccctctgttaatatctcattcctcaggctttctttttaagattttgatctgcttgttgtttgccccacctcatagccaccatctcagatgttctaaacaactgcctctaatttgacaaatgtcaagtgaaaacgcttttcctaatgggtgagttccaagtcaggttaaataaacacagacttgtgaatgggattttccagggaaaagcagcctggtcaactaatgatagttctctggtatggactttgaaggagctccaacctcgtattttgcccttcggtagctggtttcttgttttgttttgttttgtttttcccagagtgaaggtgtcgttctatcacctgggctggagtgcagtggtgctcactgcaacctcagactcctgggcttaagcgaacctcctgccttagccttccaaagcactgggattacaggcatgaaccacagcacctggcctagtggctggttttaaaggctaccttggagctgcagtgaggagagtaggaaatacggaaacataaaacgctacaaagctcactgttcttactgagtttcagccatttttcttgaataaatgtttttggattgttgctaatatttgattaattttcagagacctgaaaaaagttgattttgacggtattttgccattgttctttctcactgcttttatgaaggagataatttttggaggtccttcactccaccatcttcactgacttcactgacataggatattaaatgtgtttcgttaaaatgcaaaaaaaaaaaccacaaaaaaagtgagaatgttaaaaatgtaaggaagaggaatgagttgagaaatgttttttcttttttctattttttttttttttgagacagggtcttgctcccttgtccaggctggagtgcagtggtgtgatcatggctctctgtagcctcaaccacctgggctcaagcaacccttctgcttccacatccctagaagctgggaccacaagtgtacaccatcacacccagcatttctttgtatttttttaatagaggtctcactgtgttgtccagtctagtctggaactcctgggctcaagtaatcctcctgccatggcctctgaaagtggtgggattacaggcatgagccaccttgccaggctgagaaatgtttttttcaattactatgtttagtgaaatatttttttttctctttaatagtaggaagtgtaatctataaatgttatattcatatacaagtaagtttgccttgtagcaaatttttagtaagtggtgggggttggtaaactacagcccccatttttgtaaatccagtcttaactggcatgcaggcatgctgttctgctaatgcactgcccgtggctgcatctgtgctgtagttgcagaggtgcataggtgcaaaagaacgcacatgacctgcagagcctaatatgtttactctctggctccttacagaaatagtttgccaacccctcgtgcataggaaagtaagtagctattttattttaaatatagtaatgaattgggaaatgtgttaactttaagtttgcttattactacatggttattttaaaagctctaatgtcaagaatgaatttatgagaacattttggttgtgggcaatgttatgctatgaaaattttttacttgccttatagaaattaaagatcaacaatagttgagttaattcaagtaatgcttttggtgctgtgaataaattgtaccgtaacttccttggaagacttctatttagaaacaatttggtccagtcacttaaatcttagcatttgaaatacaacatagtgggtatctgactcaaaagcaggaggaatgcctgtgtaagggcactgaacccacagaagggcacctgggggacgtcctcaagttttcagttgttatttgaacttgtgcaggccactttgtttttctggtctcaattttatcctctattaaatgggtgtaatataactcttctgaaaacattgtatgaattaaatgaggttgtgtgtgaatattcctcatgatctataagagttgaacaattgtctgtactattactatcatcgatactgttgttaatgtgtaatcaagatgcagaagaggtttttttctgttgctaatgccattagccataccattgaagccagattctttaaaatattaaaccctccattaatttaaaaacactgtgtgctttccaagcccaaaccccagtttctgtttcactcttgagatttttttcaaaaacaataaaagtttaatttaaaaaatgttgcttctttgaatagttaatttctgaaagtttgtacattgcagaagcatcaatagttcttatttttttcatgtccttgaaaaaaaaagagttgttatttagattaaatgactcacaatttagtgaaggtagaatttacaatcctagatggaaagtctaagaaaaaatattacataggaatctagcttgtttttattttaggttgaaattagcaattctatttggctaaaactttgacttactgcagttaaacattgattcaacggtgaattgatgatatactactttgtataaggtataaaaggtgaggggaaatagttatctctaaggtaattttctctaataattattttctaagcagcaggttctgtatgtgtgtgagagagagaggggtacagagggtatgtgactaggtttgtccttggagtgagacaggtcagggttttgtttccactctgcttagaagctcattgtgtcaatttgggtgcgacacttaggccttgtgctcctctgtaaactgggagtattacttgcctcatgtagccttattgtgcgataggcaaaggtgtgtcaggaccctggggcctgcctgccactctgatcattaggccagcagaaatgggagggcaaagcataggtcagatcaataaaattcacacctgtcccaaagttacatatccagtctagaatgttaatgaaatgctgaaaaaacataggttattatttaccattatttgtgttttcagaagtactaccgaacaacttggcatcctacaacatatatttgtaaataacacacacagccagccctccgtatccatgggttctgcatccctggattcagatctaaaagtattaaagacaaaaatcactgggtctatactgaacacatacagacctttttttcttgtcgtcattctctaaacaatacaatataataactatttacgtggcatttccattgtattaggtattataagcatctagagatgattgaaagtctgtgggaggatgtgtatagattatatgcaaacactatgccattttagatcagaaacttccgcatctgtgaattttggtatgggggactcctagaaccagtttcccacaggattccatactggagggttgactgaattttcataattctaaaaggtacacagtatttcctgtagatcatttggaccctagagtaatgtggaagaaaacagccatcatttgcaggattctttgccattcagagctgttaccaatttggcatagctgtagttttgtgtcccatgtttgtcccaacagtattatgtttcctacgccatgaaatattctgcaaaaatatgatttctaaagactacaatgtttctgctctaaagagtgtgaccattgacttcattatttgttttgacctgggcatagatccttgtagacaaatttgtgcacttttccagtgatttcaagcaaaaccccttccaaaattggatgccacagttgaaatgctcacccagagaggcccctccccaactctcactgacactgggccacccccttaaatttgatctttcctttaaggcaggcaaaaatgacatctttttgtttccagtttttatctattcaatgttgtttctgtaaggtcactagccatatgctttttttgtttgtttttttttttgttttttttgagacagggtcttactctgtcacccaggctggagtgcagtggtgagaacacagctctcattgcagcctcgatctcccgggctgcagtgatcctcccacctcagcttcctgagtagctgggaccacaggctcatgccatgacacccaggtaactttttttgtaggggtctagctatgtagcccaggctggtcttgaactcctgggctcaaaggatccacgtgtcttagcttccaagcacgctgggattgtaggcatgagccatttgtgcccagtctgctgcttctttaaattgcctgtttctttgccagtttttctaaaaattaaggttttttaaattaaaaagtttataggatatattgatatgactgtaatgtatgtttatttttatctgtcaagtatttttcccactttatcattactttcaattttgtttagagtgtttttgacacataaagtggaaaacttgcataccttccaatatatcaaccttttcccttttaagtactttttaacttaaaaagttcttttgaaccctgaaatatgcaaatatttgcctacatttatttctgtttgccttatggttttatgttttaatttatcttgaacttttaaatatgtattctgtttgggtacaggtgttgtttttccccttcatataataaattttcccaagcagcatttttgaattttctcttctttaccacataaaattcgacctttattgtactctttttaaaacattttttcccagaccactgctattatcttgcacactatgccgaacatttataaacatttcaacacatagtggtgaaaacccacctctgaaattgttttcttgtgtgttttcacctatttatttttccatgtaagttttagaattattgtcaggttctctcctcgactttggagttttagttgggattgctcttctgtcaggagaatcaacatcagtatggtatactgtgtttctgtttaagacacggtatgtctttgtattagcccagttttcctttttaagtcattcagaaagtactgccattttctccatagacattctgtccattaattttgaaatttacttctttaacttttgtaatttttgtgttatggtgaatggacctaccttccgtggacaaaccccttttcccagatttttgagctagttattgctgatgcagattgttcatgtgaagctggcttatttattgaaggtttaaaattatgatcctgtagttctatcatatttttatttatctatatgtatttctatttctatctataatacaatgtattccttcctttagtgctgtttttaatttttaaatgtttaaaaatttgtataaattgaaggggtacaagcgtattttgcctgggggtgaagcctgggcttttaatgtatctaccacatgtatataatgcacattaagtaacttctcatccctcacctccttccgccctcccccctttttaagtctccaatattatcattttacactctatatccttgtgttcatgttatttagctcccactgataagtgagaatatgtggtatctgactttctgtttcttagttgtttcacttaagataacaacctccagttccatttatgtcactgcaaaagacatgatttcattctttttatggctgaatagtattccagtgtatatatgccacattttctttatccagttatcctttgatggacacttaggttgattccacatctttgctactatgaatagtgcagtgataacaatacaggtgcaggtgtgtctttttgatataatgattttttttttcatttgggtacataccctatcgtgggattgctgggtcaaatggcagttccatttctagttctttgagaaactccatattgttttccatagatttgtactaatttacatttccaccaccagtgtttaagcgttcccttttctccgcagtctcaccagcacctgttatttgttaactttttaataattgccattctggttggtgtaaggaggtatcgcattggggtttcaatttgcatctctttgatgattagtgacgttgagcatttttcacttgcttgttggccatttatatgtctagttttgaaaaatgtctattcatgttctttgcccactttttaatggagttacttggtttttgtaaatttgtttgagttccttgtaaattctggatgttaatcccctgtcagcggcatagtttgcaaatgtcttctcttattctgcaggctgtctattcactctgttgattatttcttttgctgtgcagaagcttttttagtttaagtcccatttctctatttttgttttcgttgcttgtgcttttgaggtcttcgtcatgaattctttgcctagaccaacgtccagcagtcttccctcgggtttcttctaatacttttatagtttcaggtcttagagttaagtctttaatctatcttgatttgtgtatagagtgagagataggggtcccagatcattcttctgcatgtagcaatccaatttccccagcaccatttattgaaaagggtgtcctttttcctggtgttacgtttttgtcgactttgtgagatcagttgaatgtatcagtgttctcttccattccattggtctgtgtgtctatttttgtaccaatattgtgctgttttgattactaaaggcttcacatataatttgaagtcagataatgtgatgccccggctttgttctttttgcttaggactgttttggctattcaggctcacttttgggttcatatgaattttaggatggtttttttctaattttgtgaaaagtgatattagtattttgatagggattgctttgaatctgtagatggctttgggcagtatggtcattgtaatgatactaattattctggtccacgaacatggaacatggaatgttttccatgtttgtgtcatctacagtttattttattaatgttttgtagttttctaaaaatacttgtttaatatgaacttactacctttctttaacctttttttgtatatttggcttataatatatttttcgtattaaaaacttattctagatttaacttgcattaggagtatctcctataaagagcaaatattttgacttttacatagtttgcataaaaatcaagttaaattgaaaattcaagtttccttagagatcactttagtgggatttaagttcaaataaataatagtatgagatatttatgtgtttctaggtttttttaatatattagtgaatttatatcccagatgtttcaaacaatttccatgcaaattgctttttttaaaaataattttttaaaagctagtaaaatttagcagtggggggattgtatagtgacagcaatgttaataagttctgataacccactaccatctgaccagccaaaaattaactagaatactaaaactaatttctagtgaaaaccaaaaatgaatacaactttgtatattctctttaaaggaatgtacattgcaaacagaattttatcatcatcatattattacatgtaatctttcaaattctttaaaccgtttcatcttcacaagagccccgtgttgtattgttcccattttagagacaagaaatctgaccccaggaaaggttaaataatgtgtagaggtggatatccatgtattgagctgaactgacaattgaaccttgttatttcttttgaaccatggtggtgatcagtgtcctcccagctataatcagagtagactagagatttgggggaaaggaaagaataatttgtgcgcatttgagcagttgttttctgcacttctgtaaattattttatcaatcttatttagaccctttcataggattaaatatgctaagtgaagttgtatttccccatattgctaatatttgcatttcagttgtctttatactatccaaattggaaattgatttattaaactgatctaatttaaataagaacctcaccttctagttggatacaaaccacattgttagagagagaggctgggtgcggtggctcacgcctgcaatcccagcactttgggaggctgaggtgggaggatcacccaaagttaggagtttgagaccagcctgaccaacatggtgaaaccctgtctctaccaaaaatacaaaaattagccaggcatggtggcgggcgcctgtaatcccagctatttgggaggctgaggcaggagaactgcttgaacctgggaggcagaggttgcagtgagccaagattgcaccattgtactccagcctgggtgacagagcgagactctgtctcaagaaaaaaacaaaaacaaaacaaaaccataaaacagagagagagaaagacagagaaagttgcattatagatagtatattatatagactagctaaattgtaaaattcaggtaggatttttttttcctacacattaacaaattttaggttagaggcccacaccgtttatagccaagagtgtaagatacaacagaattttttttgtttgttttacaattggatttttaagatccatttttatgccagatttttctttgtaagcctcttctttccctaacaaggagaataatacattaaaagtggagatcttagatcttttcactttgcagataggtcataccttaaaaaataatgtgactaagacaaaaaaattatgttttcttcttatttgttaattctttacaatatcataccgtctcagaattgaatagcattatcaccgacattgcaaggttagggaaagaagtacacaaatctttcgcatggtggattgttactttttaaggaggtatgaatggaatggcagtacttgtgaaaatattttttaaaaagctctctaaaaattgcacagaattctgtatttcatatttttactgtgcccatcacttaacacaaacttgaatttatatcatatgtagaaccaattttattatttagggaccgtcagaaaggaaaaagtttttcatttggttttccatatttttccacttttaattttaaaagctgaactagaaaagcagctgggtgtggtggcttacatctgtaatcccagcactttgggaggccaaggtgggaagatagcttgaggccagaagtttgagaccagcctggtcaacaaagtgagacccctcatcaaaaaaaaacaaagcaaaacaaaacaaaacccagagaagcaacataagatctttcatttcacttataataatttttattgttctcgaagttctgtttaccaacttaaaatattttaaattctaagtttcaaatattattgatagtaaataagcaagtatatctcactttaaaaaatattcttaattttcctataagtcaattattactggcattctagatcttctaccctggaaatctttgatttaaaaatatttaagtaatttcttcttttcttaaaactttccaccctacacaattgtcagattaacccttagattattagcatagagttaggcaaaatttccttacatttgcaagagttggaaccaaaataagtcaattaaaacgcaaagatactctatataaagcaaaaatgtgttattctaagcaggcgagctagttgcttaataaagttagcttttctcctaaaatggctaacaaatagaaacagtcttttaacatttccaacattttattttcgtggaaaaagcagtttttcacatgtgcagaaaatggaatgattaaataagcttaacaaatttttctgcagaattcgtttttgggtttggttttagtctgtgtttctgtagtacccggtagacataatcttgtgtgatgggtaacagttgcgagaggtgaactcttaagtttctttgctctttaggattctgcaacttgcagaacatctgctaaaaagtagcaaagctgatgcatttaagttttccatcttctgtttgcctcgtctttaccggcatggaaagtaaggaagagctggtgggaagggctgagggaattgaggggccggaagaagggcgtgtccacactgagatgccgctggggtgtatgggtactggagctccggtgatgggaggcactgtgtggctgcagagcagtttggccccaggggggcccggagcccgtggagtccagtgctgtctgaggtgtacaacaagctatgcatggagattttcataactgtctttttcatacgtctcctttttttcagctccgagaacagagtttattgaggatcactggttggcatctcgacacccccatgaaatagactgcccatgcactgtatagatgctatttctaaagtgtcgggaatagactcttgaggcagatagggagctaccgttcatcctttacacagtgagaagtctgtgcacatataaaatgagaaaacaggcttagagtgtgtgagcagcctgcccgtggtcacatcccaagaagcccatgcatgttctgaaactggaagtcacgtgaaacattttgagcactgatgatctccctttatcagtaatttcaactaactgggttgtttaagtgagtaggcatttatttgtggttttgtttttcttatgatggagaatagtagtcgggtttcatggagcgtaacttctgagtgcctggtggtgtgatgtcgacctggtagtaggggatggagggagatccatctaatcaagttgattttaacaaccagcaggacattctgttgggcatctttttccttaaaaggacattctgattctttgagagaaccttcctgtgtatacattcttcataagccaggtggatttttcgtatttataaggtacacaccatacacaaaaatgcatgtgtttgtgcgttttctcactggcttttcatcattggtgccaggctgtgacaagctttgcagtaccagactatgtggctggctctgcctttttcttctgtctgtcctcagatttggaaataaaaggtgtttgcactttttatacgccaaatgacttcccaaatgagacagaacggttccaagggcaatgcacggtagcttaagttaacttaaagaaggcttattcacttgtctttagaagtagctgactcccacctgcccagcttcccagctttaggactgtggggactccagggatcacaatgaagtgggcatattccagagcgattttgaagaaacagaggaagatgaggttcctgtcatcacggatggtactgaggaaaagggcaaatgggatttggattccagtcccaatcacgttggtctgcagacatcattggtggaaccaggcagaggggcatctttgccatttctggtgactttcattccttgtgtacacgcagattttgtctggcatcattttccttctgcctgaaggacttcgttgaacatttgccatggtacaggtctgcccatgatgaatgtctttgtttaagtctgagcaagtctttatttttcctacgtttttaaaatacatttgcaccagtgcagagttctaggcgggcagttttctttcacttcctgacatatgatgctcctctgtctttttgcttcattgtttccaatgggacatttgttatagttcttacctttacttctctgtatatataaggtattaatatttttttctcagttttcaagatttttcctatcattgattttaagcaatttgaatatggtgagcctgggtgtagttttcttcttgtttcctgtgcttggggtttactgagtgttttgaatctgtggctgtatggttttcagtaaatgtggaaacattttgatcattatttctttaagcatgtttctctgtttcccaccgccccccaaacttgaatttacagatagattaggctactagaagttgtcccatagattactgatgtacttttcatttccttatctttaaaaaaaaaaagtctgtttcatattggatagcttctattggtttgtctttaagttcactaacttttttttctttcgtgatgtctaatctgtcattaatcccatcagtgggtttttcatctgagacattgtagttttcaactctagaagttcaatttggatcttaaaaaattttattttttaatccattccatgtctctatgtaacttaatctttcctctagcttcttggacacagggatatttcacaagtgttttatctgctgtctattccttttatcatcactgccattcctggatctttttctattgattgatgctttgttgtaggttgtgtttttctgcttctttgcatgcctgctttttttcactggaaatctaacattgtgaatttcaccttacaaagtgctggacatttttatgttcatataaatattcttgagctttgttctaggatgcagagaagttactcagaacaggtgggccctgtggaggcttacttttaacctttcttagttgggatcaaagcagcctttaatccaggcattttcccctagcgctgagataatacccatcagattactctacctgatgacctgtgaatttctaccttaactggtgagatcaaggactattcctggatcttggtgagctccagataaactttcctttgcttttaccattgggtctttccctgaacttggggaagtctcctcacatgcatgtactgatcaagcctcagccacaatctcaagggtaccctccagagacaactagagctctccttctggggcactgccttacaaacttcatctgcccgtgtctccgtggggctccattcagggcgcctgcaggctctgcctggctcctcagatgatgaactgggacagagagctcaccttgttttgccttattataggataattgtccttcattcctgtgtctaaaaatcatttcttaacatgcatttcttacttatttgatgcagaagagtaaatcttgcactgcacttttattctatcttagtgagaagtagaggtttgtaatcactttcaaagtgaaatcacactttgtccttctaacaatcccactcagagatcaatagtgtgcttggccacccttccacagccaagagagaataatcatgcagtgcttcagaatactgtattcccctgcgttcagagaaaaacagagacagcccagtaacaacaacaacaaaaatagcttgttttaatttaaagtagaacaaaatgagtattttttcctttgtgtttaagtcaggtcgattgtagataaattaaagggctttgatatcatcagcaaagcattcttaccagctcaggaacaaatgcaagtgttcttggaaaaggtttgtgggtgtatttagggagtccttgttattttccctcgctttgaatgaaaaaagaaacttatttatttttatagtaatgtttcctcaaagtgattgtgtagcaaccatagaacataacactctgtgttacaaagtagaaacaaatagagctttgtacttagtacaggtcatgatatccaaactacaaaagtctttttaacagggtgaggatctgagtgagaggttcctgtttcctgacttgttattttgaagtgtgattgatactgtgctcttcaccagagaaaagtcagaaactaaggaaactgttagcaacaaaaaaactaaactaaaagtcattttggttgatttaactccaaggcgtcagtttcttagagtgccaaacccaaaccctggctgccatctttgccgctataaacgttcactccattttaggggagcgtgtttgcgccatgtagggtggaacggggagcgtgcgctgggtgagagccatagcagtctctccgtgatgcttctgcaccagctggggctggagcgctttgcccactggcagcttccagccgtgtgcctcggtttcctctggcatcggggtgggtgtgagctgtgttggcccttgcagagtggagagcagtccatgcaggtgcagccagcttggacaggtgcgtgatgggaggacaagcccacatccatctggacgaggaagtgctacgaggtcaggctgggtcaaaccttggtctccttgccactgataaaccaccatgcatggtccctggactcttgacgcctgtggtgtctctgggctcccagcgttttctccccacaatctcacaagtggtttttcacttccttcttgtaaactttcagatcacgtcccacctatgcactggtcttgctacaaacacttaccaaatagtagaggggagtgtgcactcctctaacaagagctgcgttggatgggcccatccacagaaagccgggagggatgcccgggtgtgcagtttccacatggggaagtcattggaaggcttctagcatgttccatgccatttgttttgtctcctcatccttacttcttgttcctttttttgtttcctcctctcctttcttctcccagctctgccttatgtctttggggatccttcactcccttgatggcctagaactgggcagaaagaaaagtttgcctctgtcctcctctttcctctcactcactccaatcccttatccgcagagagcctgctggagtccagggaagtccgtttctgctggggacatcccagcctccgccttctgggtccgggcagtgcccctggatactgacttctccctccctgttgtgtcccacctcgcgctgaatcgtccaggacctgttttgctattttgtctggggacttaaggctgttcatgggctttaatcaatgcaaggaagtaaaattcctgccaagctgcccttaaggtcatctgggggagaccccgccatgtaacatgatcctccggcctccttccagccccagcttcattatatgtaaagctaggcttctgctgactctcagatcagaccgtcctggctttgtgtgcctttataaggctgtggttacacctgaggatctcggctgccctcctcttagctgtcagacgtagttgatggtgcttgggtcttggctgcacctcaccttcctggctctgaaaatgagtcactaaccacctcgattcctcgtgttggaatccctggcgtgctattttccgtgggaggcttttacttttagaacctgggcagccctgggctcctcgtcctgcccagggcggtgctggctcgtttttcagaccgtggtacaaacaggccttgttgatcttgtgccttttgtaggcaggtatgaggtaaagccctggtggatatataacctgactttagtttggctactgctttctttgaccggcttttacccgtgtgtgttttcaacttttgcaaaacagtccccgtgcccagagtcccagtggcactgctacacttggaaaataagcaactaaacacatgatgcccattcctaggacatcctcagatttaaaggaaccgtaagaacctcgggctgggctggaactgctgataagcagtggtgacagctgagcggtgcaggtacctagggcttggtcccggtaggtgactcacagagctgtcctccctgtgggctctgccctctcggatgaccagggacagggaacgttaggggatcttaagccaggcccttgggctttctgacagcagatcttattagaaggtctggggggaaatgaggagcatgagaatggttttcctgctctagccccgcatccatcatctccccaacacgtccccactgtgggtcactgggagtgatcaggaagtgatgtggaaaccctcagcaagggttctagttgctaggtgatgagcctaatgtgtaagactaggttccactatggacgttccgtcatttttttttttttttgtaatgaccttcttcccgtttggatggctcaccatgcatgtcccagattttctggaagtgcttgtagctctccagcttgggcgacttggaacctgtgactaccagggcaggccacttcttcatgggtgacccaggcagcagtggtccaaggtggaactgaaaatgaaggttgtgggaaacaggactaggtgtctccagtcccttcctcacctgtcatgtgttttaggatcttcccatgcttaagttacagtatgttgctggagaccagagattaaatgcaggagtggggttgtcttcctgcttcccagcccgtctgtggggaacagcactgttctcaggcacgtagtacatatatggaaccatgagtgagtttgagattttctcaagaagaaaaggaaaatgaataaaaacgaagggtttaaagcagaaattgaataatgtattactttgaagataggctttacaaaaagaatatcattcttgaataaagtaaatttgccctgtttattcttaaaagctcacagcaaatttttgatgaagcagatggatttcttaaattaaggtttgatactccatttgattttttccttctctgtgattttaaaataaaatttattccttagagaaaatcagagtaaaatgcatgttctccattcctccaccatgcagtaagccgtgtctgaaggtttggggagtgcatgcctgggtcatgtctcaccccgcccgacatatgctcctctctcccatctcatgggctcttcatgtgacatcctgcagggcccaccccaccccatactcagttgggctctttctggtggtggcttcatcccatctgcggccactggggagccctgacccacagtgtagactcttccatccttcaggaagcatctgcagggctcaggtttcagggacacaagagggacattctcacttaggcatcatgtcccctctcccaaccctgtggcccctcttccattagacccttactgcctgtacctggcttctccacatgccccaccttcatctcgtggccacacagtgagagcatcacaccctcccaactacgtccagtcttccctcaaagcctggggaaccttgctctaatgttaatgcctgtccaccttccccaccctctaatcctaaactcaaatcccacctcactcaaggagctgctccaggttccctcaaagaatgtatggcatttggcataaagttggtatactggcacaaagataacatagatccaggtcagccacccaatgggggaaaagagtggggtaaaaatacctgagttgggaatcagtagttacttataaaactgttctcagccaggcaccgtggctcacgcttgtaatcccagaacttggggagtccgaggcgggtggatcacctgaggttgggagttcgagaccatcctgaccaacatggagaaaccccatctctaggaaaaatacaaaattagccaggcgtggtggcgcatgcctgtaatcccagctgctccggaggctgaggaagcagaatagcttgaacccaggaggcggagattgcagtgagccgagattgtgccattgcactccagtctgggaaacaagagcaaaactcttatctcaaaaaacaaaacaaaactgttctcacacctgcaaaatgaggtaaactggagcatgtttctatgagagctgttgtgacttgtgttgaggtaatccttccttgctcttcctcatgtgaccattaatttatggccagctgcttaatctaaaattccctgcaggatagtaaacccatgatgagaccttgacaaaagacaaatgcaacaatgagaacaagccttagacccagaaaataaccttgaggaacagggaagattcatggcaatgctgttttcatattgcaaaattaaggacgtttattacgtccagcatgaaaacaaagagttaaatctcgaggtgtgttctatcagccagtgatacgtgtgtcacttttgaaaagtaaatatgacagatttaactttaaatattctttcatgattgcttattgttttttttttcctactggtatgttctactgtggtcttcctcaaagaaatcgttcaattgaccttcacctccactacaaaacagctgcagaattcataaggaagttatttcagagccccggttgtcaccaatacatgttgggttttttttttctttttcttttttttggccggggggatggagtttcactcttgtcacccaggctggagtgcggtggtgccatctcagctcactgcaacctctgcctcccagattcaagcaattctcctgcctcagactcccgagtagctgggattacaggtgtgcaccaccatgcccagctaattttgtatttttcataggaggcggggtttcaccatgttggccaggctggtctcgaactcttgacctcatgtgatctgcccgccttggcctcccaaagtgctgggattacaggtgtgagccaccacacccagccccatgtgtttttcttttaaaaatatttggtgaatgacaacttcatttaaaactgttatttcacagggagtgttcagctgtcgtcacaagaactttcaaagccttcattcattgagctagcgaagctcactttaatatatctcgaggcccctgtggctggacacagaggcagatggcctgaagccagcccctagccgcagaagggtgggcaggaaggcccctgggctggtggggggccaccctgctggctgccccacctgcctggggtggggtgctcaggacagggtcgagcagccagtggtgctccagggaggagagtggatgacattggagcagatgcttgaaaaacgtaaggatgccaccaggggagaaaagagtgaaggatgttttcctcatctcacagccatcacaaccattccttaaaagccatgaacttctcactcctcgtgcttgtgctctgttattgctcctccaaagctgctctttccagcccggtggatgcccctgcgtttgatggaaacacacgtgtgagtggaagcgtaagctgaggtcagaatggtgtgatctccacatactagagaaaaatacattcccttcagtttctggagaaagggaaggagttatagtttgaagtaagtcaacatttatggtggagaggaagagaagtaaatgtacagctgacttttgaaaatgcttaagggtgttaacctttaactccctgcacagccgaaaacctgtgtttgacttttgagtccctgaaacttaactgctgatagcttactgttgaccggaagcattaccaatcacataaacagtcgattaactcatattttgtacgttagatgcattatatactgtgttattacagtaaagtaagctagagaaaagaacatgttattaagaaaatcttggctgggtgcggtggctcacacctgtaatcccagcactttgggaggctgaggcgggcggatcacgaggtcaggagatcgagaccatcctggctaacaccgtgaaaccccgtctctactaaaaatacaaaaaattagctgggcgtggtggcaggtgcctatagtcccagctatttgggaggctgaggcaggagaatggcgtgaacctgggaggcagagcttgcagtgagcagagatcgtgccactgcactccagcctgggcgacagagcaagactccatctcaaaaaaaaagaaaagaaaagaaaagaaaatcttaaggcagaggaaatacatttactatgcattaagtggaagtggatcatcatacagatcttcattctcgtcatcttgatgttgagcgtgctgaggaggaagtggagggcatcttgctgcctcagggtggcagagaggtggaggaggtggaaggggaggcaggagagccaggcacacttggtgtaacttttgttagaaaaaaaccacatgtatatggacctgtgtaattgtggctgtttcatgtagtacgtggaatgaatgaaaaaatcacttgtttgatgcatgaccaaaaggatatttaattttctgcattagaaaataaaaagtgctaaaaatttggcagttttctgtttcttctcaaggttgtaaggggctgcttataatcattaaggtaaatggcttgggaaaactattccaaataaatggcagatgtgcctgccatctttgatttcaaaatacgttttcctttagtctctgtttgggaattgtgggaattacaggtttactttttcttttctttttttaaagtaaaggcaagaccttgttttcacaaagccaattataaagtgtttggcattccctagacttaattttgggggaaaaaaatagcacagcctttgtgtttcacatatggattcagcatttcttcatgttcttcccatgtaagacagacacacccctccaatctgagggcccaggaagtgccagagaggaatgagacctgcgtttgtttggctgaagactgtgacttttatctgagacctacttagattttagtgcattcagttccccatcaaaatatataagtagccaattcatttctgttctcactcagagatagcacaaaaataaggacgcgtgtaaagtgtgctgcagtgagtgggtacatacattgctaagtgctgccattgaaaaaattcattgtggcaaaggaccttttttcaacaatgaaggcagcatctcttttcctggatcgagacccgtaggcacagtgaaggaacttggaattgtgtggctggtggcgtggctccaatcccttggagggaccggctgccacagaccagcgtgggctcctggcacacagtgagtcacccggatccagccagtcattcaaaaacaaacttgagaaggatcactgggtgcagcttctctacacgtggcagacaggggtcccataggctgccggggccccgtgtgtggatgctggactggcttctcctggaagaatgcccgtgtgatggcccgtccgctcaccatggctgccacaggtcccattctggcaatgcgccttttatttcaaaagaatttttccttttcctccacacccgcctttctgttttccaaacgaagagcctccacctacccaggctttattataatttaagtaaatctaaaatgccaatgtttaaaatttctcacatttctatcatattttattttttacttctaaaagaactttcatatcaattttttcaactattcaacaaacacttatttgaaatatgttaaatattcagcaaaggcctactttgtgctggaagaattctcattcgattcttaaagactgtgctgagaggtgactggcctactgtcgttaccgcatttcacagatgagacgccttgggttcagctcacaggagtgagatgcttctccaggcacctgtgtggagtgggtggccgggtggacctggacctggacctggccacctgtttaaggcctcagctctttccactctactccactgcctgtcatttgtcctttccatgtttagccatatgtgctcattcatgcatgtacacacacgtcacacacacacagacacacaccacacacatacatacaccacacacacaccatgcacacggacacacacaccacacatacacacgcagatgcacacacacccctacccgcatatgcactcacacacaccatgctatgtactcacaaacacagcgtcacatcataaacacctcatatcacacactaagcacaattacacacacacgaacactcacacaccacacactcacatccataaccacacacacaccatgcacgtagacacacacatcacacatatagacacacacacagatacacacacataccaagctacatacaaatacagcctcacatcacaaacacctcacatcacacactaagcacaattacacctcacacacacaccgcacactcacaggcatgcaccacacacacacacacacacaccatgcacgtagacacaccacacatatggacacacacacagatgcacacacacaccatgctgcgtactgacaaacacagcctcacatcacaaacacctcacatcacacactaagcacaattacacacacacactcatgtgaatacctcacacacatgtgtcttggggtgaagcaatacacaggcagaccagcagcagcacgtgcgtgccaggagaggtgatgggagtctgtgcctgggagggcagcagcggctcccggttacactcagagaagccgaggcccacggaggtttgcgagttgtccatcatggtaaagactgggtgtcattctcagattttctgaatccactgttcagttccacaggccctgccggagtgcccactgtgggctgtcccggaagtgcaagcaggatgaccacaggccttggatcctggggaatgtatacgtgtgtagaacaagtgttagtgatggatacttgggagtaggacaggactggcccacttgaggctgcatctggggatgaagctgcccctggttcatacggattcacacagacagagcaacttgggctcctcatttcagttctgtcactttgcaaagctcttggtagagggcgagttgtcctagccattcagtccttgtacctgagaagcaggagagaaaatgtcccagcacccaggggacatgtgacatgggcagtgcccaccctgtgccccactgtatccttagcacctggtgtgtgctcagcagaaccaacagatgtttcctgaatgaacgcatgaatgcatgaatggaggagcccagtgggcgaagcatcattcaggtattggaggggacggtgtggcggaagtgcccgagacagggaaggaggcaccagcacagaccagtgtcacaggccagctgtctgcttattacccgtctccctcctcgcaggtgccgagattgctacatcccggggtgagatgtggctgtgtcctcgtgacccggatttgccaggaattatctcacctcacaaagactcagcccttggccataagagcacctggaggaaactaggttctaggcaaaacccctaaaacagcagccctactggtgttggccacaccctcatatgtaaaatgcagtttcacctaaattctgttcatgatttgttttaggcagattaatgacccccacagatgtgtacatccgaatcctcggaactgatggatgttttaggttgtagggcaaaggggaagtcaggagcttctcagtgacctcgagatagattctcctggatcatctgggtgggcccagtgtaatcacaaggtccttaaggtggaagaaagtgtcagatgagggaaccagagtgccggtggcccagtgcgcaagacttgccaccattgctggctttcaagacagagaaggcggccggccgtgagctgaggcatgcaggtagcctgcagaaaccaggagaggcagggaagcatactctccgctgagactccaggaaggagcgtggccctgccgacaccttagctgagtgggccctgtgttggaattctgacctacagaacgataacatcataaacgtgtgtggttttcagccactaggtttgtggtgacctgttactgcagccccaggaagcgagttcatgggcctagtggtcggaacacaacacgcaaggtctgggtagccccagcctacaacagggaggctcacgggcctgagagaacctgctggacgtttatcaacaaaaagcctgcagtgggaggtgctgaggaacatggtcctcaaggtttgcaaggactgaagctgggtgccacagcctcgggctgagattccgacgttgagaacagctcggtctgtgctgcggcgcaggcacacgcacatgtttccacggtgcactctgcccaatttctgttctgttctaagaagaaaagcgtccagacggagagttcccaaatagagttttggcccaaaagcaacattttaccgagtcaacacaggaaaattattttaaaaggctcttgggagaacaaagatggctttgtatttggtgctgaaacccaagtaggccacatgcccttgtcctgcagatctcgtgttctccgcgttaacataaaggagttgatgagatcctcggctctggaacacagggaggtgtggagccttctgtagggtgcaggtggccagctgttcaccgcctggatctgttatccatgtaacaagtcagtaactggggaggtttagggacatggggcttttgtatgctgtcagatacatccattggggttcagagactggcacgggggccttccagcaggtgggctgtgatgccattcctgcccagcagtgctgagcaaagccagagcaggccaggcaagtcagagacacatcagcgtcacggggcttgagaaagctggaaagtgtgtttttcctgaagcgaagctgtcccacaccggattaaaccactgtaacatgcttagcaaattgaagtctcagcgtagtggccattggctgcccaagagttgaccaggagtgagcatcgcacctgcccccaggactctcgtccgccctcattctcagtgctctgcctgacgcaggatgctaagcgctgcatgcaccttaacatagtccccctgactaccacctgccacacaggcattgccagtgttatccccacattgcagatggggatgctgaggctcagagccgtgattggctgtgaactcttaagtgctggtgcagtgtaaccctgggggtctggctcccacccctcgctcctcttctctgctggtccacctcatgccccgaacccaagtgcagtggaagggcccctggacacctgcatcagctctccctgggcctcgaggtgatgctggctgagtggccttgggcatttggagcacatgtcctcaaattccagcatgcacaggacagcctgtgggttaatacacatgggggcatagaccccacaaccagccttgggataccccttgtgcacctaactgctctcctctgcagaggagaggctgtcaccccaaaggtctttctcttttagttttgtaaaaggaaaacatattttcccttcatctggagcagacttaccaaaccccatgacagtgagccaggagcagcgtcagcatctagtacagcgggttcatcaaacaccaggaagatgtgacagagacaggcttgacttctatgggaactcggttcctgatgtcgttgtaatattggtaataaagttaaaccaaaaaataatagatgaaatgaagtcagaaagacatggttaaaatagttactgtgagcaccagcttttgaaattagggtaggtgggaagcctcaggggcccccagagtgggggctgaacagacctttccacacaaagctaagctgagtttgcatgaacatcttcaagtgttcgtgtttcctcctggtgcttgtacctccgtaaactcactttgccccatttgaaattgccgtgtcagaatgtagcttcttccgggaaggtgcacggtggaacagtgccagggagcagcagcgcccagcaggcacgcgtggagtgaaggagcgtggtcagctcccagctgcaaccgctgggtcacaaggggagggcaggtgagaactcaggcaggagaggagaggcacttgggaggcagaaatctgtgctgtgtcccctggggaggcaggagcaggggacaggcggatatcagagaaggaaggaaatggttcttggggtgttcagttggtgtggggtgggccaaggagagcaagggaagcggcttatcttgtccaggacatagaaaactcactgaagccctacgggaacctgcagccaaagaaaacccagcaatgccgattctgtctttattttaaatgtcaatgtttcttcctcagggatatttgttcactccttttgttttgtaaaagatattgcattaaaatagcgttcatcctgatccctgagctgttgcgtgcacccttgcgttttgcacttgatgtgagctcctctcctgcctcaccctggcccccaggcgagtttggtgtctaatgacaaggttctttgtcgcttttcctccttctttagaattcctgagactgaggaggagttggaggtatccatcaataattcctattagtgaagaattgtttccactctgttgggttttctgggtttgttgttgttgttggccaggaagagatacattgtattccagaacttttacctaatttataaatgtaccagttgataaatacttcattataaattgatgtgtttggactggattccctcacagtgatgccctgaagctatatgtactttgggtttgttgaattttacttctatttatttattttgagacagggtcctgctctgtcacttaggctggggtgcagtgacgtaatcacagctcactgcagccgcgacctcctgggctcaagcgatcctccacctcagcctcccgagtagctgggaccacaggcgtgcacttccatgcctgtcttgaattttatttctttgtggaacatgccaatgaatgttatttagtttaactttgtttttttgtctgtttgttttgtttttattcttagtgaggaattttgctgaacaccattttggttcatctctgagtttagggtgcttgggccgggctgcccacccctgagtttgtagtgccagcctttagaggctgtaaattcccagaagctacatttgagcacccaacacatcagcgctcaggagcaagaaatgtgaggccgggagagacgagctcccaaatccgacctgcgtttggacataacgggggtttttatgaggaaggcagggatgtgagaggggagagcccaggatgaaagctgctcacctttctgggccagtcaaaccagacaccatcagggaagtctgtgtgaccgaaggatcattgttttttgaaagaaaaacaagttccgtaaccattcggatggcccccgagttaggatgtgaagttatcgatgactagtgatgcccctgtaccaaaataactgcgggcaagcaggcatgggaagaggaaggaaaggcacagagaaagggaggggccaaacaggcaccttatggtttgttttttaaagtcacatagcctccgttacatgaggacgggggagtttgtttcttctataggggacacagagtaaaaccactcaagccagtcgggggcctccgagtgggatccctgtaccgggctggtggatgcgggaggcgcacggtgccctcccgaggaggagtgaagggacacgggcacagctgtcaggcagctccaacagaatcacagaatcggttttgccccacggtctgcagtttgttctccctctcagtgtctgaggattgcccagttcactcagccgtggagacctgggcgctgtttcaccagatgggagtccggcacagtgcccgcaggaaaagagcgtgccttctctgtggacttgaatctttgctgccttgtgccgccctggccatttggttggacatccacgtagaggctgcagtaggctgtctaagcccccaggagctattgcagggtcatttaattacacacaacatctgtcacccagatgaatctgggcttcggcccccttatctatgacaaatggacttgcgtgggtgtctgctgaggctttaggattcccgcctgagccctcctggtggctatgggacttcagactgcctggggcagggggagggctggacaggcactggtttcccccacgcctcccagcactggcttggggaaggtgcggcctgtatgtagaattcagaccttatagcatgaagcgcacactgcaccaggtgcctccagagtgttgattcgcctccaggagacttgtttggagttttgatattgttgctttggggtccatctcacctgccagggcagggctctcattgctgagactgcctatgtcagtgaagctgaggagctccttaactccagtgatgggagtagctggctgaatgcaacccagggcctccctccctcttccagttaactaggccggattccagatttgtgaccctgacgaattttgcaagggttatatttttaagaagcttaaaatgaagtctataacaacacagaagtcttacatttaactctctccttggacaacttcttattgtgctctctgggtaacacactttcagtttaatccctgtagatgtccctggaggatatgacatagacgaggagccagcccagggtgagatcgggtagcatggctgtgctggcacgtggagggtaaaggcagagctgaaggtctctctccccaccctcaccccccagggcggcagtctcctggtgatgtgcctgccccaaaagagtggcagccagaggagtcccagctctgaccttggtgacagagaaggatctgcgtgctgtggagctgggctgcccttcttggatggctgtccccccaggaggggcccaaggatccactgagccccctccagacctgcagcactggcacctggagcccagagcgtgtcatgtctccgtatgtagagagtctgtaatttctaagagaaaacctagcacaaaatggaaaagtgtggcagaaagtcaggaagaattgagttcaagggagcacagaacctctgaaagggtggggtgggggcaggggccaggggccagggcagccaccatggcactggcctcaggggactctctctgagggggctagcctgtcctcaagccactgaggagtccttattcacaaagacatgtactttgtgaattcttttctgaaaaaattacatttccaacttactagaacttgcaacagcacagatgaacctggagaacattatgttcagtgaaataagccagccacacagagacaaacactgcatgatctcccgtacgcgtggaacctaaaaatgttgaattcatagaagcagagtagaatgggggttaccagaggttggaagggacttggggggattttggtcaaaggatacaaagtttcccttagacaggaggagtcgttttaggatctgttgtacagcacagtgaccatagttaatagcaatgtgtatttcaaaattgctaacaagtagattttaaatgttctcatcagaaaaaaagatcggtatgtgagatgttaatggtttgatttaaccataccacagtgtatacatgtatcaaaacatgacattgtgcctcatactatatacaattattatttggcaattaaaatttaaattttttaaacatctccaaagctacggaaggaggaaggcctctacaaggccagctcaaattacggctgtcaccaccttctgtcaagtgtcacattgtcctgtggcctagttgacccatcccagagggatatccggcaggttccaggcaggtagcacctgcccaggacacatgtggctctgacgatgtctgcctcacctgtggagggtccatgactatgggagaaggtcccccagtgtgggtgggaagaagccacgttgtgaggtgggctagcagctccccgatgactcatgagtaccacgtttgtgcatgaacggaggcttcttttccaactccagctgctcgggcattgctgcatgcatgcacacaggccataattagaccatggcagtgtgcattaaagaggccagtgccacactcatatttataagctctgaaacaaactacttttttttgagacagggtctcgctcttttgttcaggctgaagtgtagtggtgctattgtggctcactgcagcctcaacctcctgggctgaagcaatcctcctgcctcagcctcccaagtagctgggaccacaggggtacaccaccacacctggctaattttgtttctgttttttatagagctcaggctagtctcgaactcctcccaccgtggcctcccaaagtgctgggattacagatgtgaaccaccacgcctagccctgaaacaaactattttcacatgttgtccctgttcgttttgtgttgctataaaggaatatttgaggctggataatttacaaagaaaagagatttatttggctcacggttctgcaggctgtacaggaagcatggcaccagcatctgcatctggtgagagcctcagctgcttcctctcataggggaagggagaggggagcagaatcacaggggtgaggaggggggtgccaggctctttttaacaaccagctctcacaggaactaatagagccagaactctcgcacatcccctacacccccagggcaatcatctatccatgtgggatccacccccacgacccagacacctcccatgaggccccacctctaacgctggggatcggtcttcagcagaggtctggaggggacaaacatccacactatagcacatgtcaaaattttcccagtgtgtattattacacaggactgcagagtgaaggaataaaatgatatctaaagaaatacttccagacagatgtcttagtgctagtacctgtctggcacactttgggaaagcaagtacccctactagtaagcataagtgtcataacatatgactaaaaccaaaatcagagctcattctgtggcattaggttgttattcccttcatcagaaatccaaaaatgttaaaacagttcttgttcctatttacaataggaaaggtattcaatctcaaatcattgggcagagtgtagggaagaggctgtcactctctcttctcagcaggtggcagggaaagcccaaggtcgccattcattagatgttaaacatcggactggaggtgccaagttggcgcaggccctccctccgtgggcctgtgtcttagtcacgtggacggtggtgtcctgtgggctgggctgtgtggctgtgggctgtgtggctgagaaggtggggatgccctggctgattcagtccctcagaagggggcgctgctcattgttgtatgcttgcgcggtcacataagatacctgggatatagccagttgtaacctacacagttttcccaaagaaaaaacaattgtttttcctaaataaagataggagagaaccactgtgatttagcaatgcccgtttctcagcacttcctatctcccaaatactctaaaattgggaggtatgagccagttgagttttgggccttccttagagctgctgttccgacctccagctgtgagtctttggacgttgactcaaccccctcttcatcctgataatgggaatggcacaccttccagggacactgccaagactgactggtgacaatgaccctgcaatggcctttgtggaatccacgtgtgtggcctccagagaagatgaccatctgcatggcccttctcactgtattttacccaaggaggaaaactcagtttgtagttagttctgcgtttcagccttgttatccattctcggaatattaccgggtaaagtcagtttcgcgagggcactgctgctgttgatgcttgactgggaaaattgacgtcggcttccaagccgggattcacaaaggtgtcttaggtcactgcacactgtgcccagggaaatcatgtctccatggtatattttgatccatgtgttaaagtcccctctattcccagggctggatcttccaagacggggcagtgtttgtttgcttaaggtactttactgatcatactctgtagcccattacaatttagggatatttgcagtaaatatgttatggagaaatattgtgatattttttggagatatttccagagattttttttttgcttcttatatttatttatttattaaagaggttgctttgtgatttttaattctgcgtggtaggagaagccagcctctgggcagggtgatgttagtaagggactgatcggagggtgagtgctttcagtaagttgttgcaagagaagcctcagggaaaggcacatctgagggctttgacccaggctgccaccttcacatgagtgagaaaatcaatctgcctgtctggcttttaatcccctcataatgaaaaatgagagagagggaccttataatcagtgaagccttttcatcttcagaattctgatttagaggaatcaggggactctggggaaatggtgtcctggacaaaacccttctctccctcccatacacatcctgaatgaggtagctgctgtatccctgggcatctggggcaggacttgggttccctgggtccctagacagcactggtggggcatcggagaaccctggggtgagtcccacagagcagagcatcttggaggaaacttgggcttgcagaggtctgggggcctccagtggaaaagaggtcaactgtgcatgcaaaggcgactggatgccctggttccccaggctgattttcccttgcttctgagggaggtttgggggaagttatgtgcccacaactcttgggaggccacttcaccttttctaagaaagggatctgccatcactttagaaagctgacccaagcatgctatgctaaccaaaatagtaaccactcatccgcagggtcctggctgccagggagcggaagagggtttggacaaacagaactcacacccagcgaagtggagctgctggggaagacctgtggccacttacagagaactacttataatcactcagggagcacaatgagcacttagaaggggaagtggggaaggtggtctacaaaaataggaacaaaaactgcacagtactcagaaacttaacaagaggcttaggagcttcatgaagaaagtggcgatatctttttaaagggtgtaagcgtgcatgaggcactgcagcatctcccagggccctgggtgggacgggaagagcaggtatgattgcagtgctcattctcccaagagctgcatgcatttctatctggaggcttctcttggaattgaataaaatggccttaacatttatgatgcctccaaatgagccaagacagtcttaaaaataagattgaggccaggtgcagtggctcatgcctgtaatcccagcactttgggaggccgaggtgggtggatcacctgaggtcgggagttcgagaccagcctgaccaacatggagaaaccctgtctctactaaaaatacaaaaattagctgggcatggtggcgcatgcctgtagtcccagctactcgggaggctgaggcaggagaattgcttgaacctgggaggtggaggttgcggtgagtcaggatcgcaccactgcactccagcctggggaacgagagcaaaactccatctcaaaaaaaaaaaaaagattgaaaaggagcaactttttgtaacagatattggaactggggctgcaggtgaagttgtgcaggtaaagatggtctcagtgatgagagccctgccctagcaggggagatggaactcaaagcaacaaaattgacactccaaacaagtctcctggaggtgaattaacactctggaggagcctggtgcagtgcgtgcttcgtgctctaagatctgaattctaaacgcgggcctcaccctcaccaggccagtgcttggggggttggggttggacatccacatagaggctgcagtaggccatctaacccccgggagcatttgcagggtcatttaaatacatgcaacatctgtcacccacgtgggtctggggttggcccccttttctatgacaaatgacctgcatgggtgtttgttgaggctttggggcatcccgcctaagccctcctggtggctatgggacctcagactggctggggcagggggagggctggtggccactgtctttgcagagagcagagcaggacctccccagtgtgctggcccagggccctgtctctgggctccaccctgagcaggtacctttgcatgaagactcctctcagcgctgaagctaatggtggcactgatccaacatactgtactaccatgccatgtggggttgacatgagaaaggacaagtagattaatggaacctaataagcccaaatcaaatgatattatctgtaacagagtgggtatgtaggttcagtgggaaaagaactagttagcaatattgacacaattggctgtctggaagaagcagcattggatgctcaggtcgtaacagaggaaaatgaacatcagttggtttgaccatttaaatgtttgttttaaaaaaaaaatactctgcactcctcccacaaaaaacaaacaagcaatacttggaaacaacatgtataatacagggacataggtgactgtcttagccaggcctggagaagtcagatatatttacctatataaacatctgaaaggattatataacaaaattatgctacaactagaaatgttaaaaccgacaaaccatggctcttagagaaaaatatttccaaagcaaaagacagaaaaggggttaatattttcaatatgaatgctctcacaggtttcgtggtcaagaagagaggaaagaatacaatagaaaaagtgagggaggccaggcacggtggctcacacctgtaatcacagtgctttgggagactgaggcgggagaattgctggagcccaggagtttgagaccaccctgggcaacatagcaagactccgtctctacaaccaagttaaaaaactgttgggcaggtggtgcatgttagctactcccagctactccagaggccaaggtgggaagattgcttgagcccaggaggtcgaggctgcagtgagctgtgattgtgccactgcagtaagctagattgtgccactgcactccagcacgggcagcagagtgaaaccctgactctaactaaataaatcagaagaagaagaaaaaaagaaagactgaaggggaaacatgcagagttaattcacagaggagcctgccaagtggtctgggtggcagggagatgcacattaaaagaaaagtagatgtcctgccctagccaagtgtggtggggcacgcctgtaatcccagctactggggaggctgaggcaggagaattgctgaacccagaagccggaggttgcagtgagtcgagatcgtgccactgcactccagcctgggcgacagagcaagggtcttgaaaaaaaaaaaaaaaaaacacttgcagggaggttttaaaaagacaaagcagctggttttgcagaaaaaagggcctggagactcttagatactgacggaggagtgtgaattgttacagcctcttaggaaaaaatatttacaatgcaaaacttctccgtaggaataaggagcgcacaactccggcccatttcctgggattgtcataccaatgaatgaattaatgcataagaaattaccttgaaaactctagaagtgccccggagtgttttacatccattactagtgggcagtattattgagatgtcttgaggtctactaagatactttgagaatgtaccattatatgcagaaaaggccacagtagaaatgatttgtcagaaaaaaagtttcatgttaaaacttactaagaggtttgtaagtgatactgtgtttaggcatcgttttgctttcgcaaactagtgtttcctggggaaaatagatttaatctgggtgttcagtgttgcattgtagtgagtaattatgtgatgtgagcatagcatggtgtgtcactttctctgggctgagagactctgcatcctttcttcattctaaaaagaggccagaggccctgccctctgggggtgagttccgctgggacaacgttcagccctttctgacttaccacagagcgaccagtattttccattcagcttgactcatttgagcagtctgctccatgcacacatgtgcttccacacatctgggacatttcttagagctcacatcacctcgaggagacatacagaatagaaagtagttcagaaaatacattttgtgcatctagtctacactaccgtatttttggcaattttggtatcagaagattcactccagaaaaagcactccaactatcatttctcactgcctctcacttttagtattagattcagaatccattagcatgtctcactgaaggagcagatgtttcagtttatggtggaaggaagacacattctgggcgttatgcaacatacttggctcacgttcccactgcggattttgccattgctgtttcagtgctgagttctcaccttcatgattttaaaaatacattggttctgtaaacatttacttaataatccattttccagaatctttgtcctgggtgttttaaagcagcatttctcaaccgggagcgattttgcacccccaggaggcatttgacaatgtttggagctgttttaggttgtaacaacttgtagggagggagccctactggcatctataggaggaggctggggatggtgctcagcaaagtgcagagcccagagctgtccaccatcaaggatatccagccccaaatctcaacagcgctgatggcggagaaacctttgaaagctattgttgctggcattctgggctttctacttctctgcctgatgtataatgagtgtatatgaaatctgcgataattttagagtcttgtttggtcttttttaagtgatgtaaaattattttctctctgtctctgtcacacacacacacacacacacacacacttctttattggtccaccatatgaaaaataaattccaagaagggttttcttattcccaaggcatcggccttggcactaatgattattccacaagattcttggatctcttgtggtgatcctcccatttagggctcgcctcactgtgtcctggtttcacatttgctgtttgtttaaagtgttacacacttctcctgttagttggccaaaggagtcccccaggctgacctcacttgggaggcctcaatctagttggtctgcatgttaggttcattaacatgtcttcttttttcttaaaaaatgtattctggccaggcatgggggctcactcttgtaatcccagcactttgggaggctgagtcaggtggatatttgagcccaggagttcgagaccagtctgggcaacatggtgaaaccccatctctacaaaaaataaaaaacaaattagctgggtgtggtggtgcacacctgtcgtcccagctacttggtaggctgaggagggaggatcccttcagccctgggagttggaggctgcagtgagctatcatcacagccctgtactgcagcctgaatgacagatcaagaccctgtctcaaaaacaaacatccccgcaaaataacacattacctgtttcatctataaggcacaaagcatccggatttttctaggtttagtcgaatgtaacacagatttaattggagctttctctttgtagggattaattgttctcttccaatgaaataatacagaatgatactaaacacataatcatattttatataccaccgcacctcaagcagtactgtctgtgttctccatttcatggaaatcctgtaagcaatcttaccatctttctaataaaaaaatcaaagtaacagctcttgttttaattccaaaccacaaatcaaagacaagatataacacgctgctcatttgtactatttctgattgttttagtcaaaatcagacactcacttcaacaataatagtgaggaaaaaccatgctcaaaaagaaaacaggagatgtgaagtcaaaatagtggccacggcctctcacttaattgaacagtcactgttgacagtctggtgacagccagaagagcgtgaagcgggtgggacgggagcagagggctacggggaaatgggtcagtgtctgctgggggagactgtagcgatcctacagacccccgttctgcagatcaggaactcgggcactcagagtccaggcttctgggctggcgccctgtcttactggggatgagtcatcaatgcacttgagactgtgtgtgcaccgtggctttgtgaccctaaatgaaagtagtggccagatgtgaagcaccctcgttaattattgatcattccaaagccagctgtttagtgctgctcctacatgtttcctgcaggagggattttgtgaggaagggtgtggcggctttgtgcagaaggaacttgtcaggtggccaggctggggcccctcaagtgtcaggtgtgccctgcccacgttgggagcacctctcaaagccaccaaatcagcctgattaaagccaggggaataaacagctaccctgccctagcgggaactctctcagtggcttgtttagcccagagggaagtccccaaggtgatcctgggggagggcagtgtccttctatggccacacctcagatggtcccaactgcaggtggtaccagtgagggaggagttcatccctcatctatgcaggccgatgtagggggcacttcccagtttgtagcaaaaaaaacacagtttggtgactcctgatcttggacaagccccctccagttgtttgcacattggaagtggttttggcaaatggactgaactgtgttactccatgtctgtgtcaaacactggcacaaatctggaactgtctgcctttcctcccacctttttcttttctttttctttttctttcttctttttttttttttttttttaagaaggagtcctgccctgtcatccaggctggactgcagtggcgcaatcagggcttactgccacctcaactttcccaggctcaagtcattctcccacctcagctttctgagtagctcggaccaaggtgtgccagcacacctggctcattcttgtattttttggagagatggggtctcactatgttgcccaggctggtcttgaactcctgggttcaaatgatcctcctacttcagcctcccaaagtgctgggattacagatgtgagtcaccatgcctggcctccaccgtttctcaagcttagtgatattttatctcagaccacattagtctctgcactgcataattttaaagggaaaaatggaagaacttttttgcttagcactttatagtcttcatgagatattcctcctttaggctaccagatcagatgtgctttcaaaaccaaatctctctaaggcttcccagaccctggagtcacccaggtttgtgtgacttttgggaggtcagtctctgcgcgtttggtttccatgtctgtaagtgggaacatactgtcaggatcgtgggagggttcactgagagagactgtgaaatgttctgtgcaggcctgggtcataataggatatccagcacagctttgctgattttttaatgttgttattacaattaagatgataatgggccaggcacggtggctcacacctgtaatcccagcactttgggaggccgagacgggcagatcatgaggtcaggagattgagaccatcctggctaacacggtgaaaccccgtctctactaaaaatacaaaaaaaaaaaaaaaactagctgggcatggtggtgggcgcctgtagtcccagctactcggaaggctgaggcaggagaatggagtgaacccaggaggcggagcttgcagtgagccgagatcacgccactgcactccagcctgagggatggagcgagactccgcctcaaaaaaaaaaaaaaaaaaaaaaaaaaaagatgataatgatgtctcaatgctgagaggaatttagcgtctagagctcctgctggtgtggcctaaagacctgtcccaagctcttagtcgtccatggcctttgtaggggaggtccacttctgaagaacagttctgtcgttcaaaagactacatggtcttgctacagctgggcatgaaatgtgcttgagtgatgcgcaagaggactgtctgccttcatggatgtgccactggaagttactgtctccaaaaatggagtaaaactgcggtggtgacgggcacacattcgagatgtccttccagccgtgttcactcggccgtgggaggtgaaggccgaggtgtggaggcagacctgtggctgctggctggggtggcaggcacccaggaaccctgtgtcctccgggccctgtgtggtcagccctggcccaccctgatgccgtgtgctggcgtggcacctctctgcccccagccacaacgccagcttccccgcctgggcacgaccttgcctgcatggcctgtgctcagccctcagctctccttctccccacacttctccctggtgctctcagtgatgacatccacagtgggggctgctgtcacctctgtgcttaagacccccaaatatttctgtctccatctgcctgtcttcaaagctggagacacctccggagagcggaccccgcacagccccaccagcttcttgaactcaaagttggtcactgttggactctgtcccttctccaagcagaccctgcccctgggcgaggtgggtggtgcccccattccagccaccagggccagagaactggatgcccattcaacgacgtcctcttcagcagcacagccagacttccccagccagccgttcttcctgtctctagaggtccgtgctgataaaagcctcaagaagggcgtggttgagtggctggtattaagagtgttgtgccagtgggctcgatttctgtcttgggggtatgtagaacctgtgcatggggataaattgcagggtgagatgcctctcctgccactcactgcttctgcctgcccttcagtttctgtcactacagcctgtgagctgctccttccagccagagtcacgagaatggacgttattaagtgtattcgtcagctcaggctgccgtggcagtggaccacagatggggtgacttcaacagcaggaatgtatcacctcgcagttctggagcctggaagtcagacaccgaggtgtgggcaggatgggtcctcctgaggcccctcccctcgccatgttctccctgtccttacagctgtgtgcgcacgcctctgctgcctttctcttataaggaccccagccacattgcatttgggcctagccttatggcctcattctaactttaatcctctttagagcctctctctccaaatagtctctcgggggacacagttcaggggacattaggaaaggctgttagggaaatgcagccagtggtgacatggcagggttgatgtgggcccaggctccttgccgggtgctccagctggagtggttgcaggatttggacccctgaggcatctcttgcctttttggtctgctgcagtaaggaggggcctgtcccgctgttccttcataaggggctcctgaatctgagtcttccagggtctgtccctggtagggattcccgtggactgcagggccttttctttttcttttttttttttttgacacggggtctcgctccgtcacccaggctggagtgcagtggcgcgatctcggctcactgcagcctccacctcccgggttcaagcgattctcctgcctcagcctcctgaatagctgggattacaggcacgtgccaccacacctggctaatttttgtatttttagtgagatggggtttcttcatgttggtcaggctggtctcaaactcctgaccttgtgatccgcccgtcttggcctcccaaagtgctgggattacaggcgtgagccactgcacctggccagggccttttcttagaagccagcgtcctttctgcagcccatgaggaaccccttcccccactcccacaaaccaggacagtgacctgaggtctgcacgtggcacccccatctctccatgtgtggagggtcctcaggggggaatctccttcagagcccagatgcctcccctgaagtttctattttaaaagcctcctggatggggcaggcaagctattgttttatgattacaaagcagatggaaactgactttattttggatgagagttatacatggaatgtagttaacataaactgaacagagacagtgccttgcggtgtctctcctcctccgcccagggtgaggcccaggactgcccggtctcttggggaccccatcgcaacaaagcctgccccgccgatgctcgggcataggctgccttcctctgagagcaaactgtgactgagcattgggaaactttcttccaaagggacaggccctttcaaatggcttcgtgtcctctgcaggagcccagcagacgctcatgagaaggaagaaggacaaaaaagcttgtaatgacatgaagtcaaggcttgacctttggaaaaggaagtaggcacatggctagatatgtcagtgtctcagtcatcatagcttcctgtctgtgctcagaaggggtccgactggccttcataagctggacggcctggggatgggggccactgccatgcctcctctcagacctcgggctggggcctgaggaacgagcctctgcatggccagaggaccccatggttccctggactgaccatgctgggaccacatggcctgcaggtgaccgagcttgtcacagcaggagaagcagctctgaggaatgcttgggtaagctcaggaagaacaactttgggaacactttcaggggcttgactccacagtccccaaagggcgctctctagcggtgatagcttgccttgcatttgttttcgaggtcagaaccgcatcatctaatgtatctttgttcccaacgtagtgccccagagctatgctttgtacataactggtttggtggatcttgaattagaggatttaaaaaaagtagaggcttaaaatggcaggggacactcctctcttcagcatctagggcagccgatggtttcctaggagcctctggaactttgccaggggggggtccctcaaatccacacaggggaattaaatagaagagagaaaattggcgtgtggcttcctagctctgcaaactctccatacttctcatccaatgctcagggagctgatagatgtggcccacacagtccacctccagatacaaaccaaactccttgctctcttggaactcgggtgagagtagagttttatggggggtgtaggatgggaggattagtaagatggttatggtaaacatgaaatgtgttttagtgctttttactcttttacagtatcacccagaggacagattttttgtttctttgtttttgagatagggcctctgtcacccaggctggagtgcagtggtgccatcacggctcactgcagccttgatctcctgggcttaagtgaggctcttgcctcagcctgtcaagtagctgggactacaggctcgtgccaccatgcccaactaattttttttttaatttttttttagagatgggggtctcactatgttgtctaggctggtctgaaactcccagcctcaagcaatcctgctgcctcagcttcccaaagtgctgggattacaggtgtgagccatggcacccggcaacccagaggatttctcaatgagatttcctctccaaggtatgtttccaaggtgtaacataccttgttcagataaatttatgttcctccacttatttaaaaatggccaaaaccgccttcaaggaactcttacaaatgacctttgtgacattagttagcctgttattccaggaaaaagaattaaagaagaaatctaaaaattatgttttaatctaaatatctgttgatagtgactcgtaggttctgcaggctgactgtattgggtgttgttctaagcaggtggcttggaatgtgtccctgggaggtaagggggccttccaactgccaagtatctcccttacctgctgcactttaagtcccatttggcttaacgtggcttaacgtgttttaattattttttattacgatgaaacatgcaaaatataatatttaatattttaaccattttacattttttaaattataaaatgcacataaaatctgccatttcaactatttttaagtgtaccattcagtgacattagtgatacttacggtgtggtacaatcatcactactacgtatttccaaaacttttccatcaccccaaacagcagctctgtgtctataaaatggtaactctccattctgcctctctcagccactgatggtgcctaatccactttctgtctctgaattttcccccactgggcaccttatattaagtggaaccggcaagagttgtccttttgtgaatggctcattttacttggcacaatgtcttcagtattatagcacttctcttcatgactggataatactccattttgtttattattcacctgttcatggatacatggattatcctacctcctagcaattctgagtgatgctgctgtgaacattggcttgctatacctgttccagtcactgctttcagctcttctgagtgtagacctaggaatggtcattttaaccattttggagtgaaaaattcaagtgcattcagtgttgtgcaactgtcactaattccagaatattcatatcttcctagaaagaagcctcttgccgttaagctgtgactggtactcccttttcccccagcccttggcagccacaaatccactttctgtctctatgcatttgcttgttcaatggagtcatacaatatgtggcctttatgaatactcttttcttcttttactttgagtgagcttcagtggtatgaatattcttttttttttccttctttttttttgagacggaatatcactctatagcccaggctggagtgcagtagtgtgatttcagctcactacaacctctgcctcccaggttcaagtgattctcctgcctcagcctcccaagtagctgggactacaggcacgcaccaccgcacccggctaatttttgtatttttagtagagacagagtttcaccgtgttggtcaggctggtctcaaactcctgacctcataatctgcccacctcggtctctcaaagtgctgggattacaggcgtgagccaccacacccggccaaatattctttttaaaacacctgtttattatcaaaattttcagcctatgcaaatgtagaaagaattgccatatgagccccacgtgcccatcacccagatccagccacgaccaatgtctcgtgagttttgttaatcaaaatctgttttctagggaagaaaagaaatacgtgaaccgattctggaaagaaatccacgtgggagactttgtgcgtcttcgctgcaacgaaatcttccctgcggacattctgctgctctcctccagtgaccccgacgggctatgccacatcgagaccgccaacctggatggagagaccaacctgaagcggcggcaggtggtccgcggcttctcggagcttgtaagtgacccacgtttccagggcctcgcaggcattacagccacacagtgtccccatgacagccttctggggctcagagcacctgcattttcctgtctgtcagaccaggctgtttttcctagtagacgagtctgagggtctgagaggacccctgacctacctgagcccatgacccgcctgtgactgtgggaagcaggattcagtttctctgactctgatttcttttgtgcatgtctaagtttcgcagaatgttatttgttcctgtaaagttacaaggaacatttatgagcagctgatggtcaacacgtacctagctgtttcactggtttactaaatggcaacgcagcaggagtcatggcctgttcccaccaggatgctcaggaacattttctcctcaagggtgtttgggttcagcgcgaggtcttcgtagctgaatcctgcctctggtgtgccctggccaccgtgcagcagggtgaggggtgagaggctggagggaagcacgtgtgacagctgcacacaccgactccattgggctgcccaacatctgtccctgctccagggagaaagggccccacccgccaggtctgtgccgggagtgtgaggtgctaatgccaggtgaactgacaggggcaggagccctcagagatcaggaagaccctacaaggaaatgggcctggcccgagccttctcctcccaagcctccttctcccagccctgctctggcctagacagcaagtctgagtcggcctgccctgaagggtggggaagccggcctctggttcacagggaggatgccactgggcttttcctcctctatcagacagtgccctcccccatcggcctcggcaccagcccatcgggcttccctggggcagtgggctctgctgtctgtggacctcagcgagggcactgtagggagtggggcggtgagcgattggctgggcagggttgtggggggctctagcatccctgtctccgctctagatgcccccggtcaccgtcacagggggagatgcctgacacacttgcagcaggccaggtactccgcacctcgcccgcccggcctgcctgcggcaggcgtctgcctgactgttccaaccgggctgatttccgccatgatttcctcatttactctgtgtgtgtgtgtgtgtgtgtgtgtgtgtgtgtgttttaaccttcttttatgccaagtgtatttttgtgagctgcctcaaatctttttggaataaggcaaagcagacataaaaattaaaaatagtattttttgttgttgttaatggagtgctctcatttagatcaggagagctggtgaaagagttaggggcccctcgaggcacagcctggcggcgcccagcttctccatgactgtgctccagggtttggtgataggtgtgggccccatccgatgccaccccctcgccccaggccctcgtgcccaccccccacccccggctctcttcaggaagtcaggggcgtgagcccgtctcactctcagcttctcccctaggcctggccccgtctcctctgcagggatgtgaactaacactgacatcagccagggacagcatcccctctcagttcccggggtctcagctagagttaggggcaggcagagggctgatagctcgaatgtcacctctgagaggagcagcctgtgcacacagagggtgagtgccacttaaacaaatgcagatgagtatctactggtgaaacctcagacaaggtggaaaatacagcagaatttaagcactggagggtggagcatgcacacttggcatggcaggtaggggaacgccgcagatagatctccttgatcaactctcaagaataacttcctctactgggcatggtggcgcatgcctgtaatcccagcactttgggaggccgaggcgggtggatcacttgaggtcagtaattcgagaccatcctggccaacatggtgaaaccccatctctactaaaaatacaaaaattagctgggcgtggtggcgcatgcctgtagtctcagctactcgggaggctgaggcaggagaatcgcttgaacccgggaggcagaggttgtagtgagccgagatcacaccactgcactccagcctgggtgacagagcgagactccatctcaaaaaaaataaagaagaacttccccatttcctatcttctgatcttcaacttctgaacccagtcgtatctacagtcctctcccgcccactttttacccaaacaataactgcagcacttcatagctcggtggtgctttatataaatgagctgcttacaagttagatgtttgaaactcgaggacggctgcagaccaacacatctacgtcacccttctcagggccccaggaatgctgaggaagtagctttgagccatgatctggtcaaaatggccaaactaacagcctaaacaattctgagggtttttaaaaaattgttttattagcaccaaaattctttacctgcatgcacattctggtcccaattacctttttcccccgactttctgggtttttttttttctctttccctaaaggtccaaagacatttttttggtatccaaattcccatttatgcattatattctgaaatctatgaaccaccccactgaaagtaaaggaagcaagtctcttgacttttaaaccccagcaattgaaaaaccacaaatgccaagaacatttaagtactctgtgtttcaattagtttttttgtaatactgagttagcttgtctcagacaggttaagaactggtaataatctgtacactgacttatgtgaaatacaatataatattttaccagtttaatgaatgatcagttggaagtgggagcccctttgcaaatcacttaaattagaagtgatttgcaacgcttaggttaaggagaagagcgggctgtgtcattaatgcaggaacttagggtatccagcggggtccagtcaggagacagaaaccacacatgattcaatcagagaaagtctgatgtgaagaattcttagttggggattgggttataagaagtaatgatatgtgaattatatctcaataaagctgttatctttaaaaaaataaataaaaaagaaataaagaggaccctgaagaatataggagccaggaacagtggctcacgcccataatcccagcactttgggaggctgagacaggaggattgtttgaggccaggaattccagaccagcctgggcaacacagagaaaccccatctcaaaaaaaaaaaaagaaagaaagaaaaaaaattgccagatatcgtggtgtgcagctgtggtcctagctgctcaagggattgaatgggaaggatggtttgaaccagaagtttgaggttgtggtgagctgtgatcatgccactgcactccagcctgggggacagagaccctatctctgtctccaatatatatatatgggaatagctgatgaagggacagccactgcccctggctctgagacagagttctcccactcagggaagagtaccctcccaacccctgaaccatggcagggggcacagccttaaatttggggatggcaggaaaggtacttaggggctgtactggtggaacttgctagaagccttcccttggggaccggggaggctattgccagggaggtgccaagcataagaacttgctagatgccaggagcagttgctggacgctgctggagccaggccctcgctgcagtggatgaagactggtgacagctctctagacagcagcgccgtggagccccacctttgagagggtgcatggagcagcagcctgggcttgagagggcccatgttgcctgcaggaatatgtccagggtaccccggactgagagatggggaaagtgtggagcaggccaagccctggagaaacctggagggagtgggcagtgcggaacgggtacacacacacacacacacacacacacgcacgtatgcacacacacgcatgcacacacacacacaccccacctaaagaccagccatgggaccaatacgtggaggactcaggcctattcaccagtgatgcccagtatggagcagtgagatgagtccagggggcttttgttaggggtttggggccatgagaggtcaagggaggttccagaaagaggagcttgaaactgactctgaaggccaggatggagaggtctcaggtgccaggcactacagggaatgacgtccgtcagatggtgccccagaggcggaatagggttgtatttaatgaagagcatttgaaaaagtgcgcagtgttgaggggctacaacaaaaaccggaaggcggtgggcatggcccacccagaccccagaatctgaaggcgaggcctagacaccgggctgatggctccgggaccttaaatcacccagctatttcacttctggcaaaagaaacagagatcttgagacgtaaagatttgatgtaagagttggagttgaatggatgttatccaagaattgagagaggcccccgtgtggagcatcacactgtcaggcaatgtctcacatttgttcagcctcctgcacgccaggcctactgtatctcccacaactgtagtagagcaaacatttttaaacacaatttcacagaattttaagtataaatcttgtgagataatgattatcacaccattttatagatgagaaacagaaaaagtgaagtcaggagattctcccaaggtgcctcccctcccccaccccatccgtcagtgtggattcggagcgggttcctccactttgcgtggggtgtctgctgtctctcacctgcacattcgtgcagccctgccacgaaggtgcatacgttcagatgttctgtgggtagcagtttctagttcatttgtaacatttgtcatttctgcagaactaggagatccctagactgataattttatataaaactcagtgttttcaaagactcatttttgtaagttttaattcattcagcagatacgtactgagcatttattatgtttctaacgccattctaggaggtgcattgatcaaaactggggaacatctttcctgccatagtgcttacatgatctatgtgaaaagttggatagacggttgaagtcttcggtgctaactgtagacgagaaagcagaaacagggatatgaaatgtcagatgagtgttggaatttcagccggggtgaggcggggacagggctgtcctgcttgagaacagctggagagtccagacccagaggacacgtcagtgtcgggaagagccgtcccagaggtgacttctgtgtgggttaatttactgagaaaatagtttccaacagtttgtctcttgggtggacctgtttggatgagtgcccacaatcccagccacacccacgtcctctgtgcagcgctgtggggagtagtcattgtcaggcttgcaggaagatctgctgctgactcttcccaggcgtgtgcacatgtgtgcacgtgtgtgtgtgcacagtggtgcgtgttccaaataaggaagaaagataaaaggagtatggaaacttcctaggctggacaaacactgctcttaaacacgtaccttcacagtcaggtcagcagtgatgccaaggcggagacagggtttcccctctgttttgtgaatacactgtgaccagtccctggggggcctggtgtattcaggctctgactcagcacggttttctttacaaaggagagtcagtcccaccccaagttacttgacagaattcagaagcttagaaagtgacttcaaaagtccaaatatgtagaagacaaaatattttttttaaaaaactgctacctacacatgcttccaaaattgtctctatcacaggaaaactagaagtgaaaaagtataatttgcaaggtagtttttgtacccaagtctctttttccctaagcttttcaagttgttagtctttaatgaaatttagctacattggccgtggaattgaaggaggcagcataatctatcatctaagtggaaaataaagacagctgcctgggtatggtaattagatcggtcagttttaagcctttacaaagaggcttccatgtttttctcttatacattcaaggatagtcaacaagctcataatttatactgagacatttttgtttttaaatttaacaatctcataattttcttgaaggacattaaatctgtaacaggaaagacagaaataaatgactttgacaatacaataactttatttagattaaatttttaattctaacaagtgtggatattcatagaaattcagttcggtaggtaatatgattatttgagacataccatgttttttcatattaactgtgtttatttcatggcaatataagtttggcccgaagaagattttttttttaaattctggtgacttcataatggattctttgcctttaatttatagtctattaaatcaccatgtacagagagtgcagcaccagcactctgatcttttttttttttttttctttttgagacggagttttgctcttgttgcccaggctggagtgcaatggcactatctcggctcactgcaacctctctgcctcccgggttcaagtgattctcctgcctcagcctcccaagtagctgggattacaggcatgtgccaccactcccggctaattttgtatttttagtagagacggggtttctccgtcttggtcaggctggtcttgaactctggacctcaggtgatccactcatcttggcctcccaaagtgctggcattaccagtgtgagctaccgcacccgaacctctgatctaaatgaataaattaatgccatgaagttgataataatttggctagtctgaaatatttatccaaaaagatcttcttatattgtgtggaaacttaaaattttttgtgtggttggaaatgatcatttcttattccagaagtaaaaagacagccaaagcagtaagatgttttaattctgttcaaggtagcgtacaatgtgaaatgctttttttctctttaactatattttcactgtttaaaaaaaaaaacgggaatttaataaaatttccaattttcctaaatgtagtttaattgcatcagcagttgcaaagggtttgaaacttcctctgtgtgtatgtgtgtttctggagcagggatttccttaccagtaggaagaggtgacaatgtgagatcgacgcagttaacactaggcatctcctcatgagtgagtgaatatgtgtgtgtgtgtgtgtgtgtgtgtgtgtgtgtggatgtttaggtgtgtatgtttgtgtgagtgtgtatgcagacaggtgtgagtgcaaacatttttgcaagtgagtgtgcaagtaagtgtatgttccaaagaagaaagcaaaatgaagtgatattgctttattaggttgtcactttctattatctctaaatttaggagaggataaatgttccctcctgggctaagatatagtgttgcagaagtggattgctctgcaagagagtgctccctaggggaatctggagtttccaatctcactattgaggacctgctgtgagcccatgcattacgtgaggggtgcccacgcaatccacttctgctgattggactctggaacctttgtcccttggtggaggccctgtgctgtgtgtcatttcccttctgcttgttttgtgagcacagctttcaacaagagggaacttccttgtgtccacagagcacaatgcaagacctgtcagagcacctccgcagacattggagttatcttaattttgtgaattggtaagagccagcttccctcgttcaacctatgcaatgctttcggtttgcgagtgctcctcaagtggaaggctgtattttggttctcactgtggtattagggcttccttagagtttcgcccgtctacagcagcagagatccatgaacacatttgcagtttcatatagtcacataaaccagaccttataaaggaatcgacctttaaggaaagcaagaactcgacttcagaaaacactattgcctactgggatgtggatgaaactgggcttcctgacatctcagttgggtttagtgtcgaaattaattcagggctttttcaccattgctaatgaataatccgtgtgccaaggaaatgacttcgtgaaccccagtgagacttttaaccaagctgagatcaggcctgcaaacttcttcaatttgtcagttttcacaaagcccttttcagtagtgtgtctgtcagaaggccttatgttccccgcctcccaaaactgtaaaaggacaagaaatgtgagtgtcattgctggccacgctgtcttccctggggttccggagagtgggggattgggtgcatgccggggtgttcataggttaggaattgtgccagatcttcagggtcgttccactcacctgtcacaactgacctttgccgcactggcaccagcccttggcgagaaacaagccctttcatttgtgtggtaaagaaggccaacttcaaagcattatggatgtaggtttgttttggacaaaacttcaaatagctggtttgctcatccggcctttatcaagcattctggattcttgaccaccagacaggaaattctgcgaggacagactctgaggttgacatctccatctcggcccagtgagcctgcgtgggccacggaaacccctctcggggattttgagtgttgttttaaagctaaaagtgggcagggaaaggttttgggtgcaaagtcgggttctgaagctgagatcagactgccgcaagcatcagagacgtcagggcctggtgggtgggtgggggacgttcggaggagagagccctaccttttctgcaaatctcctatggaccagagattcagccacagcccagaacctggaattggggtggctctgagtcagtgttcagaaagctagtaacccttgatgactgaaatgagtgactgaggcagaagtatcaatcaattgaggtttgttaagccagctttaggatgtgtcccggtaaaataggaatcacagactgatttctgaagaggttttcaggccgggcgcgatggctcacacctgtcatcccagcactttgggaggctgaggcaggtggatcacctgagatcaggagttcaagaccagcctggcccacatggtgaaaccccgtctctactaaaatacaaaaattatccaggcgtggtggtgggcgcctgtaattccagctccttgggaggctgaggcaggagaatagcttgaatccaggaggcagaggtggttgcagtgagccgagatcatgccactgcactccagcctgggtaacagagtaagactctgtctcaaaaaaaaaaaaaaggtggctttcaggaggtgtagtattcatacatttccttaaaggaggaggaggcacacaggaagaggggcaggtaggcagccagggaatggtcactttcctgtgagacttcagttggtgtccagtaaatccacatttttacatcagacaaagtcaatgtgtgaagagaaaaagcacagagtcaattatgcagacatctctgggtgggtggagggaggagtcttgtctttgttctgtagctgggaagataagcctctagtggacattattaatgtggaatccaacagactttagttttagaagctagacttagatcgcagacctaatgtttttctttttattttttatagagataggaaggtctcactatgttgctcaggtttctcttgaactcctgggctcaagcagtcctcctacattagcctctcaaagtgctgagattataggcgtgagctgccgtgccgggctctttgtgttatgattggcatgtccttgtttatgggtggccagcaaacaatgtcctcatgagtgatcccggggggcatgttgtgctgcacccctgttaacctcagtggggaaggcacaagtccaagaggccgaagaagagacccagagccagcacttgcaacacggggtttgattaggggcttacacagaggggagagagtctggtggtggcgggctgaaaaggaaaaccactaccgcttataaacagcatgcactttctacagcattttcacttaacaccctcccctgaacgacctctacctggaagccttcatttaacccaaaattcagggcctcaatcccctgtgcgacccgagttccacaggacaggtgggagctcagatgtttatcatagacaaagaacaaatctctgggttggccacgcccagatgtcctagctcagcacacatactcaggcacatctgccatgcagagtcatcctcagggcaggcttgaggtattgctgtcaggtgcatttgccctgcagggcagccctgcagagatgctgtaggcctcttgcctgtccctggggcgttggatgatgagtaatgccagtgagagcggttcatctggaacagggtgttgcctggctccacctctgggcctaagtttgggggtcctgagatttattattttcctttgcaaccctctggtgagagtgactacccccactactcccttctcctggctgggtaacagtgccatctgacactgggcacttgcctgtgtgaggccctcattcatttagttctcttggcagctctgagaaggtgctgttattactcccatttagcaaaggagccactgagactcagagggagtcagccccttggcctgctggggtccaagtgagtggtgggccaggttctgggccaacagttggggcgcagggcctggccgtgaagcccctcagggccatctctgcagagcagcgtcaccattgctgtcgctgctcaggctgattgggctgggctgggccgatccccaactgtggtcaagtctggaatggctgaaaacatgggtggggcccctccccacctcgcccgggtcgtgttgtgatggctgaaaacatgggtggggcccctccccacctcgcccgggtcgtgttttaaatgctcacctcgtagttggcttgggctgccataacaaggtgccatgaattgggcggcttaaactgcagaaatttattttctcacagttctggagtctggaagtctgagatcaaggtgccgacagagttggtttacttgaggcctctctcctgggcttgcaggtggtcgtccctctgtgtatgtctgtgttctgatctcttctttaaggacaccagtcctgttggatcagggtccatctcagtcacctcatttaacccttattacctctttaaaaactgtcttcaaataagggcacagtctgaggtatccagggttaggatttgaacgcatgaatctggggaaggtagaattcaacccctcacagtgcaggttcggagtgaaagtaaccgccattcctggatggtggcatcaccatgctgatcacctcagatcaatccatttcactgcatcccaattctctccactgtcaggaagaggaaatgctttctcatgatgaacctacagctagaaactgcagttccagaaagttagctgaaggctgaggcacccgggtaggatggccacttccccggctggctgcagtgttctaggaagctgatggttatggttagtatatgcatgtcttttttttttttttttttttttttgagacagagtctccctctgtcacccaggctggagtgcagtggtgccatctcggctcactgtaacctccgcccccccaggttcaagcaattctctgcctcagcctcccgagtagctgggattacagacgcccgccaccacccccggctaatttttttgtatttttagtagagacagggtttcaccatgttggccagggtggtcttgaactcctgacctcatgatccatccgcctcagcctcccaaagtgctgggattacaggtgtaagccaccatgcccagcctatatgcatgtaaaagtaaaagctctgtggataacagtggatcaaaaggaattaggattttactatggggcagacttcgaaaatctgattagagtgtgtttcagtattggagcgcgtgtgcatgcatgtgtgtgtgagagtcaaggcactaataagcaatgtcaggacagaaattctattaaacatttcccttagaaatagtgagggaaaacctttcaacccttaactaaactctcctttaaaagttcttagcatttccttcaaggaagacataatttctacggaagcaatacgtagtgtttttcctgttccctgcttgtttaacattataaaagtaatccagacttgttttacaccagtagtgaaaagagggctctaccaggcatggtggtttacacctggaatcccagcactttgggaggccaaggtgggagggccacataaacccaggagtttgagaccaacctgagcaacaaattgagaccctattgctaccaaaaaaaaaaaaaaaaaaaaaaattagcccagctacttgggcaggtgaggtgggaggattgcttgagcctgggaagttaaggttgcagtaagcctagattgtgccattgcaccccagcctgaatgacagagtgataccctgtctcaaaagaaaaaaaaaaaaaaagagagagagagctctgctgagagtcaattagaaattggaaacacaaggcgggacctggacctggacctgggtctggggttgaagcacttggggtggacaggatgggagtccaggtgcccagccaggagctttgcctctcagtccacacttgcaagtagaaggaatcaggaagcactgcttttcttttaaacagacaatgccattttttctcagattacatctttcacagaaagtccacagtaatgactgtgagccacagtgacaggagcagtggcccaggagcccctgccgctcaccagcccacagctctggaggcccaagccactgaccctccctccatcgcagctgctcgcgtgctgtgtcctgtgaagggtccagcggtttcctcgtcatgccggcccagcacttggggttccctctgacctggctgtccctcatccagtgcagagaaccagctgccaagtcctgtagattctgcacgtgcaagtccaggaaccagcctcacaggggtgaggggactttgggagccagccctggtgcgcccgttggacccccttggccccatgttcaccccagtgtctcccaggtcagggatgcccagtgcctgcccatgcacccatccaggttggcatgttagatgcgtctcagacagagggcccgcaagggtcccatactccagtgagcacacctacctctgtctacagcacagtacttcagcgaggtgacagcggctgggtccttgctcactgcagtggctgcagagaacatctgccagcacttagcacaggcagctagcacgcattagtttttagcctcttagtgtctcattggccgaggtgggattcccctgaggagctttagaagtcccaaaggcctgggctcacccctgcattctgactcccctcatgtggggtgggccaggcactggggtgctccaggctcttctgcactaagaaccaccacgctgagataagtacagttgcttccctattttacaaataaagggatccaggtctggacaggtcaatgggctcaccctactatgcagccagtcagaggaggggctgtgctgcaaacccaacattgggctccagatcctgttcttacagcactccccaaccccatgcctctctgcctgagccccggttcatccaggtctcccagcagactcgctgtccgggatgtggcgcagcctccatccatcctctgcttcctggtgacagcagccttgcatggcacccccttcaccgtctcaggggtgccacagcgtgtccacccatctcctctctgcaggaagccctacgttctgctgcagcacctgccagaatgatgcaccaaaattgcagttctaaccttggcactctcaggctgaaaggcctgcagcggtgagtgtcacctgtgaataccatggtaaagttagggaatggctctctagaccagaacaggcagaagggaatttgattgctgcccacacatctgactgtaatgtgctacgtagcggagcagccctcttcaaagaaattgctgatgccaagaaaccaggcagggcaaagtgtgtgtatgtgtatatgtctgcctgtgaatgtccatgtattaagttatatggggcccattaaagtttttttttttttttttttagaaacagttccactagtttaaagtatggacaaaaccccgattagagtatttttcgggagttttttgggactggtgccttctcaagctgcagctctagtccccgtggcacctagctgtgttctaggatgttttgctgaggcccgaggagcgcttgcaggcggcacagacactgagctcagggtgctgggatggaagcggctgggttggggcctggaggcagtgtttgagcgtgtggttcctcagtgcatgtaagcaccacctggccctttcttgtcaccgagaactgccagcaggaagatccaattacaatagaggctggtggagcttcctgccctcctcacttcttctgctggctcagagggaagccctatttcaggaggggtgtgggctgctgggctgggcctggggagggagatgctggtggagcatttgggggcttgaggatgttgggtctgagggcctgaccacagcacagtgagacacttgattatacaggcaggctacagcatggcatggagagtgagctttggggtctgcctcctacatttgctagcttgtaatccaagaacatcatttgacctctctgggcctcagtttcagtatctgctgatatggtttgtccccacccaaatctcaacttgaattgtatctcccggaattcccacatgttgtgggaaccagggggaggtaactgaatcatggagtctggtctttcttgtgctattctcgtgacagtgaataagtctcactagacctgatgggtttatgaggggtttccacttttgtttcttcctaatttttgtcttgccgccaccatgtaagaagtgcctttcaccttgcaccatgactctgaagcctccccagctatgtggaactgtaagtccaattaaatctctttttgttcccagttttgggtatgtctttattagcaatgtgaaaacggactgatacatctgcaaaatgggaatgatgtcagaggtccttctggcctgtcctttgcactgcacctggcaggtggtgagtgctcagaagggtggctgccctcagcactgccctgctgctgctgtcattgaaaggcaggctgctggaggaaaggtgagaccggcaccaggagtgaagttatagagaaaagggtttgcgtctctgtgagaagaacttgatcatgaatacaatacctctgtctaatccacagagctggaagaattaaggtgaggctggagagtttgggtattagatgagaattggctgtccagggctgggagcttccagcccgagctctgggaaggaggaagctgcgtctcaatgatcttttccttgcccaggacttcaggagtgaccgcttacctgcacataagagcaggacagctgtagtgccgcggtgagggatgtgatatcattagaggctctacacgggcagaattctggaatgtgggtgggaacgctaagtctctgactttaacctgagctttcttggtgccagaaaaccagagcaagttggacacgctgaatgttctggagggcttctgagatatcaaaggcaggagcaggtagacgtgtttctaatggaaagttctgatgctgaaggggaattctttgttcacatgttgtcattattggcaggtattctatagaggagtggagaatattggattactatgctactggctgttaaacattgtctctccacgaagccaccaggctgtgccaggcagacacaacacccccgccccgcccccctgtgttgtgctgacttcatcatgagggctccacagggctgctggtgctccccagagatccttcacctgaaacatcagggctgtttaaagtctaggcttcaaggagaaaatcgtctagaagcaagtcttgatgctgtttaatgtgtgtcctgcatcctcactagcattccacagacaaacgcttcagccgggaggtttaatagaatgaagtgcatttccttacctttccctgcagtctcaggtccccagtggcactcatttcctgaacccagtcatggaagccacaattaccctctgccattagcaggccggagcttttagctcatggcactcctaaacccgaaggtagagcgtctgcggtttctagcatcataggctgagtgataaccctttgtatttcaggtgatgggaagaagtgaaggatagctcagattgttggaaagggaatatcttggtctgttcctaatactgtaatgaaatgaccacagactgggtcacgtataaataatagacatttatttctgacagttctggaagctgggaatacaagattgaggcgccagtagatctggcgtctggcaagggccctcttcccggcctgcagacagccaccttcactctgtgtcctcacatggtggagagagagagagaggcagaacttcgagtgagtgtctcttcttagaagggcactaatcccactcgtgaggctccaccctcatgccctaatcacctcccaaggacccaccttcaaataccatcaaattaaggactaggttttaacatatacatgggggactcaaacacatacattctaagggctaagttttaacatatacattttgggggactcaaacctgccatctgtagcagggaacatcctgagtcctggaagcccgcgctgcacggtgcaccttaggttggaaagctctttgcccaggattcttcattttcgtaagtctttgtcgggtcagtggaataacagcatcagcctcactcggtgccttgaagaaatgcagagtcccaggccctgcccagatccactgaggcaaggatctgcattttgacaagatcctaggggattcatgtgcccattggagactgagaagccctgcattgcatgggtgtcacctggacataatgaggcatattcttctctaattgttgtccttggttttgcatgcaagtgggataatccgcttctgtgatcttgctttcctgacatagttgatattttcatacttcactaatcaagcacttaaaagaagacacagagaggttatcttttacaaaaaaatgtacttttgaaaagctctaaataaaataaaatgaaacggtgttctcctatagatataattttagggatgctttatttccattgcttattgattgatccacaggggaggagcttatagctggccagctctcatctgcaaagtagttaattattaacagcacttatttgcactgatcctgtgcttcctggagtgaatcattttacagcaggtgctgcagaatcagtgtcttgctgtgtcctggtcttcattaatctgcagcctgtgttcctccagcttttccaaataatgacagaggacagacattcacagaaacaatctttaatccgggcaccctgtggcccactcaagttgacacatgaaattaacactcatgtgcgtggaagcctctcagaggcatccttctgggagcccagtgctggaagggatgctggagagccaacttcaccaggaggaagtgagtctggatgcagggggaggagcctggccatctgctgtcgtttgggatgagtcggactcactggttgctgatattcaagaccaacagatgagcggatgttaaattagtgatctagaattaaaaggatgcccagtcccagtgaaaataatttatttcaagaattccatgggcaagcaatttaggcacgtaaaataacacccttattctcagcaggttaattttgctcgagaatgaattgagtgcaggtggaggagcaattattttcttacaaaaataagcttccctttccctaagttgaaaatagccttggataagtcagatgacagtagtttcttaaagacaggcagttcattaactggttgtttttagctgctcagtaagagtctttcaaaaaaccaaaagtttgggaaaatgtgtgtcacttgaaaaaaaaacattgttaattatcggttgaaaactttagctgccctttcattttttaaacagccttattgaggtctgactgacataaaataaaccacacatatttaaaatgtataatttggccaggctcatgcctgtaatcccaaagttttgggaggccgaggtgggaggatcacttgaggccaggagttggagaccagcctgggcaacgtagcaaaaccttgtctctacagaaaatttacaacttagctgggcatggtgccacacgccaattcctagctggttaggaggctgaggctggaggatccctggagcccaagagttctagtttgcagtgagctatgattgtgctgctacacactagcccaggcaatagagtgagaccctgtctctaaaataataaataaataggcttgggcacagtgactcatgcctgtaattctagcactttgggaggccaagacgggaggatcacgtgagcccaggagtttgagaccagccttagcaacacagtgagacacagtctctacaaacatttttctttcgaatttgccgggcgtggtggtgcattcctgtagtcccacctactcgggaggctgaggcagaaagatttcttgaggccagaagatcaaggctgcagtgagccatgattgtgccactgcgttcctgtattagtctactctcagactgctaataaaaacatacccaagactgggtaatttataaaggaaagaggtttaactgactcacagtttggcatggccggggaggcctcttgaaacttataatcatggctgaaggggaagtaaacatgtcattctttatatggttgacaggaaggagaagtgccgagcaaaagggggaaaaggcccttataagaccatcagatctcatgagaactcactgtcacgagaacagcatggggggaaccgacccctgagtcatttacctcccaccggatccctcccacaacatgtggggactacgggagccacaattcaagatgagattttggtagagacacagccaaaccatatcattccaccctacccaaatctcacgtcctcacatttcaaaacacagccatgcctttccaacagtcccccaaagtcttaattcattccagcattaacccaaaagtccaagtccgaagtctcatttgagacaaagcaagtcccttctgcctatgagactataaaatcaaaagcaaattagttacctcctagatacaatggggtaacaggcactgggtaaatatagccattccaaatgggagaggttggctaaaacaaaggggctacaggccccatgcaagtccaaaatccatagggcagtcattaaatcttaaagctccaaaatgatctcctttgactccatgtctcacatctaggtcacactgatgccagaggtgggctgccatggccttggatagctccacccttgtggctttgctgggtacagccccactcctggctgctttcacagctggcgttgagtgtctgtggcttttccaggcacttagtgcaagctgtccgtggatcgaccattctggggtctggaggacggtggccctcttctcacagctccactaggtgctgcccctgtggggactctgtggtaagtgtgagtcaattaactctctttcctttataaattacccagtctcgggtatgtctttattagcagtgtgagaacagactcatacagtaaattggtactgagagtggccccggacaaccactgatcttctttcagtcactgcagattattttgaatttttaagagatagaaatggaataatacagtgtgtccttttttcgtctgacttttttctctcagtataaatattttgagatttatccaagttgtaggtattcatagtttatttctttttattgagagtagtatttggttgagatatatagtatagctcaactatgtatcttttggattcattcatctgttgatagacatttgggttgtttacaatttttggttgtgatacataaatgtgctataaaaattcatataaaagtctttgcaaagacttagtctttcattctcttagacacatctcttagataaatccagaggtggaatggctgaaacatatggtaggcacatgttttatatatgtatgcttgtatgtatgtatgtatgtttcagtcaccaggccggagtgcagtggcacgatcatagctcactgcagcctcaagctcctgtgttcaagccatcctcctgcctcagtctcccaaagtgctgacattacattcatgagccaccgtgcccagctccatgtaattaattcctgctgtgaacttgcttagcacaagcccatcagttttgtgctattatagttttggaaattcagtccaatgctatgaactcaaaattattagaaactatatacttgtcagagtttttttcattctttccattctttccatgaactgccctgaagacataacacttgacgattgtaagtgcttgcaagtaactttcagaaaggcattggaataaagcaattgctatgaacaccaaggcttaaaatggctatggcaatgcagttgacaaggaaatttggttattcgtgaaccataattatgactgatagcatttatatgaagacataggtttctaggaactttatacaattttggaacatctattaataacacatccatataactgtcactcgaaggctaaacatcattccatgttttgacagtgcttcccatataatttaaaatattcgataagcccatgttggcttaatctctttgttttacagttccttttagaagttccagggctttctggaatgtcctaaagttaatttcggtcaaaagttttttgaaaagtttgtcaaatatccaaggtttaaattacatagctactcagggaggctgaggcaggagaattgcttgaacccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttacaacaaaaatcgcaaaataaaataaacaattagagaaaacagcatgtaggaataataaaatacctggaagaaatttaagcaaggaggtgaaagacacatatactgaaaactataaaacgttgctgaaaaaaattttaaaggacttaaataaatgaaaagacatcctatgttcatggataggcaaatttcatagtgttaggatgccatactactcaaagcagtctactgatacaatgcgctatctgtcaaaaccctaatgaatttttgcagaaataaaaaaggcaatcctcaaatttatgtagagttacaaggctccccatatagccaaaacaatcttgaaagagaagaatgaagttggaagattcacatatcttgactccaaaatgtactacaagactacaggaatcaaaacagtgtggtctacctgagatgttgtaccctttgaccatcatctccccatctctcccaactcccagcctctgtaaccacaattccactctctgcttctgagtttggttgctttagattccacatataagtgagtatatgaaatatttgtctctgtgcctggcttattttacttagcaaaatgttgtctagttccatccatgttgttgcaaatgacagaatttccttctttttaaagctgaatagtatttcattgtgtatctataccacattttcttcattcatctgttgatggacacttgggttgattccattattgtaaataatgcttcaatgaacatgggagtgcagacatctctttggcaaactgatttcaaatcttttgcataaatacccagaagtgagatgttggttcatatggtaattctatttttagttttgggggaacctccatatagttttccataacagctgccctaatttatatttccatcaacagcatatgagtgttccctttgttcacatcctcatcaacatttgatatcttttatctttttggtaataactattctgacaggtaggatagcaaatctcattgtggttctaatttgcattttcctaatgactagtgatgttgagcattttttcatatgtcttttggccatttgtatgtcttcttctaagcaatgtttattcagatcccttgcctattctttaatttgattttttgttttcttgttattgggtttttgagctccttgtatactttggatattaatccattattaatcaataatagcttgcaataatggatatatggcttgcagatattttctcccaattcgcaggttgtctctgcacactgttaattgttcttttgctgtgcaggagcttttaagtttgatattaccaaacttgtgtatttttgtttttgttgcctgtcctttcggggtcaaatcaaaaaaattattacccagacaaatgggaaatattttttataatgtgagttatggtaaacttgttgacacttcttttaggacctaaaatatggtctatcttgctaaatgctctatgtgcttttgagaataacgtgcattctgctgtttttaggtggagtattttatagatgtcaaacaggtaacactggttgatgatgttattcaagtcttctgtgttcttgctaattttatgccattttttctaggaattattgtaaagggctactgaacctctgaacataatgcagatatgtgtatttctctttgcagatctatcagttttgcttcatttactttgaagctttgttgtcaggggcattttggcccttttataaatccctggcaatattctctgctttgaaacttactttgtctgatagcaatatagccattttagctttcttttgactagttacagcataaccttatataacatatttgcatcttgtatttaaagtgcatttttttagacagcaagaaattgagtcttttgctaatttttttaaaaacgagtctgccttttaattgaaatgtgtaaagctttgcatttaatgtgattaatgacatggttagatttaagcctatcatcttgctagttgttttcccatcttctctttgtgacccttttcttctttttctgcttcttttttctcccattagctataccttttcattagaggttacttcaaggtttgttggatacatctttaattcatcctgatctatcctttcagtgatattatttcagttcacatatagtaaaggaactttgcaatggtatccttccatttctctccttccagactttgtactgtcatcatcatcatcatcatcatcatatatatatgttgtaaacgaatgttatttttatgatacattttgcttatatattacagagatttatgtaataagaaaaagtcttacttacccatgctcataaaaagagcactaaaatcacctagagcttaaggatgaactggctgtcaaataacaaaacaaacaaacaaacagttgccttttcctgtgctcttcattcttttgtgtagatccatatttccaattgataatttccttttgcctgaatggcttcctttatcatttttttctggtatggatctgtgggtgaggaattttttttcagcttttgtatatgtgcaaacatctttattttacaccctccttttttattttgaaaaatatctttactgggtatagaattctaggttgacagtattttacactttggtgctttaaagatgttgctccagtgtcgtcttgcttgcattgtttgtaatgaaatatctgctcttatccttatttgtgttcctttgtacataacacagctgcttgcaagttttttttttaattactagttttaagcaaattgatcatgatatgctttgtaattttcttcataatttgggggtttgagattcttggatctgtaggtttatagttttcattaagtttggaaacttttcagttattatttaatcaaatatttcttcatacccttccccatctttggggattctaagtaatagaatattggcttcttgaaattgttttacaacttaccaatcctctcttttgattcttttttctcttagtatttccgtttggatagttttggttactatttttcaagttcactatatttttcttttgtaagttctaagcagctgttgatctcattcagtttattttttgtctcagatattgtagctttcatctctagaagttcaattttggtctcttttttaccttccatgtccctacttaagtttttgatcattggaaagccagcataattactgctttaatgtcattttctacaaattctaacatctgtgtctcttctatgttagattaagctgacttacttattctctttattatgggcctagttttctttcttctttgcatgcctgataatctttaataggatgccagatattggatttgactataaatattcttgagttgtgcccaggactgcagtgaatttactcaaaacaatttgatttgttaggaggatctaaagaagtgctcatctagagttaattgttctccactcctgaggcaagactttcctaagttccctagcagtgctgatgaatgattagtttttccagtgtggctggtggaagcaggcactgaccccagatctatgtaacacagaacacagttccctctatttctctcttatttgcaccatctttaatctcttaataatactttatagttttcagtgttgagatcttatacattttttagatgtattcctagcaaagtgattttgttagcttattacaaatagtgtgcttatgaattcaatgtgtgtgtgtttacatgtagtaaatatagtatacatgcatatgtatgtatgttcatacagtctatagagacatagtaggtgatcttgtatccagaaactttgctaaactcatgtattaattctttttttttttttttttttttttgacagagtctcactctgttgcccaggctgaagtacagtggtgctatcttggctcattgcaacctctgcctctcagtttcaagcaattctcccacctcagcctcctgagtagctgggattacaggcacacaccaccacgcccggataatttttttttttttgtatttttagtagctatggggtctcaccatgttggccaggctgttcttgaactcctgacctcagataatctgcctatcttggcgtcccaaagtgctgggattacaggcatgagccactgtgcctggtcactcatgtattaattctaataagtttctaagattattttagatcttctacacagtcattttatttttgaattatgatagcattatttctacctttttagtcattatacttttttttttcttacctaattgcagtggcaaggactccagtacagttctaaatggaagtggtgatatcatacattctttccctgatacaatgtgtaaagggaaaaatttgaacattgtaccattatatatgatattttattaggatattggtgaatagcccttacaaactaatgattcttttattcgtagcctgctaagagaaagtattatgaataaatgttgaatcaaatgcatattctgcttcagttgagttgatcatatgatttttctctttttgtgttaatgtatctaatgacattgatttttctaatgccataccaatcttgaattcttgagctatatccatcttcctaatgtattatcttttatatatttctgggattagtaaactaatgttttattaagaatttttggccgctcacacctgtaatcccagcactttgggaggccaaggctggcagatcacgaggtcaggagatcgagaccatcctggctaacacagtgaaaccctgtctctactaaaaatacaaaaaattagccgggtgtggtggcgggtgcctgtagtcccagctactcgggaggctgaggcaggagaatggcatgaacccgggaggcagagcttgcagtgagccaagatcgccactgtactccagcctcggcgacagagcgagactccgtctcaaaaaagaaaaaaaaaaaagaatttttgcctaaataagatagacttgtacttttgtgttttttaatatgtttattgtgttttagtataaagcccatgccagcttcataaaataaattaagaagtatttgttctcactactggaagagtttatgtaagtgaatgttatttcttcctcacatttttggcaaatttactggtgaagccatctgaatctgaagtgttttttgcagaaagattcaaactacctttcaatttgcttaatgttaaagaactattgagaatatgctgggtttttttctactctaaattttagaaacttgtatttttctattaatctgtcttttttacttaaattttcaaatttattagcattcagttgttcacataacacttttaacctgttgatgtatgtaggatttgtactgatgttcccttttttatttctggtattatataatttatacttttttcctagatttgtcttttaattagttatttttatttattttttctgctattgtgtttagtatagtcttcttttttacaagttgtgcctagctcattaatttctccttttagtattccttaatatagtcaagtagactattaatttccccgaaagcaagcaatatcccacaatctttgatacgtagtacaagttgaatattctttttctttttttttttttttttgagatggagttttgctcttgttgcccaggctggagtgttggtgcgatcttggctcactgtaacctccacctcccgtgttcaagtgtttctcttgactcagcctccttgagtagctgggattacaggagcccacaaccatgcccagctaatgttttgtagttatagtagagatggggtttcatcatattggccaggctggcctcgaactcctgacctcacttgatccacccgccttggcctcccaaagtgtagggattacaggcgtgagccagccaagttgaatattctttatctgaaatacttaagacaagaagtttttcagatttctgatttttttttatttttgggatattatttgcattacacttaccagctgaacattcctaatccgaaaatctccagagagcatttcctttgggtgtcatatgccaacacacaaaaagttttagatcttgaagcattttggattttggagtttccgagtagggatactcaacctatatgtttaatatcatttacaaaaatatttttcttaatttctctcgtgacttcttttctttgactaattggtcatttagaattgtattacataatttcaaagcaaatgggacttttagtaattttctttttatggtgaattctgatttaagttaatcctatatgaatttagttttttgaaattgattgatacttgcttatggcacagaatatggtcagtacttgtcagtgttgtgtgagtacttgaaaaactgtgttctacagctcttgtgtgcagtgttttatacgtgtccattaggttagtttattaatagtgatgctcaaatatataacttcctggttttttgactgttttatcaaatactgagaaaggaatgttaccaagtttgtggatttgttttatgtctcctttgtttctgtcaatttttgtaatatataatttgagtttatgctattaggattatataaatttagacatttttatttttcaaatgagttgaactttttaattcaaattaatgctttttatatagagacatgctttttgatttaatactatattatctaatattaatacaggcacgctagctttctttttgttactctttgccatttatatctttttcagcttttcacacttttctagtatctgcatgctttaggtctttcttctcgtcaatatagtcttgagtttttaaattcagtctgacatagtttttgggttttcattaaaatatttttcttgatccacttttaaagttactactggtatatttgagtgtgaagcatccatttattatttttatttgtcctgcctgatgtattcttttttctctccatttttgccttctttctgattcattgagtttaccatgctttctttggttggttcggaaattatatgcttcttactataatatggtggttacatgagagattacaacatgcatctttgactatcagtattaaacattaattgatttgtattctctttctgaataattcaagggccctttttaagcaaaaaacatctttttattctcttccaacttacatactcttgtgttttgtaattgtatcagtttatgaattgccaaagacattattatttaatacagtcaacatgcttttatatttactttcttatttaccgtttttgttgcttttcatttcttcctgcatcttagtcctttcatcaggccaatttccttctctctctctctttcttatagcagagatggggtcttgctctgttgcccaggctcatctcaaactgctggcctcaagcaatcctcctgctttggcctcccgaagtgcttggattacaggcatgagccactgtgcttggcctccttctcttttaacactactgtttagtattttctttagtttttgtgtgccagtaacaagttttatcaatttcccttttttttttttgagacggattcttgctctgttgcccaggctggaatgcagtggtgcaatttctgcttactgcagcctccgcctcccgggttcaagctgcaacctccgcctcctgggttcaagtgattctcctgcctcagcctcccaagtagctgggattacagacacgcgacatcacacccagctaatttttgtatttttagtagagttgagatttcaccatgttggccaggctggtctttcaagaccatgacgtcgtgatctgcctgcctcagcctcccaaagtgctgggattacaggcgtgagccaccgcgcccggccccaatttccctttaagagtttattttctttggttttcatcattttagtgtcatgtgcctaggtataatctcccttcacagaccctatttaaaagttcttgcatctgcggtttgttgctttttagtcagatttactacattctcagctattatgtattcaataattgctcctgcatcattctctctctctttttcttctggggccctgattacacacgttagacttccctctatcctttatggtttcttccctgtcttctgtacttctcatcctttcatcttcccatgcttaattcaaaaccatttttctcatgtttcttgtagtttgctagttttctctttgtgtttgccaaatctgctaataagccaggcagtcagcttttaattgaaaatttcatgtgggctctatattttcaaaatctctaaggtcacattttataatttctagctgttgtaaaatttcaggtgcatctttagctttatgatcacagcaagcatgattttaaacttcctgtggatctgttcctattcttgttttgttggttcttccatgatgctttacatcctgttatgcctggttatccctgagtctgtgtctgacattgtacctggaaattgattttttacaaataatttgaggccttgtatttcatatatatatacacacactcacacacatacatgcacacacacatacatgtgcacacacagacacacatatataaagaagacttttgctggttttgtttagtatctaggggttctagcaatttggaattattatactccatttttcacattgagatttttctgggccactcagttgactctaagctgggtagcagctgcacaaaaggagctcagcagtgttctggatgtgtttgatgcagtggcaccgtgttgtattaagttccatgttgaagctctttcccgcagttcacctctgtgatgccgttcttcctggttgcgttagaaagcataggtgtttatcaggcccctctcttggtaggttttatagtagacagaatagtggtcccccgaaagatgcccacatcttactcacctaaacctgtggatatgttatgctacatagcaagcagaaatggaggttgtaagtggaattaaggctgttaatcagacctcactatcaaagtgatacagcgtgagacagactcaatccccgcacactgatgactttaaaaatggaaggaagccataagtcagggaatgtgactcaagaagctggaacaagcaaagagatgcattctctcctagagcctccaaaaggaacacagccctgccaactccttgactgtagctcagtgagacctgtttccaactttcgacttccaggactgcgagacaacaaatgactgttgttttaagcaaccacatttgtgttcatttgttacagcagctacaggcaactaatataggccccgagcaccaacatgtgtctcatgagctccactcaacctcttaactacatcttgcagaagctgtagaccctcctcagggaaaagaaacctcaaagcccagcctcaactctggatttttgtctttttatttcttggcttgcttattcttcactttcttgttaaatccttcatacctccaggcagctgtcttcagttttctgtccagcatctctgtttgccagtaactagaggtttggtccaaattgcccagtcgtctggtgctggataacttttcttttgaatctgatgactgagcagatctggttgtgctttagaatttcacatttctgttgccatttcagtcttggaatcattccccagattagcgcaagaggttttttcttagctgacctctttttgtattctccatcccagttggcctctaaaatagtagtatggtcttcctctatgtggctaccaatggccctgtggtccatggaactctgcctttagggtcccttttattacaaatacactgaggctccagacccctcttacactgtgcacagagagagcaccttttctccagcaaggctgtctactgagtgagctctaaagcatgacacgttcacacccaaaagccgtgcctctgctcacaccatcacccccacctgtagtgatggaagaggcactaagtggcctgtggctgtggaagcagacagactgatgtggatctcactgtgctaatagctcagcagaggggctgcaggcgggtttcatgcagggacaccctgttggattaagtacaaatacgttcaagagggcaattttaacgagcagccctcatctaggtttgaatttggtgttctgtgaaacaactctcgttacctactgcctgaatgcacagccagttcttagggactcttaggtgcatttgacggaggagaaagcaaggctttgctgacagccacagcccactgaaacagcatggagcgtttggggccaggagggaaagaaagggttttgattttgagacttcaaactctaaccccgcactgtgagcctttgaattttgccaccatctaccgaggctttttgactgtgcgacagtcaggaggcaaggggacaaaagatgaaaggcagaaaaggcaaggggaggctggcgcctgcgttctaaactagaatttaacaagggaaaagctgcctttctgctcagaaactaagggaggaccacttgatctctaacactggtgcttgcggcaagaaaatctccagttagaaaaagaaggcagaacccagacaccccttgatcagtttctctgaggcgtgagcctcccaagaagccacctgtggacctgtgtgaagctgactctgaaagaggactgcggaggcctggatgccagttctcattgtccctgtcagcttgtcaccgtggagacgagaaccacgtcaggcagggacgcagcactcacagagtccgtcacatgctgtgtgacgtgcagtggagtgtcccgccatgagcggctgggccaacctacttatcacttccatatttgggataccttaaataatacaatcacagccgctattatagattacattgctgtctaaatgggtttcatgctcatttctattcagtatttgtcacggggcattaacccctagagtaacactgaatctgtggaacttggagaaattatcactttgagttaagtttccttgtacgttcggtgtttcttgccaccagacgctttcacttgggtatttatttattatttattttttcaataaataactgattgagtacccactatgtgtcaggagacacgtggtggacaaaaacagactactttgctgtttcagtttagcaaattgaaaatgttcacctgacaatacagtcttggcagtgaaaaagtaaattcactcattcgttcagtattgggatcgggccatctgccctcctttgaatttccacagcactgaccgtcaagtggtaaatacaaattagattgaaatacaaaataataataatagtaataataaagaaagtacaaaacaaaagagttggggtaattattccattaatttgggttaaaatgcttgacttaatttaatgaaggcattctttacccatgatcaataagtaaggagctaaggagccggattagaggctatgaagaaatcattttgtattgctgccaggggaaaagagcccgcactttaaaaagaggaactatgcattctggaaccacagagacgcctcagcaggccctcttgggagatggtgcggcaggcaggggctctaggtccccaagagcccagcacggagttctggggtgatccagaagcttgtggcacctgagatccttctgaaataagcattcgtcaccctctgaccatgtgtgtgccaggcactgtgatggtctcaagggcacagagtacctgtgctcagggaacctgtggtctagtgaaggaggaatgggagccagctccagccacacccaggaagcacggggtttgatgtctgcatggggactaagcaagttcggagctgtggcacctgcctaccctaccagggggccgtcaggaaggcttctccagaaaagacaacatcctgaaatgctaaatgaagggcacttcgcctgatgctgtaggatggcaagacagaggaagccatgcagaaaggtttgggcttcctcagggttccctgcgtggcaggaatgggtgctgggagggatggtagccgaggaggtcagcgcagtgaccctgagcagagctttgctgttgcacgggatgaggattgcattctgtagggcagcagctgtctccaaggctttgttaaggtggaaaacttctgtgatcagacggggatcattcagtccagggacaaacaggcccatagcaggtggcgagaccaaagccaggtagacagaggtgttgtgtttgtcactgagagccttcgaggaccatgtccaggcgtgatgtcaaggctggaagtgaaccagggggacctcaccctccttgtgacctgggagtatcatgaagggaaatgcaaagggcgttttcagaacgggatccagatgcagaagacgggagtgtgtgtgttttccacgtcttcttgctggtgcaggcggtggccctgcctggctggcaggtgctggcccctgctctctgtgcattctctcaccagggttctctctgcccacatcatccagagacccagacaggtggcctcactcacagatttccacctggagcgttaggcagggtccctgctggcagcagacctgcagatgacccaagtgtgcacctgtgctgtgtgctcacccaatggctgaagcaatatgaacctctttactttagtttttttatgatagaaaaaaaataacagtatcctctttaatggactgtaaatgccctttccaacatcactgctgtttcaagatggaggacatctgtatttgcttttgttgagtacttagtagcaattcacttaatacaaatgtgaaatacaaggttggtaacagaatctcccctgtgaatcaaaccattcattcaagtagcaatctgggcactgctgaattagacacacgcctcccccatgtggttgaagaggggacacagctgttctaccaggaggaggtcccaggcatcaggaggaaacagaagcatgccgcagggctctgggcatccctggagcacctgctgctgcggtctctagcagaaacgcaagttcaggggcagggctggagggctctctgttgcaccactgtcctgcctctttctttccacctagtcaggtcaaatcactttgcccaaagaagtttcagaaatatctgtaagacaacaacagaaactgtgagcactttctttcttgccggtgagatatttatttgaacatgttgctctgcagtgggcgaacccttcacggtgtctgcttccttttgtctgagatgctggggtgctgcagcagagatgcagagggcagtgcttcagcttgaggctggcatgtgtgggcagcacttttgcaggtgatgctgtttctgcaatagtgagtctgtcatcccaagcacagggattcattggaaccatctctgcatcctacaggattgtggacttatagggcaacagagaccccggagatccgagtccaaatgccctctcttcacttgccaaaagtctcatatttattaatcagaagaactagcactaagtccccgggctcgctcctgattttttactctgtttttgagtgggctctggtaagcccacatccacaggcattgctgaagatggaaagagggtatctatgatcagattaaggtatgttgagctgaagcatgttttcaaaatactaaaacttaaattttggaaacttagaactttaaaaagcaattaaggccgagtgcagtggctcacgcctgtaatcccagctacttgggaggttgaggcaggagaatcgcttgaacccagaaggtggaggttgcagtgagccaaaatcccgccactgcactccagcctggatgacaggagcagaactctgtctcaaaaataaaaaataaaaagcaatttaaattttgggggacgtttctatagaatctgttacacattttctggcttacttgcacaatctttttctgttaatgccagattgtctctgcaggtattgatggttgagctgatagctcagaggccaagaaagctccagtctgtcactccaagaccactgtgaccttgggcacgatacttaaagatcctaagttgaaggtggtgcaaaaactgactttctagcagggttgcctgataattgtagggcacttagcacaatgcctggcatttggcaagcctcccaaaacttgtaattatgttgatggtgatgacgatcagaatggcagtgccctcacgaattactggcgagggagactttatgtacttgtactgaaaggtgccagatttctggtctatgttcaacttgatgattatttcatttcttctcagtcaattctcagagttggtttatatccacttaaaaatgtttaaattgtgtctcccatccaagtactgaccctgcttagcttccaagatcagtcaagattggatgcattcagggtggcatggccgtaaatgaaattttttatcatggcaaaatatgcataacacagagtttactattgtaatcatttgtgagtgtacagttcagtggcattaagttcattcgcattgttgcgcaaccatcaccaccatccatctgtagaactgcttcctcttccctagctggatatctgctttttaagaagaatggagttagtgtgcccagagcagaagggtggatcgggggcctctacctttgtccatgctccagggggcaggttgacaagtctgactgatggataacttgggcatgacctcaaagctggtttggaatgagtcaggggtagacatgagtggatggagggataaatcaatgtatttcctaaatggggagtgttgctgtgttgcctgttgttagaaataagcaatgtaaacaggattttcctcatccagaaggtgtgctctggatatgaaatgctttttaaatgagaaactcaaagatggtctctgtattcgtttactggggcctcattgatgaaacaccgcagactgggctgcttaagcaacggaagtttattttctcacaggtctggaagctggacattcgggagtaaggggtcagcaggatggtttcttttgaggcctctttttttggcttctccctgtgtccttgcatgatctcccctctgtgtgtctttgcgtcctgattttccctttgtataaggccgccagtcatgtgggattagggtccaccctgatgacctcagtttaatttagttacctctttaaagacttcctctctaaataagggtacgttctgagctacgtggggttaggacttcaatatatgagttctagcggcggatgaggggctccagttcagcccatgccagtctctagagatccctccagttctaaaaatcctccaaatcctccccagttccagaaggatgcagaggaagccagccgtcccgtgcctgggacctcccctgtgcacactccccagggcatgggattgttggtagaacattacaaacacagctctgaagtcccagagacagaatgtcctactgtttctgagccatgtccatgacatttttcttagagagaaagaataataaacagagacaaaatattttaagtcctaccctcctcgtctgccaagaataatcctggtgttctctggaactcactgccttcatggccatcctgtactttgtatctgcaaatgtctgccctggaaaaagccatccactggtttcaagataatccacaggctttaaataaacacaagactccttgaaacagagccctgctctggaaatagagcgagaggccatttcagtccaaggagaagagagactgatggctaattacactccaagaagagccttttaaaatagcatttcaatttcagttattgaatcgagctacgattatctagcacacgccccttttaatgtacgctttacactgggaaacagtaggaactgagttttgagtaattacctttatggctgtattctatgcagggaaatgtgtggttgcggcagagccatagttaacctggggtggtgtcaacagtgtttatgccatttctataatttttaaccaccttcactttttgtatgtgtcattaaagatagttcaattttttaccatgttatgacacttgctagattaagtagaatgccaggcctgaccagagagctgataaaaaagaaatccactaattgtgctcgtttatactgaaggcttattccctccatttctctcccttcttcctccttccccccactcctaagcctttcttatgagccaggctctgttttatctatcaatggaaaaattctaaagacatttttgtggtgagttgtcagggtttttttttaattgagcagaatactaaagaagttgttggctcactcattggctatgtaaatctttttcatcaaagatccatgaagatcatgtagtgtacgttgaaaaaatagaatttattataagctcctgttttccaggtggaatttgcttccctaagtctgtagaaatgggcaagtgccgtgtgtcttaaaaaactcattcatccctttgcttcattgatggcctcctttgctttatcgcctgttctctcattttgcaatagagctgcagtcatttctgctcacttactaaccagtaaccagtaccggtcccccaattgtcactcgttataaaatgattaactgttatttattatacagtggagaaggcggtgctttggctttccagagagattcataggcagagttcttcccccgtgaaatgtgcctgccgcggatgcaagacagaaaagcgagtgccttttagaacggcgcagcctgagcccggatttctctaatgtctacgtgctgttattttaggtctccgaattcaatcctttgacgttcaccagcgtgatcgaatgcgagaagccaaacaacgacctgagtaggtttcgcggctgcatgtgagtatcgtgcgtctgcctgcgcgcatccttctgtttgataactacataggcaggtgtttacacattctcagttataaagtatgcatttaatactctttgccacatggtgtagctgtttgggaatgtggcccagcacctgagccttcttggctgcttttggaagtaagagcctgttgtcagtagtgggtaagagcctgttgtcagtagaagcttgccactaccatctgtgaggaggaggtaccgcttttcctcccgctagcaggccccgggtaggtgatgggtgtgacaagagatgtgtagctgaccacacatggccccgttaacatggaagcaggagtaggccgggtggagtttcatggatatatgcttccactcagtcactgaacacgtatttattgatacctgttacatgctgggtgcattcaaggcactggatgtaatgtggtaaactgaataaacagaagttcctgcctttgtgtttatttcattctagtttgggggaaagaaagacaattaaaacaaataagcataacctagagtgtgtctagtaggccagccccttcctgctccaaaacagaaagacaggtggatcagggcacaggcctggccctgtgttggcacttgctgaagccacgtgatggggagtagtagaaaccaccttcatgtctgtttgaaaatttccataataatcggagtgtgtgtgtgtgtgtggtcagtgctgtgggcaaaaacatggaagagaataggcagtgtcagaacggagttgctgagtggcctgccagggcccttggggatggtcttctggagaacaaggctgtgacaggggcatgacgcacatgaccttcctctgccctcaagctctgttccagctatcatgcctcagccacctcccgtgggctcagccctctcgcctgcagcacaaggggccacctcctggcactgtcctgcttggaggcagggatggacttttgacgcctgcagccgctgaatggcccaggcagtgggctcgcctgccccacccacttcccccacccccccacccccccgctcccaccacgcagacatacggaggcgtgggagcgatctgcttctggaagtggccccatttctaagagctttcggtgtaggttgagtcttctgttttgccagcacctccagcattactgcctgtgcccagcacacagtggcaggcggtagggctggggatgacccaacggaagtgaactctgcacagcaaaagctgaaatgtgtctgcagccaagtgatggccccgtcacccactggaattgcccttattatctgagaatcagacaccgatagcattaaatcaccccttaaataagccaattaaagcagggtaaaactcaacaacaaaatgtaagcatataacctctacgatttggggaggaaatactcagcacaacccgtgtgctgtggcttttctggtctttcttgactcctgggccatcttccccaggcctccttgatcccttgccccaagagtttgtgtgcagggcaccatcctcagcactgctgggaatccccaggcacgagttggctacagagagcaggtgctgggttgctagacatcttgacctgaaacaatgattgtgaagggtggggcgagggcaatctctggagaatgttcagtggtatccctggaataattttacagtgccaactccaccaaaaaacataaataaataaggggccgacttcctcttctgaagactgcactcctagctcattgtccttggtgtgacagggcggtgcctggcagtggagacacagcagggacagatacgaaggcctgcagcctgctggatccacagagcctaggaaaggtgacggccctctgctggggtggacgagaggggcggggtctggtgcaggagacgggaggagcattgtattgctcagccactgtctctagcagtgtggtgaggacaggagtctgggtggtgtctccaccccgcgctcagccccagcacctcactgcctcccacatgaggcccttgcctggctgtgtacccccaggcctggctgcactccccccgggtgccggggaagatgcctcttgagtgggtgtcatctgcctgcagccagccagccaggcccaccggggcttctccagcctgtgccgccaacaggcgttcctcgtgtggtgtcctcaccggcatgttgcccgagaaagggacatgagaagagcagctctcccagcatgaaatcctttcctgctttgccctcagtcatgtcgtgttgtctcctcgtgtactccacccatcgtccaaccctggtagcccccttgtggcctgggcacaggcaccatctgggccagtgtgcgcccagccaattcaggcctctccacacctgacgctctttaacgataattcgccatctccaccagccggggtgttctgggcttgccacagggctgtcagggcctggatggcccctctcccagccagacaggtcaggaggggcttctgggggtggagcagcagtgtgttaatacttccccccgtgactgtggggcacgaccaaggggagcagccctgccccggaccatcagcctgaaggggactggggcagcctcgcagtgaggaatactcccggggtaggagtgctccctggggctggagtgctccctcgggcatgaatcctccctcctgtagggcctggtaacgctatccgtcccaagcaaagagaaaggaggtcttaactccataccagtcctgatgcccagggcagggagctaagttgggaggtagatctgctgtctaggctcaggaagtggctcagctgcagagccacctccctggtttgcttcctcccactggcctccttgcagcctccatgaggcagctgctgccccgtaacctccttcacaccacagagcccaggaatgccggcagatttgcttcttttaggacctgccattccaaacttgaaacattaactgtttgcacttggagaacagaactgagtttgggtttgtagcaagaagacccaagtctgaatacaggctctttctcttccctgggaggtggccttaggaaagttattctgcctttctgagcccaggccttctcctaatcctggaggtatcatcgactgcctgtcaacctcacaggctgacatgagagtccagtgaaggaatgaaagtgaagtacaacatgaattagaaggtgtcgtggccgggcgcggtggctcacacctgtaatcccagcactttgggaggccggggcgggcagatcatgaggtcaggagatcgagaccatcctggctaacacggtgaaaccccgtctctactaaacatacaaaaaactagccaggtgtcttggagggcacctgtagtcccagctactcgggtggctgaggcaggagaatggcgtgaacccgggaggcgagcttgcagtgagccagaatcacaccactgcactccagcctgggtgacagagcgagactccatctcaaaaaaaaaaaaaaaaaaaaaaagaaggtgtcgcatgtgaaatgctcacagtaggaaaatcttagacacagaaagtggattggcagttgccagggtttgggggtgtggaatgagataggaatgggaagtgactgcccgtgggtctagggtttatttttagggtgatgaaaatgttctcgttagctgggtgtggaggtgcactcctatagtaccagctacctgggaggctgatgtgggaggatcacttgagcgggggaggcagagattgcagtgaaccgtgattgtgccattgtactccatcctgggagacagagcaagacccagtctcaaaaaaaagaaagaagaaaatgttctcatattagctggtggtggtagttttacaactctgatgatacaaatacaaacagaaaaaaaattagcctgtgcagtggctcatgcctgtaatcctttgggaggcctagatgggaggttcacttgaggttaggagtttaagagcagcctggacaatgtagtgagaccttgtctctacaaaaatcacacacacacacaaaaattagcctggtgtgggtgtggtggtgcacacctgtagtcacagaaactcaggaggttgaggtgggaggatggcttgagctcaggaggtccaggctgcagtgagctatgatcacaccactgcactccagcctggacaacagagcgagaccctatctgaaacaaaacaaaatacagaactctatgaactttaaatgagtgaacattatagtatgtgaaatatatctccagctggcagaaaaatagtgctaggagcctcattattcaagtgccctttaaggctgcattctttggaaggatcctcatatagttaagccctagcgaaatcttcagagttaggatctggaagtaacatcgttccccaccttctccagctgttcccagcactcactccttagccccaaccctgagatgtcatcgcccagagaggcctcctgggaatggaggcctggctcagcctgaccctgctgattgtgctcagccaactttatggcatgtggtcacctctgaagccacaaatcaatcaaacatttgcactttcccctaaagaataaagcaaagaggttggctggttagttggtcatccaatgtaaaattccatttcacattgtaaagcaggttccctagttctcttttccgatctgtcaatgtttgctttatatacttgggtgctttgatattggatgcatacatatttataattgttatgtcttcctgcataattgacccttctttgtcttgtaggatagtttttgacttagtctattttgtcggatacaagtatagccaaccctgttctcctttggtgaccattcttaccccacagagcaggcttctgacctggagagcctcctacaaccgcatagggccggcacgagcaccagctgcattttggagtaggctcttcgccctggtgggtgacacccttcagagacggtggttagtaaagacagcagggctgtcactaacaacagagctgtcagggtccctgccccctcctgcctggtgtctggttggagccttgtgtgggctgtatccaaaatgtctttactgccagtgaccaagcattaaataaactgcatcaactagactcattaaaactggaatgttttaatttcgccttgccacctttagttgacatatttatatcttaaaaatattgaacatcagcacaaaacagtctggtaatttccacacttacttttgttagatatgaacatctgatgattttatacagaaatatttatttatttttatttattatttatacaaaaatatgaacatctgattattttaaagcaaattctgcccaggatttgccaatggaaggaattatctgtcattccttcctcccaacttatgtcagtcaggacccacttaggaagccgactgaacaccctgattcatatagatgaggaaggatacttggtaagggtgcatctttgctaaggtgtttctgcaggagtgggtgggtgtaggggacgcatcggggacagagcagatgctagattagtggccgctgagcagtcactgccatgaggccccatggggaagagtggccctgggggactcatgaccagggagatgcctggggagactcatagccctggtcaggggacactgccagccagtgctgcctctctgggagggagcagggaataaactccctgtccttcttccttccttccttcctttctttctttttttttttgagacagagtctcactctgttgcccaggctgtagtgcagtggcgcgatcttggctcactgcaacctccacctcctgggttcaagtgattctcctgcctcagcctccctgagtagctgggattacaggtgtgtaccaccatgcctggctattttttttttttttttgtatttttagtagagacggggtttcgccatgttagccaggctggtctctaacttctggcctcaagcaatcctcccacctcggcctcccaaagtgctgggattacaggtgtgagccaccgcgcccagcctactccctgtcttttcttgctctcagccactcctccagtgtccttcctgtcatcccgcactggagggacccagctcaaagccaagggccgggcagccttcaacgtttgccaggctctgaggtaggcactggggtgtgcaatggataggacatgagcagctcctgtttggaagcagagacatggaagcagatggaatactgccggctggcctgggtggggggcctgggagtgtggcatggaggactgccctgaaggcggcagaagctgagcccaggccggaaggccgggctacctcaggcagaggctagcacagagtggacagaacatgctgtgtgggggtggctggggcagaaaaccacagaagccaccccttctgtgggccaagcaggggctgcagggtcggctggttcccacgtcaagctggagcaatgaggagtcctgcaggggacactcacaggcgtacactcgaagattgctccggtgcctgtgtgaggaacccacatgaggaacccaggccagtggagctgaggccagcaagcgtgtgttgccggctccagcagagaaatgcagacgcctgaatcagagcagtgctgcatggagatatacagaagagggcatggattaaagacacagccagggagatgaggttgaatggatgtaaaaatgggggaggagtcaaggacacctggtgacagggtttcaccatattgatcaggctggtctcgaactcctgacctcaagtgatccacctgccttggcctcccaaagtgctgggattacaggcgtgagccaccacgcctgtccaaaggacctcattttaacttaaggatctctttaaagactctgtctccaaatacagccatattctgcagtcctgggagttagggcttcaccagctgaattctgaggggacacggttcagcccatgacaacggagctgacggctcacgttcttgtgtgtgtctttgtggagttgagcctcgtgcctgtgtgcttctgggcctgtgtcaccctcggccgggcctctctctctcagaagcccaaggcagcctctagcccaggtaccaggcacctgatggtgatgtcgttctccagcctcccctttgtgttgtgggctgttcacgcaggagtacgttcccatcccctcgcattcgctcttccttctggcatggacctgtataggtcgatgcacctgtgtaaggtgccaagttgccgtctggcttggactcatcagaaatcacagtagttgctcaaaagtcagtgtcacaattaagaacatttaatgtagaacatttttcttgtttctataaagtttatcgtttgtccttaataagcataacctgaacttggagactatttgttattttctactgtcccagtgcaatggtgtctttgtctggctttcgctggagaagtccacgggagacacgtgatagggggtgtcctcactccacaagcgcagagcagggttttgtacctaaggatatctcatacctgccaggcttttgatgctgtggctggcaaagtggtttgccgtctcgaatctctctttaaaggaaaaccttactccgtcttggcattgccaagggagcagtagacacggcgttggctgaacggcccttgtgtggccccactgtgtctgctctggcgaagaacccttgctgttggtaaataactgacttgtggaaaatatatcctcccagcttgcatttcagccttgcctttactgtttagcttctcttcttcactaggacataggtttatttccctggtcagaaggctaatagttggcaggagggaaacccctgcaggggtccctggtgagacgctaagagccatacaggaagcatgtgggcttgagagtgtggggaatgcgtgcggagagggggtgtgggtgtgaaaaggtagcctctcggaaggcactcccttggtggccctgcctggcatgggttaggctgggcccctgctgttgttctggaaacctggaaccacagcaggcctgggttacagttccggttatgaggcctccccctgtgacctgtgctctggcccctggggccatatctgtcccagggcggtcctagcccaagactgcccagccagcctgggtcatcagtgggcccggaggacaagtttgaaaaccagtagcttaagcttagactatccctctggatctaaatagcagtaaaacagaatttatagaattgtttcatggaatttaccacatttcagaccacatatattaatacttctaataactttataacttcttgtaagagaaaaggatgttaaaaatgaaaccaatatcgtccccttttgtagaaagatgtttgtatttttatgacaacttgagactgattaggagtaacatttcctgtgttgagcaggagatgtacagagaccacgtagcaaggccttccttggccggttgggagtttgcccttcctagtggtgatcagtcccggagtgaaaacaagtctatctgcaaaacacataaacaccaggctctagagctgcttctggatgcctagtgactggtgaacagcagttctgtctcagctcttgcagagacccacagggcgagccacccactctcgggggccccctgtacccttcccagtccagatcccagcggccccaagctttcattgtgtcagggccttccttcctcaaggcattgcggctccagacatgaggcacaggcctgcaaccacgtgacatgtgccaactgtccctctacagcatacatgacaacgggaaaaaggccgggctgtataaagaaaacctgctgctgaggggctgcacccttaggaacacggacgcagtcgtcggcattgtcatctacgcaggtaggctcgggcacctggcaccacctgccgccagacagcgctgtgttctccagcacttcccctcactgttttcttttcttttttctttttcattttttttttttttgagacgagtctcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactaaaaacacacaaaaaataagctgggcgtggtggtgcacacctgtagtcccagctactagggaggccgaggcaggagaatctcttgaacctgagagacggaggttgcagtgagccgagtttataccactgcactccagcctggggccaacagagtaagactccatctcaaaaaaaaaaaagaaaaaaagcataacatatccccattgtagaacatttggaaactaggaaaatggaaaggagcaaaagcaaaaattctttgaatagtacctcaacccaaagccttctttcttggcacggtagtgtatttctttccatttcgttctccacagtcattatatatgtataagattaatttcattttattttatttattttcagacctgttcaacaggaagtaagattaattttaaaccctgcttttttgaccaagcttctcacctaagcaccactgaatggcagcatggaattccctccacgccatccatgcagctggtcccttagctccagtctctgacttgccatgtctctttgtcctccccgacaggacatgaaaccaaggctctgctgaacaacagtgggccccgctacaagcgcagcaagctggagaggcagatgaactgcgacgtgctctggtgtgtcctgctccttgtttgcatgtctctgttttcagcagtcggtaagtctcctagatggatcggaaatgagtgggggccaggcgcagtggctcgtgcccgtaatcctagcactttgggaggccgaggcgggcagatcacttgaggtcaggagttggtgaccagctggccaacatggtgaaatcccatctctactaaaaatacaaaaaaaatgtgcctgtagtcccagctactcgggagactgaggcaggagaatggcttgaacccgggagggggaggttgcagcgagctgagatcgcaccactgcactccagcctgggtgagagagtgagattctgtttccaaaaaaaaaaaaagaaagaaagaaatgagtgggctccaggtgagcttggtgggctgcccccagacatgcaaacctagcactcaaaaattaaaaccccagtttttcactgacttgaactcaagggcagcctgcatcagcacaggccacatggaaacgcctgggtgaatgggcatgacagagtatagctgtccttcggtatccatggggggttggttccaggactccccctctataacaaaatcttcagatgctcaagtccctgacatgaagtggaatagtattggcatataacctacctataccctcctctatactttaaatcagcagtccccaacctttttggcaccaaggactggttttatgaagacattttttccacggatgtaggggtagcagaggatatggtttagggatgaaactttcacctcagatcatcaggcaccagttagattctcatcaggagcgtgcaacctagatccctcccatgcacaattcacaatagggttcgtgctcctgtgagaattgaatgctgccgctgatctgacggaagacggggctcaggtgggaatgctcactcacctgccactcacctccagctgtgccgcccagttcctaacaggccatggaccagtaccagtctgcagcctggggattagggacccctgctttaaatcacctctaggttacttataatgcctaatacgatgtaaatgtcatgtaaataatggttatactgtgttgtttagggaatacacacagatataatttttttctcctaatatttttggtccatggttggttgaatccacggatatggaacccacagatactgagagctgactgtaatgttattttctgaactgacgatttcttagtggaagaatgctttcatcacagcggtggtggtaattccaggggaagaagtatcagtaacctggtgctaaactaaggctaatagcaggagaagcacagatgttactaatgggaacttcatgaaaagagaaacaaaaaatggctttggatcctaagaagggactagcagttaggttccatgtagggctacaccaagtgggtgtgatgtggtctcagcccagcggcataagttacagatgtacaggacatgaaaaaggcttctgtgaccagacaggtgtgggtccagtggattaggcaatgtgcactactgttggcttcccagagcctcccatatgtgaattgtgaatctcaggaaaggacaataatggcagtgtctgagcctactgactgtttttttgctgcgcatttcatgagacaggtatttcgtgagatgcgtgttaagaaattctgtcttggcgcctcacactgtcagctgccaacacgcgggtagctctgtgttgggacaagtggtgccacttagcaccaacaatgggaaactctcagtgtaaggaagagaccaggtcccacctccttcctgaagttggatcgaaggtgctgagaacattgtgttttcgctttctgacatggcaaagctgagtaagaaaaccaaatgtgcttgcatcaggtaacaaatattaaagttttgctttaatatacgctagcaatattcttatttttccattggatgaatgacatttctctttgaacattactacaggacatggactgtggatatggcggtatcaagagaagaagtcattattttatgtccccaagtctgatggaagctccttatccccagtcacagctgcagtttactcatttttaacaatgataatagttctgcaggtaacaatactaagtatcgtacaataattgctttacttttatgaagagaacttaaaatcatcatactctgttcagaatttcctataaattctgcatctaggaagatggcaaatatatctacctggagttctgccttttatttttcagcctaaatcaccaatgggatctttccttgggtgatttttaagttaaaattctccttttctgttcttaaggttcttgtgctttgagggtttggtttgggtcactgttttcattttgttgtttttcctttcagttacttttaaaaaaaatagattttattttgggataattttaaggtttacagaaaagttgcaaagtcattgcaacttttctgtaaatcttaaaattactccaaaataaaatttagttttctaaataaattttacagagagtttccatgcatccctcacccactttcccctaatgtgaacatattacattgtcatgggacattgtgaaaactaagaagccaactttagtccttcgctttgtttttttttctctttttctttttttttttagacagagtcttgttttgtcgccaggctggagtgcagtgacacgatcttggctcactgcaacctccacttcctgggttcaagcaattatcttgcctcagcctcccgagtagctgggattacaggtgcatgccacacaccttgctaatttttgtatttttggtagagatggggtttcaccatgttggccaggctggtcttgaactcctgacctcaagtgatccacccacctcggtctcccaaagtgctaggatgacaggcatgagccactgcacccggtctagtcctttgctttgaacaaaactatagccttctttcagatcccactagtccttccataaatgtgctttttcttctccaggatttagttgaggttatccacattgcatttatctgcacttgctattgttactattattattaattcgcatgcttccctgacacctcccagtcaatgcctggctatctatgcccagaaaggtctgtgaaagagtggggagggtcccagagtccagaggacgagggggcagtggggtcactaccaaccttcctgggaactgagtgaccagaggacattggctcagcctttgcctaggagggaacctttgctgtctcatatatgtgcttcatacaacaggaaacagtcttatttaactgtctaaattagttttctaaataaatgcaaattttgttctagcctcgagttaggactgtagctggtgtttgattaacgtacttcagttcccaggagtacccagttagtctgtgtgtgatattctgagtctgtaaacattagttcaatactgttactctacaaaaacaaatgagtaagcaaacattaatttcgaggagaattgttcttaaattatggaggcatcactgaatgtttttctcaaagcctctttccctttcctctgcattgtacaagaagagcacagaatcacaaggccagcatctgaaaaaagactgtctgttgtgtttgcactgccccctgaacttggggttgtatccctgggaaatgggagaccagggaaagcctgggggtcgaatgccaccacggagtgtggtgtgaggtgaccttgcttatgaggactgactgtgccatgattttttttctcttttctctctttcctgtcctagcctctctcaagcacaacttgcttgcttctatccaagccatgggtaccatacttccagacaccatagtggatccccgccctgcagctgctccataagctgtcctagtttattctctttgccaatactctaatacttttccaatactgactctaaaccaacctatttaagctctcttaaaggtacagtatagtccctactttcttgcggttgtagtcatttgttatttaaatagatttgagtaattccccagctccctggtcctcacggtcgttcatcctgtgtgccttgtctcttccaggttttgatcccaatttccttatacgtttccattgaaattgttaaagcatgccaagtgtacttcattaaccaggacatgcagttgtatgacgaagaaacagactcgcagctgcagtgccgagctctgaacatcacggaagacttaggacagatacagtacattttctcagataaaactggcactttgacagagaataagatggttttccgaagatgcactgtgtctggtgtagaatattctcatgatgcaaatggtgagtctgggggtgcggggctcccaacccaggctgaaccagaaagctgccctatccagaattgtttggagacacacacacacacacacacacacacacacacacacacgcttcagggattactgattttcaaggaagtataaagacgtggctgtcacagcagctcaggtgcctgaagcccagtgctatttatagaacaggcactggcacggccgcccgccctgttcctgcagtgtctggggtgccaggcatccgcctaagcaatcaggcaagccacccgcaaggagctcactcccaaggcatccagtccccttgctctgccacagcaagggacagagagatgtctctgttgtcatccatccattttctagtcataaaatcctcagaagggcactggctaattcatgtttcgttctcttccctggaacagtgttcctgggaactggaaagatgaatcgcctcactcccaattattgaagcggtccccactcccacctctcccttccttatctgtggctgcctccttccaacctggtgtctctggggagacaccagcttctgaatcccagggtgtgactgcagccagcgccccaccccagtcaggagagggcatggaccagggtccccgccaccactgtgcctggggctgcagcgccctgggagtgagcaccctgcactgcagcctggggtccatttcctgcctgtgacagaaacagagtccatgctacagaaacagcaaattaaaaccggacagagggaactcaagcgggcatgactaggaagctgctctttagaaggatttggtgggaagcatctgttgtttaccagacacttttgtgagatttataaaaccaaggattatcatgatagccacagtcttcctcaacacaaaatgaaagcagtcatagtaaacagaaggcagaggaaattacccactttgtttaaagttttatttgccacccaaaatagataatcatgacagtactccatccactcacccatcctccctcccaccagcctccttcggcctccctctcctctctttttcccttctcctaccctcctctcctctccctccttcctccccttcccctcccatagttgctaaacctggtacagcacagtgcattgtgctcttctcaaaaacagaactcagcagagtcctgaggggatcagagacccgggcagtcggttctacagcagcccttaaagccgagacccagtttcagatagacacgaggaataggttttgagatctgttgcacagccaggtgaccagaggcaataaaaatgtattacacatttcaaaacgactcagagagtaaattttaactgtctcatcataaaaacatgataggcaagcaaagtgacagatttgttaattagcatgatttaatcatgccacattgtacacatacatcagaacatcacattgcaccccatgaatgtatacagtactgatttatccattaataataataatacatttaaaagataataataaagttggaagcttaggctcccaggggcaggatcccaactaagattacagaaagattctgacagttgccaaatgctaccataaaaccagagggtttccttgcctcaagacacagggagcttcctggtgatgaatgaaaccacatacatctcagcagcgtgttttagagaagtgcctggatcagctagctattgacaggcacccaggcaaggagcgtcatcagccagttatcttatgatctgacctctccagatgtcactcataaaggagttcagatggactctgagccccaagccctgctcacgtaccagaaccggctgtggaagccttgggtgtgccccctctgacagcttggcaagatgacctggagctagctggctgtgcatgcccaggagggggcattacctgctcctgggcctcatctttcctggggacatggaaggcatcccaggggccactgccgatcagaaactgcttcagaacaccaacataccagccgtggcccccacagcctctgagggaaggagggggccctgaaggatggctccatggagctccggatgtgcgggaccactgctgggggagggtgggatgggccagtccactttcttggcagctgaagcccaccccctcacctcatgctggacagagtaatgtgtccacgttctgtgcgtccttgctttcggtgcactgggctgatgccacccgagagctggggaggcatttgcggggcatctgctcctggaattaggatctccctgagttggaatcctggcattggcaagtactcagccttgtgatggtgggcaggtgacttccccttttttatccccatttttctcatctctcacagagggtctattaagagatgcgcagtggtccacgcggctggccggctccataagtatctccttctccggcctcttgacaggcccctgctgctttgactcagcaccatgcctgtgcttgaagttctgattaaacggttgttctgataagtaatcctcatgaatggtctccattttgctcatccacggtgaaacaagctgtcctccctgggcaaaacccagaaaactggttcagagccatgggttagcaagaagccacagcgcaggcacctctaaaggggatttgcccagcgttcaccaggtcatggggaatttgctcagcagggcaacatcacagtcaagatcatcttggatggagtttcaaagctgagtccaaaccctagctgtaggggtccaagctgtgcagtctgggagtgtgagcccccctgtgccatagcatttcatccagacaggagcagatggtggccaccgtccatgtgggcaaggagctcagcaccaggtgagcaccgtcatcccagcatgactggaaggcctgccaccctctgtcctgcctccctctcccggccacctgccaccctaccccctgtacacctaggctctacctgaagagaccggctggacgtcaacccgttccccttcccctaagttgtgcgaccttagaaagctccttacgttctctgagatgaaagtcagtctctgtgaaacagagttgagaatatcaacctccccaggttgcagctgactgaggatgttctccgtgccttgctattagagagcaagggtggtgaatcctgtggggctgccctgccggaagcctcacggaacctaaaacacactgaatggtttctttccgctccgcccagccttcccccatgatgcctcaccctgcgccctctccccgcagcgcagcgtctggccaggtaccaagaggcagactcggaggaggaggaggtggtgcccagagggggctcggtgtcccagcgcggcagcatcggcagccaccagagtgtccgggtggtgcacagaacccagagcaccaagtcccaccggcgcacgggcagccgggccgaggccaagagggccagcatgctgtccaagcacacggccttcagcagccccatggtgagtgtacagggcctcctgctagggtgctgccacgtctcttccccattttcaccatcccccgctcatggaaggtgtctatatttaatcctacaaatacactgtcgctgggcggcttggctctactcagcagaagcttttctggccaacactttctctccactgtcgtcttttccaagacactgacatggcccctttgcatggcttctaaggctggttgattgctggcaagtcacccagaaagggtgacaaagaggaagcccgtgctgccaaatgaagcaaataaaacctcaggacaagatgacaaccgctaaaaagcaaagccaacccctcccaagggagttttaattagacgagcccaaatccataaaatactttctgcctggccttgtcagccgcccagacattaatggaccaccatcatccagcacggagaggcgcagaagtgagcaataacctctgaaagagcctttcacttctgaaatgttttaccaatgcagcagaggggatgaatcccccttgcttactctgtggtggcctcattctctcatgtgcttctaaacccacagagaagctgccatctaaatagggctgatttcgagttttggacgctgattggtgggtttctacagggcccctgggagtgggggctctcacgcttggcaggagggaggctgcactggaacaaggtttcctgacagcatttttcagtatgagtcaagagtatttaaagtattcaaactttctcgtctagcaatttagcgattcagccaaggattgctacatatggaagtttatcaatgtgtaatttacatcagcaaaactgaaagaaatttaaatatccagtgataaagggatggtcaaataaatgatgacatatccattttcaagttgttaaaatgtgtttttaaataattcttaaaagcctggaaaagttcagacaataatgttttggagaaaatggaaaccaccaatatgtatataaaatattttgattatgtgaaatttaaatgtagagcgaaaagactagagggcaatgctgaagcatggttttcacaaagtggatagaagctctgtatattttgtgcaattaaaattgtaagtaatttacaattataaaatgacatatatgtatatgagagatgaagttctgtttacagcttataataaaatcaaagtaccttaaatagtcacgccccaagatcctcggcaggctactgggtgggactcactgccagcctccctttctcccaggagaaggatatcacgcccgacccaaagctgctggagaaggtgagtgagtgtgacaagagcctagccgtggcgaggcatcaggagcacctgctggcccacctctcgcccgagctgtctgacgtctttgatttcttcatcgcactcaccatctgcaacacagtcgtcgtcacgtccccggatcagccacgaacaaaggcaagttctggagggtccctgagcttgaccttgaccttctgcgctgcgggccatggttgtcagtcctcctgagggcaggcgcccttccctttcctgcagcaagcgctcttggcacatcgtgacctaagggggatgcggtggggtgcttcatactgggcaaaacagtgcttgtggttctgcagcgttggccccaggctatagtgggcaggggctatgattggggccaagtgggagggggcagcccaccagagatgacttctgagcctgggaggggagggacacagggcagccagataggccagcctcaggtaggcaggtgggtgtgtggaggccctgcctgcctgggtccttccttcgctgcctggcctggggcagggccagagggaggctacccaggacaacctccccgagcctcagggtcccagatccacacaggagagaggacaagacaggccgggggcccagcttctgggacgaggagcttgcacatggaccctgactctaccagccatgcagctggagacacattggcctcctccctgtgcctggggtgcccgcctgggccgtggggccatggggaggatttatggggcatcgaagattgttcttcaatgaaaagcggtcgagaatcgatcagaggctacttaggacactggaaatatagcaatgctcaaattggttttggttcagtctgacattaaggttttctcctgagagaggaaaggttgcacgtgtgaaagctcctctatcacccagtgcaccccagaaagccctacagtgggctaggcagtgtagggggcacggaagcgtgatatgcatatggaaccaggcagttttgaatgttgaatggggtaggtgtgtgtcatagacctcccagcccccgactctcccaggatcccttcccagcctcctgggtctgcccttccagcaggtccctccgcaggcgatgtggggtgaacaaggtggcctgtattttctctgctgcagcagcatgtctggcagtacctggacccagtgactcccaagtggacaggcctgccactcagagaccagcaggcttgaggcttaggccggcagccctgggctggagctgcttcccgaagctgcagttcatctcctggctgcctcagcatctcccatctggcctctgggctctgcccccagcattaaaaacccttctggtgtatatccctgcaggaagtgccccttttctgggctagaccctgactgacagatgttaaatgaagggtgagagatggcagcgtcattgaggcttgtgctgaaggttacacggcttgagttccacctagggaacagcctatcaatcacccacactcaggctgcaggtgaagatgtctctgggtgcatttctattcccacatattggttggtgagcgccaccttcgaggacatttggagccagcagggattgctgtgcaggtgcctatgtctcccagctggctatgtagcgtatttaaagtcataacaagaccaaaggaaaagcacctgtatcaaaatctggctctatgcaccttgctttaccaaacacctgatttttctggaggctgttactgtaattcacaacttaggatgcaatggtaaaattgcagttttaagaattgctaattcagtattttggttgttttgacatttgctctttcaataaagagcaagaaaaaagcgtggctctgttgccctatcattgagctttttgaaactttaacaattgtgtgtgtgtgtgtgtgtgtgtgtgtgtgtgtgtgtatatgtgtcattcattttgtttcttactgtggtggttaaaatattgtttcaatgtttgggatcctcaatttgtcagtgtatttaatgcgcttagaaggattatttggggactggaaatgtgatttgtatattaaatttttatagacataattcaaaggaagtataaactgatggtttgttaagtgactttttaattggaaaaaaaatgcccagttttgtgccaggcaatggtgagcctgctcccctgagctgtttttttgcaaagcaaggggacactgtagtgcagggacagccccaaaagaagcctgcagatgccaccagctgcaactcccctgcatacatccaggcctcactgatgggccctcggcaatcacgttctgaaagaatcttgcataacctttgtttaagagaagtggaagaggccagcggacgatctcaaggaaggagtactgtctctgcttgcaatttctttttttattattattattatactttaagaagttttatgatacatgtgcacaacatgtttattgcgacactattctgcttgcaatttcaatgcatgcctgaaatctgggaaatgggaaatctgtgctctgagaccccagtggggaagcgaggtcattgttcctccaagtgcctggagcatcctgtgggaaccagggtggggcctctgggggacatagcagttccctcacctgccttctgaccatttctcttgcaggtgagggtgaggtttgagctgaagtccccggtgaagacgatagaagacttcctgcggaggttcacacccagctgcctgacctcaggctgcagcagcatcgggagcctggccgccaacaagtccagccacaagttgggctccagcttcccgtccaccccgtccagcgacggcatgcttctcaggctggaggagaggctgggccagcccacctcggccatcgccagcaacggctacagcagccaggcggacaactgggcctcggagcttgctcaggagcaggagtcagagcgcgagctgcggtacgaggcggagagcccggatgaggccgcactggtgtatgcggccagagcctacaactgcgtgcttgtggagcggctgcacgaccaagtgtcagtggagctgccccacctgggcaggctcaccttcgagctcctgcacacactgggtttcgattccgtccgcaagaggatgtcagtggtgatccggcacccgcttaccgatgagatcaacgtctacaccaagggggccgactcagtggtcatggatctcctgcagccctgctcttcaggtactcccacccctgcccagctgcaccccagctcgggggaggaggtcctgagaaatatccccacccaattccttctcttgagtaaagtgattttcattaatccttttccaacagaaatgcccattggagaattgcatggtttcttcagatcagtgtttgcctgtttgaagggtttggactaggaagtattcaggggacttccatgcctgcacacccccacctccaagaactggggggtcagaggatacttgaagagtgtcacgttttaaatttgaacaatgaaggttgagaatctagactagtagctctagaaagttcttcctgccctgtggacctggtgcagcagagagatccaggccacagtttatggggctgccttgggccacagtgggggcccaggaagtaagggatgctggcctcccccactgccctctgttctggcacttgggaggggaagggccgagcccccctcataaagggaacctggccacccacctctccctctgtgctcagaggacggaggagtgcagcctcacctccagggaactgaactgggtggaggtgaggatgctgcaggagcctaggggccctgctgaggctctactgcctgccacgggcttcctatttgctgcaccttggaagtacctctgggcagcagctgctgggaaatgctataagccggttgctcccttctggagctccgagttggagctagggagtactttacctcccactggcctttcttgccagcatctcagtgcctcaggagaggacccctggcacagaagcccaggaccactcatgatggagaattggatgggaggaagagcttcatacaggaaatccatgtccccatcacagagctgtgacctccaaaaggcagctgagctaaatctgcaaatgtgtctctgagaggagtttggatgaccttccatgatgatgaccaccgcggggcgagatcttccctttctcccactgcagtggctctgccttggagtcagcaaagaatccaattcatggacacagtttgagttctaggaagcttcttctgaaaatcgattcttgtttacatccacacaaaagaaaaacataaatagggcaattatctgagtgatttcattctacagcaaaaaaaaatctctctgtcttattccacagccttgggttcaagacaacataaggggtcctgggcttcagatttcacagcatgacgggtgatgtctaaggggaaggcatggagtggccctggcatgtgggggctgcccagcgctggcaggcgaggcctgtccagtcctgtagagcagggagccctgtgagctgtgcaaggaaggccgcagcacttgccgggcttgtctttgctggcaacatatttttttacatgagtaaaaacctcaaaagcagaacacacacaaaaagaactgctgtcactaagtctcactaataccatcagccatcatttcataaaagaaggaccacatttcacactccaccccgtcccccccaaaaaattaccaaggatatcccagaaaactggatgcctttcaattgaatgaatttagcgtcacgacctgctcactctcctactcctgcttttctggtaccttcccagagtggatagagcattatcaagaggcagggcccccctgcctgttcactagcaggtgccgagggccatggcaaaaggaacagtggtggcctggcctccagaggcccctgagtgagccagggatttcctcgtttgtctgcaagttgggaaggcacctgatgccggttacaagacaatccacaatgctctcctccgactcaaaatcaaactcacagtcggggtaggggagcccctgcccaggccggggagcctctcagacctggcatcgtcagcgtggctttgctctgggtctcaggaagggagcttcccataaccaggtaactgcagataagaaaaagaacctcaaatccatggcatcatggaagggccaggtaatgacattgtctcaactctcaccttatcaaaaccatgacattgataggaaaagttaatcaagggcttgtgttgatctccgccttcctctgggaatttccaagcagtgcatgaagtcagctttggatagggaagatctacgtgtcaacactgggcaggttaaggttcaggaagttcagagaccccagcagtttcccaagagaacgactacaggagggccctggagtcccctcgaagttacccacctgtgaccgcctgcccttatgcacagatcattcgccttttacttggggagcggtggaggggtgtggataggtgcagactcattgcagagggctcactgtgcctgggaatcgctctgcctgtgtaaatcaacttactacctgtgtgtaggtgacaaactgaggagggcacagaggtgtcccactccagacttaatctgatgctctcttcagagggctcgaaacactttcaccagaagaggcccgagttggctgagcagatagtggatgtgactgtatgatatcagcaggatggggccatggctcacctgccctggcaggtgtggtgtcaggcaacaagcagggactccaccccaacccattctcacagatctctgttcaaatcccaggtctacacttacggctgggatgaccctggacgagtcactcactctttctgtgcctcagtttcccatctacaaaggaaatcacagtgcctgcctctcacgggaagtccccacatgagcccctagctcagtgcctgctgttacattgatgtccagcgtccactcggtacctttcccaagtctctggctccttcttgttaagatccacttgcttatgctttggtggcgttgctacttggagtggtctttaaggtgtaaacctcaggccactctgccttctcccagagcaaggacagagagatggccgtagcccactgcctagcgtgggcctcacacattgataccatgcagtaatcagtatatgttttttgcatgatgagtacatgcatgtacaagcagggactgcacgttagtttaccattttaataagataactccttattggggaaatatcgcttgtaaagcttagaagaaatggaaatatcacttggagcaattttaaagcacgtggtaaaatcatgaagagaggctaccctcatccctctgagggcctctctgtgggtctgcaagcaccactcgccagctgtctcctggtgggaacatcaggtgcagcccactgtcaggtgcagctgtctcggccctgctgtgtctggggtcagtgggcactggagtcatcttcgcagactgcacctggagctgtgccccttagcctcctgctcctgccccgacccagatgcagcctcagcgtcctgcagcacagagctctcgactgtccctgcccagcagggggcgcagggcagcactggtcccactccctcaggtggtgtcactcctcacccgaggagctgagttccaggcacagaattcctcctgtcaccatagggagacaagacacacaggacttgggtggctgtggaacatcagaaagaaggggctaatattgcatgaccgttgcctaaaatgcagtgtgaaaattgccatgccttcagctcgaaatcagccacccccagcatcacttcagcaagtggagaagagcagggctgactgaatgcctctagggatccacactctgttccccagtacattctccttcggaggttcccccagctcctcggtgatggtctccttggagcttgagttcttcccatcctctcctaccccccatcagagtgtagaccgattccagcctccacaagggccccaccctccaaagcccagcctcggtattccgcagtgactgcccagtggtaggtgcggcaggacatgtaagggaaaagtcacccaagaacgaggggcagatctcgccagaaggggcacaggtgtgtgtccatgtctgcaggagaggacaacgggctcagccacttctgcctggcagggccaggtgctccctgtcactaggctctgtgcagatggccctgcaaagaaacaccccattgtccacctgagaagcagacacctgtggggccgtctcctcgtctggggcacccagggtcccgagtggcccatcctccctccctgggctcggttcattttgttttggagagtggttaatctcagtgtcacacccggtaccaccgcacgtcccagtgcacgccacatgtcacctctcaggacaatgggacagctttatcaagagtatttcaattccaaaacccctcagttaggcacggctttgctcgaggaacaatctgattctgggaaaaggttatctgcatcttctaagagtgttaccacgataccaggaatacaaagatgagtttgagcatcatcctttcgggaaatgtaaatacctaaagcaaaggattctagggcaactgtttttcttccccattatcaactccataaagagtcttttctgacttctttttcaattgtcccctcctggccttttaataacatagatatgctgtgtatctgtttatgttctatatgtgtacttagactttgtttagaaaagagtaagatttttccacctccaagaaccagtgatcactcccttgagggctctgtcacccctgtggagaatgcagcacggtcaggcatgtaaaagggtctcttaccgggtcctctttcaggtggtggacttagattagtagataatccttcctgggccacgggcctcatgactggtcagtagtgttgccagatttcacaaactgtatatatagaatgtccagttaaacttgaatttcagacaaacaaatccttttttaagtaaaagtatgtcctatgccatttttagacatcgtttgttgtatctggcaatgctacttgtaaggatcctactcttctgaggatagaaagtgcacttcccattaagtaagaattttcattaacaggaagaacgtgagcctccatttaataggctgggcaaaaggatgccaaatgacttttgatgtagtttttattttcatgagcttatttcaacaaaggatgttaaaaacagccaaacatcagcagggcgcagtggctcacatctgtaatcccagtactttcggaggccgaggcgggtggatgatttgagtccaggagttcgtgaccagcctgggcaacgtggcaaaaccctgtctctataaaaaaataaaataaaacagtcaaacatttgcatattgatgagactcttttttaaaacataacagctcatttttgctttgaattctatatgaaaatttgtgctctattcgcaagtaacgaacagacgtggggtaaatctcggagtgtctgaagaccattccacaggcgccagttcttacccatgtttctgcttattctccaacctagttgacgccagagggaggcatcaaaaaaagattcggagcaaaactcagaattacctcaacgtgtatgcggcggaaggcctgcgcaccttgtgcatcgccaagagagtgagtgggggtgtctccgcgagggtgcacgtgcaggtggccgccccacagtgagcagcgcccggtgcagcactcaacaatgtatctcccataggttctgagtaaagaagagtatgcctgctggttgcaaagccacctagaagccgaatcctccctggaaaacagcgaggagctcctcttccagtctgccattcgcctggagaccaacctgcacttgttaggtaattaacttgagagtcgcatgcctaagggcagtgtggagtttgcagggacggccctggaggggtgagtgctcttgtcagcggctgctccgcaggctggccttggttagggagccacctggcaggacgctggcacagccgaggcgggagggtgcttgcctgaatcttctcctagtctcatttctgtgaggtgcacgtgctgccccccaggcaccccaagacagcagctgccatgcttccccttaacctggtttcccaccaaaaatagagccaaggagtgagatttctgacagttgggagttgaaaggattttcccctcgggaaacagggaaacttttgggacccagaaactgctgcattttgcatcttaggaatgtttcacagattcgaggtgaatgaaaagaaaatgggctcatttttactgaaatatgtccacatttccagctgtgttcatcttggtacttaataaatgctaactagtattagtgataaatgaaggtatttattatgttaatgcttactttaatacttaaaatatttattttcctatttattaaagcattcattaaatagccaagtcattgtatacatgctctgtgtgtccttgaagagctggtgttgaggatggtccacccccacctccatctcgggtgctgtgagtcaggtggtacttctcgagcacaaagccctgggcaggtcatcttcacttaacacaaaaaggcggtgttcacttgccctctttttctgggcagaggagttgggatagctatatatttacatctacatttctagtataatacatagttaaggtttgcatttaatagcataatgtacactaggcataacatatatctgcacacattttatatattgtttgcccacagaatcttataggaggccacgcattacttggaaagccccgggatccaggggcccagtggcaccatgagtggcagccctggatgtgaattaaatggaacacctgagaaatggctgtgcctgttttaggccctgaagttttggcttactaaagcagggctgctgtcgtctggactgattgggcttccccggaagacagtattgtgcaggcctgtggggtaggaggcatctgctggttgtcccagacgtgcccgcccagcctcattgaccaggcttgtttttaacccttcactgtggggcaccttccccagggagcagcttttcccctggacagcactaacttctcaaatggagtgaaattggccctccggtgccatttcacagtgcttgctggttccgccccctggagtaatgcagacagaatctcctcccttttccacatgatgaaaccttgactatttggggacatggctgtgagtcccaggctgccccttctccatcttccctgctctcagagcccagaagccctgactcagttgtccagccctgctctgccactgcaagctggtcatgcgggctggtcatgcaggctgatcggacagcctggggcaagtggctcaatcctttttgcatccaagttctgctctgtggtaatcccagtgtttcgggctcttgtgagggtgaaaggaagggatgacggggggcactgagcgtggcgcaggcacagggcctggcactgagcggttgtgtggtgagtctcctggttggtgcttccacaccgtttccacccagctggcctctcctctgcaggctttctctggtgatcgtgcatcggtcacctctcttggcccggatgctgcagctctgttaacatatcctaagttgttaacggcccctgcggcacccgaggctcatggttaacttgagttccagtcatcttcttaggcctttttcacagggattccttgcttggattctataatttttacttgggcaactgtgtgaagatctaaaatcagagttgtctaccgatcccctgttccacttcctctgattggagtcgggatcccggtcatcagcgtttctccaaactgattccaccacatcccgctgtcatcctcaggtggattccttccctccaggtgcacgtgaggatggctctgagatgtgtcagcgatggaactcctgggttgcccacatgggtgccagccgtgcactggagcctgctcacgcctcctggcagagctcatggatacattttgaagaattttgcagtagcccacataaatgttcaggaatctcacgtcgccttttgatgctatgttagtagattgaagtcagccaaggtgggagtatttataccacagaaatgagcaaatgcagtaaatcgaccttcctcccacagaccggttgttaaccacttaccatctcctgctacctgatatgtttatgtttcaaatgacgaggcctgagctggagagtatgggagccacccaccaccttagcgttcacatggctcaaacgcgggcactgtgttccagctcctcagcttcattaagaaaagtgaagccagccacttatatttttactattccaaagccaaatcttttcatgaaggtgctttttttttgttttttttttttgtctttgagacagagtctcactctgtcacctgggctggagtgcaatggtgcgatcacagcacattgtgagctcaaatttctgggctctagtgatcctcccgcctcagcctcctgagtagctgggaccacaggcgtgtgccaccaggcccagataaatttttacttttttttggtagagacagggtctcactcaggcttgtctcaaactcctggtttaacgtgatcctcctgcctcagtctgtctaagtgctgggattacaggcgtgtgcccctgcaccaggcccaggtgcttatcttaaatagcatcagagaaccatacataactatcttcagcagaaaggatctccgttctctccatgctcttgaaattttcttttccttaatgctctgggcaggaacctaaattcaaaggatactcttgctcattttccccggcgtccttgctagtttctctaaatgtctaaaacttcctcgttggtgaaatcctttcccctcccattcaaagctgtgtggcaccaagcacagtgacgctgggctctgcacaccaccaactcctgagttatgatactcagaaatgccaggccttccagagggtcaggtcgtaaagacagtggcatttactcagagtcacataaattatatcacaaacaagtaccttggaaagctgaagaaagccgctgtgccccaaatcatcttgaaaggctgctgcctgcaggtactctttcctctgccatgtttcatgccgaggtgggggtccctcccataactcctttttcagttcaatgctattctgcacctgactcaggctcacaccttataaaggtgagtgttggtggggtgacccagtgggaggcccatgagtttgaccaaatagctcctgaactaaggaggttctgttttcaaggtgttaacttttccctgtgaaacagcagacaccctccgtactggagtttccggcaaggccttccctgctttctttcttggcagacatttgactgagggactttagctcagcagctgggatacaaaggtgggaggcacaaggtccttgaggcaggaagttgccatttagagaagagtgggcaactgcttgggttatgtttcaagcactgtagtggaagcgttatcctggcaaattgtcagtaatccatcaaggttagccattattagtcttactctataatcattattactatcattaagtatgaatgaattactatgaacacacagaggaaggcaagaccatccctgtcttccccagacatcaaggaacctgtcatagtacaagtgacactcaggatgagccagggacacgggccacacacagtctgcccccctactagagcccaagggccagggtagaggagcaaagctaaggtcagatgccctcccggtgcccgggtggctggggatgtgctcacggggagcacagagcgtgacctggctttcttcctgagcaggtcttaagctccacacgctgtgtggtcttcccagggtactcaggttataaggttcagagcagtgtgcagcatgggtgcaatgttccctcctcctttctgggccctccccaagttcccacatcaccttccagtacatccccgacatgggagctaggcccaggctacctgagctggaagacagcagatcagccacttgcccctgagggggtcttctggggtgctggtgatgttctgccccctaagttcagggctggtgacactggtatgtgacttgtgaaagtgtatcaaaggaatatttaagaaatgtacacttgtgtgtttactgtacctcagttctaccttcccctccccatgcctgccatcccatcattctagaagaaggggtaagggtggcttagttcgtttgttctgctgtcacacaataccacagactggggacttaagccacagacatttacttcttagagttttgaaggctaaaagtccaagatcaaggctctaacagctcacaatgtctggtgtgggatctcctcctggtttgcagatggctgcctccttgcagtgttctcacacaatggggagattgagaaatcacctttccaatgcctatttatttatttatttcttgagacagagtctcgctctgtcacccaggctggagtgcagtggcatgatctcagctcactgcaacctccacctcctgggttcaagcaattctgcctcaacctcccgagcagctgggattacaggcacccactaccacgcccaggtaatttttgtatttttagtagaaacagggtttcaccacattgaccaggttggtctggaactcctgacctcaagtgacccgcccgccacggcctcccgaagtgctgggattacaggcgtgagccaccgcgcccgaccccagtgcctctttttataaggacactgatcccatcgcgggagccccatcctcatgacctcatctgaacttaattacctcctgcaggccccacatcctaatactaccacactggggattagtgctccctcctatggatctgggggacacaaacgctcagtccatagcagcatcccagcacagggcacagcatggtgtagcgcagtaaaggagcctcagtcagggctcgaacctagggaccagggctgcagctcacttccagagtggggaagacagaaaccatctcaccaagatgtaaacagatcttaaaaaaaaaaaaaaaaatctgaggcaggcctaagcacatttccgcagtcaatagtagatttttcccaacatactgagaccaaaaaggcaaaacctgcctctcaacttctttatgtttgtggaaaaagcatatttaggataatcttggtttcaagaaataatggccttacctgtgaagtctgtttctatagtgactagtaataagcattgttgagactggacattctgaatttcattcaccagaagctttctatgggatgggcaatttttaagactatatttttatccctccgaatatcgtcattcccaacaccttcccatacgctttgccttcaggttatctgtaaagttacaagttagaaagaagttgaggtactttggtgtaagtacacataattatgctcagtgactcacagttattcctacgcactcgactgagtcacatcgacagagctgtcaaaagcgtccaccactgtcctgaaatggttccacaggggacttcctgtcactacatggcagacaactggcagcccagcccctggcaaggcccaggcaacaggggctgtaccagtgcctgccttcggtgtatctggtgcatgacatttgcaccccagaaggattggggggcacgtgagaagcgggttcgctcacactgctgtgcatttgaccaggtgccactgggattgaagaccgcctgcaggacggagtccctgaaactatttctaaattgcgtcaagcgggcctgcagatttgggttctcactggtgacaaacaagaaacagctgtcaacattgcatatgcctgcaaactgctggaccacgacgaggaggtcatcaccctgaatgccacctcccaggtaggtgggtttcaagtggctccgcttccttcccctggggtggtccatgtttatcgtggcccccttggcagacactcacattcctggcagctgctgtgagaaggacctcaccctccgcattcgggtttaggatgtgcatgttattgccttggaagaggtaaagtttgctggaatttcttagtaccaaaggaatgcatgtctgggctttattgatacaaagttcagcctggtttctcctgacatactgtccaagtcatcaaagaactttctcgtgaggtcccctgtgcttccacagtggagccagggcagtggtccatttagcactgaccacctcaggatcattgcaggcactgaggacttctttatccagttggatttgtctgtttaaatccccaagtctgtggcgagtagctacttcatatactgccctggtctgggctctgagtcctcgcagaagttcccactcaaaacttcttgcgccggctttcaggcttcttgaatggagcagggaactgtcttgctgtggctgatctgctcctccccagtgtggccaaagccaccacagcctctctggggctcacactcagactccccaccccagcccctcttaggtccacacctgcaccatcagctatcaggaccttgggactttgtcgcttgggagtccccctttctgagatggccttggtgggagcattcctgctctgtgagttattgcagcagcccccactcatctcctggcctctaggacctctcactccatctgtaagcgtaggaaaggctgcctttcaagccccgttgtccacattgtacagacgccattgtgaccctcgcaccttgttccattggattctatgatccagattcccaccattcccagtcctttcttcacagccacgctggccggggcacccccttcctctcacatctatgcaaggtcaccctgcttcagagcctgtgccttcaccagggccttttttttttttaagtgacctctttctccaagaaagtttgcgaatttatactaaaggttgacctgatgacctggtcattgcttttatttatttatctataattagcatatagtaaaattggctctttttttggttatacacttacatgaattttaacacgtgcatagatctgtatatgtatatacaccaccctatccacggtccaggagagttccatcatccccagaaagtctgccatgctacccccgtgcaattgtaacttccctccttttctaacctctggaagccaccaatctgttctccagaactacagttttgtcttttccagatgtcaagtaaacagaatactccagtgtgtaactttcagagcctggcttctgtcactcagcataacacttttgagattcacctgagctgttgcatgaaccagtagtatatttctccttgatgctgagtaatatccactaacaccagattttgcatatccattcaatcagtgaagaacattttagttgtttctggttgttgacaatcataaacagcacttctataaatgtgtgtatacaggtttttgtgtgaacatgttttcatttctttaaatacctaggttagatgtgaatgtgtctaagtttataagaagctgccagacaccagcctgcttttcaaagtgctgtattactttgctcagtgtcttttccagcacttcgcattgtcattgattttttttctgctagcccctctaatgggtgtgtagtggtatcttgttatggttttaatttgcatttcactagtgtctaatgaagttgaacatctttccatgtgcttattttccattcaaatatcctcttggatgaattgtcaagtatttttccattttctaattgagttgttttcttaatgttcagttttgagaattctttatgttttctgtatgtaagtcctttgttggctatgtgatttgcatatatttcatccctatcttctttattttttaatattgtctttcacaaaagcttttagttttgataaatttttattcttgttaaatttttattttattattttatctttttggagatgaggtctcactctgttatccaggctggagtgcagtggtgccatcgcaactcattacagcctcaacctcccaggctcaagggatcctcctgcctcagcatccctagtacctgggaccacaggagcgcacaagcatacctggctaattttttatttttttaagagatgggatgccccagcgttgcccaggctggtgtcaaaatcctgaactcaagtgattgtcctgcctcggcctctcaaagtgctgagattatagacttgagccactgtgcctggtctgattggtcattttttttaaattttatgtatcatgcatttggtgtcatgtctaagatgtgcctaattatgaatattttctcctgtgttttattctaaaagcattacacgttaacatcttatctatagatacagtccattttgggtcacatttcatgaaaggtgtgagggttaggttagacttcatctttccacatgtggctgcccagttcctccagtgccatttgttgaaagcgtcttcttttggttgaaagcgtctttgtcaaaaatcagttagttacatttgtgtgggtctgtttctagactttctgttctgttccattcatttgtttgtctatcccttcaccaatacgacgtgtattgattcattgtagtagtttgattactgtagttttttataagtcttaaaaattggtagtgttattcctccaactttattctatttcaaaattgttttggctagtcttcttatttgttgccttcgtatatgaattttaaattaatttttctgttcagaaattcctgctggagcttttatttgaattttgttaaatttataaatcagtttgggaagcattgatatttttattatgttgatcttccactctgtaaacatggtatatctctacattttttaggtcttcttttatttcttttatcagcattttatagttttcagcatacacatcatatacatgttttgttagatacatacccaagcactgatgctcctcaacttatgatggggttatgtcccaataaacctatcataggtcaaaaaaatcataagttgaaaatgtatttaataccccaaaagacccatccaaaagttgaaaatttgtaaattgaaccattgtaagtcagggaccatctgtacaacattttttgtaggttttgtaagtagtatttttaaatttttattttccatcagtttatagtacagttgacccttgaacacgtaggggttagggataccaatccctccatgtagtcaaaaatccacatataacttttgactctccaaaaacttgactattcatagcctactgttgaccagaagccttactgataacaaatagtcaattaccacctattctgtatattgtatgtattatatgctgtattcttacaataaagtaagctagagaaaagaaaatgttatcaagaaaatcttaaggaagagaaaatatatttactattcattaagtgaaagcggatcttcactgactctttccttggtcgtgtctattctcccattgagcccatccagagagttttcaaaaataaactttatatatagaattgtttcaaatttagagaaaaactgtgaggatagtacagacttatttctcatgtatgccatacataatttattgttactgatcttacattagcctagtacatttatcacattaaggagccaatgttgatacatcattactttctgaagttcatacattgccttagtttttacctagtgtcctttttttgttctgggatcccatccagaacactacattacattttgtcatcatgcctccttacactcttcttggctgtgacacttcggtaaactttctttatttttaatcattttgaccattttgaagagtgctggccaggtattttgtagaatgcccttatattgggatttgtctgatgtttttcttatcactaaagtggagctaagggttttagggaggacagccacagaggtcaagtgccattttcatcatatcctatcaagggtacatgctgtcaacaccatgtcactgttggggttgacctttcagtcactgtactctttgcctcttcccatactgaattcttccgaaggaagtcactgtgcacagctcacagttaaggagtgtggagttatagttttctccttgagggcagagtatctacatagatgatttagaatccagtgagctttttatttcagttaatgtatttctgtcacaaatttctatttggttctctgaaatatcttccttctttttggccaagactgtctgtctctctgttcatttccagcatgttcaatcttacttcttggaacttttggataatggctgttttcgtctttctttgtcgataatgtcagtatctgtgtcatcttgacattggcttctgtggattgtctttttccacagagttaagattttcctggttctttgtatgctaagaagttttggattgtatcatgggcatttcgaatattatgttatgacactggccatttttaatttctatggagaatgtggattttttttaagcaggtgatcaaccctgtggggtttgggctgtgagctctgggtgttggtttcaaaggcagatgtgtttataagacctagtcttgcatttttgccctccagaggtcaccttggaacttgggtggcagtctgttgcagagtttgcctctcaaaggctttgttatgggtgagcccaggaattcattaacaacattatggggtcagttagccaagcttctctttacaatttttccagcgcctctggttccccaagaatccccttttcagtcttctggcaggaaagctggagtgtgtcaccttcttcttcccatatttcctgcccttctcctgcatccagcgccaagtgggggcagaatagaagacagagcaccacaggctctgttggaaaggagggtctagctcccttggagtctgcggcagcagacatttctgccactgccattcctgcatagccacggtagcagaattgcctgggactgagttcaaaataatagacgaaaaagaataaataaaattggagacttcctcatcttctcagagcactgggaacccccttttcactcctcaagccagagctagaaggtatctcctggagctctctctgtcattgccttggagcccacgtccaggttccctggtgccttgggctaagccaggggctaccagagtgacagtgacatacccaccacccattcagtgtccttagcacacttgtctcctctcccggtccatcggctgctactccctctcagagctctgcagtaatgagcctatgcgtcctgcccaagtgccgcctgaagtcagtgggagcaacgggatgaaggaggagtctccactgctgtgggagtccagggagctcatggagttcctgtgatggcatcctgcattctcctcaaggccttccccagttactgccatatcccaccccatgccctggaagcaaagctctccctctcctatccatctccacactttcgcacatcctggttggtgatttgctgcagccatgagtgtgtgtgcatcagctgtctgttccccctacggcagtaactgtgtcttttcagtcttcttttctctagtctggcttcattttctgaatacaaaggatcctcagtaagcgtgtgttgaacacagctggatttccgtggtgtgttgcagggcactggtcactgacccagcagactcacggtctgcggaggatcaggagctgcccaggctccccggagcgtgtttgttcctggagacggtggtccctcctgtgcctccagctcctgcccctgatccctagtgctgctaccaccgtaggttttcctcctttctctggaatccagatcaagttttgcctattaaaagcctccgtaattgtgcttttttttttttcttttcctggcagaattggagaacttagggaggatactgaaaattgcatttctttaggggctaatcataacaaagccttttgcagagctttgtgtcctgcagttagtccttggggggttaggtaagggcctctgagaactatcaagaagtacatggagggccttcagtctaactatccagcaatttcacaataatacagtatggcctcccaaagtgaagatggtccattccaacctctgcactgtatcatgggtgatcaagtaagatcttagagaaacctagaccagttcagtctcttttttttgagacagagtctcgctctgtcgcctaggctggagtgcagtggcatgatcttggctcactgcaagctccgcctcccaggttcatgccattctcctgcctcagcctcccgagtagctgggactacaggcacccaccaccacgcctggctaatttttttgtatttttagtagagacggggtttcaccgtgttagccaggatggtcttgatctcctgacctcgtgatccacccgcctcggcctcccaaagtgctgggattacaggagtgagccacccacggtgcctggccaccaattcagtctcttctctggggaaagtcatcctctccggctgaacttcacagtttctggagggtggcctctgggcaggcgggtactgcagcctggagcccggaaggatgtcagctccagaggtgttgagccagggcggggatgtttgtggcatgactctgagggaactgcgctgtcctctcatgtccctttcaggaggcgtgtgcagccctgctagaccagtgcctatgctacgtgcagtccagaggcctccagagagcccctgagaagaccaagggcaaagtgagcatgaggttctcctctctctgcccaccctccacgtccactgcctctggccgcagacccagcctcgtgatcgatgggagaagcctggcctacgctctcgagaaaaacctggaggacaaattcctcttccttgccaagcagtgccgctccgtcctctgctgtcggtcgacgcctctgcagaagagcatggtggtgaagctggtgcggagcaagctcaaggccatgaccctggccataggcaagtatcccagctggccagacggcctcctcccagctggacccaaacttcctctacccttccatgctacaccacgagatgggaaaacacttcctcacctttctttctgtgtgtaaaatcacacccagtgtgatagagcaggcaacatgttccgaaggtaaagtttacattggaaagccacaaaagagagtagcagagttacaggttcatgctgcaaggtcagtaatccggtgctgctttacggcaacaagatggagcttaccctgtttctcaggagacaggacacaagagacctgcctgtcccagtctgtcctggccacagcagagggcactacacactcagccttagcccaggccaacttagaaggtcctttgcagctgcttctggtcaccatgagcctccgggtgtccaaggctttgtaacgccctaagggcccagaggcttggtgaccagaattcccactgcctcctgtcagctgtgctgatggttctgggacaggcttctgagtaaataagtccatcatcagatacgcatcactgctcagttttacaccagttatttaaggactgtgtttctcatggtggtttttcctggcagacactgttggcctggagagccctgtctgctcctctccagggaggggatggtggccactcgcctccttccaggacatcctctctgcccacttctagtgcaggcagagtctctagcacaggttcaggggctcagcagcaccacctcctggtgagggccaggaaggaagcagtggccgtgacccccacatgccaacaattgggcctccctgtaaatagaatctactcctaggtgagaactggatcagaaatcaagtaccctcgccaatcaatcagccagtgttggcagtattttctgcaaaaggtctgtgacagcccctgcttgttgacatggagattgctgcctgttcacagtgggcacctcacctggccagaggagaccgctgttgagcctgggttacagtggcagtgaggagagcgagcactggcctgaacacggtcgtcatggggaccctgccctacacaccctgaggccagtaaccgctaaggagagtgggcacagggcacgtgttcaggaggcccggggaacctaacagccatggcctgtcctgaggccatctttgccttcatgtgcctggggtggccctcaggtttccctgaggagctggaaacggtcttcaggctgacctgcaccacccctgtcccagcctcctcctctgagcgtcagtgtcctccctgggagcacgaggacaacgtcagccctgaaaggccacagtacacagtaagacgtgaatgatgtttccctggcctggccagtgcctggctcagccgcgtagccactggtgtctggtattcctgaagaagtggaaggaaatccttggcagattaaaaagaaaaggaaacacagaatggaatctcaaaagaaaacgggaaagtaatgacccataagaacatcagcacatggctgggcacgtggttcacaccagtcatctcaacagtttgggaggccaaggcaggaagatcacttgagcccgggagtttgagaccagcctgggcaacatagtgagtccccatctctacaaaaaataaaaaaaattagctgtgtgtggtggcgcacacctgcagtctcagctacttgagaggctgaggtgggaggctcacctgagcccaggaggtcaaggctgcagtgaaccgtgatcacaccactacactccagcctaggcaatagagtgagagaccctgtctcaaaaaaagaaaaaaaaaactgctggggcaacatggtgggcgaaaccccatctgtactaaaaatgcaaaacctggctgggtgtggtggcatgtacctgtagtcctacctactcaggaggctgaagtgggaggatcacttgagcccaggaggttgaggctgcagtgagccatgatcatgccactgcactcccacctagcctgggtgacagagtgagaccctgtctcaaaagaaaaagaaagaaagaaagaatgcgttaaagcatcaatgtgacctactcctagtgcccagtggtttataatgtagagagcatcgttgcataccatatctcatgttttaccgtatctcattttaaatgggacattctggggaaagctgtacagatttttattgcttcagagaattccaatttgatatatattaactgatcagttaatattggtctcaacattataaagaacaggaaaatcacagggaagagacatcctgtagtcacactacaagtcattctaactttgtgtatctgcaccttttctcatttgtgcaacttgggatgtatgccctgatttgggctcttctgctgcccagttccaagaatggtgaccgtcacggagtgataacaactttatgactctgctgtcctttccccgaaggtgtccagatatctgaccatgctctgtgttcctaaacattttctatcaacaaattgacagaatgaagagaagttctcctttattgcacccctagagggccccaaagtgagcacaatggctaatactgtggcaatccatatgcaaaaaaaagagctccacaacgtgctgggctgaatttaacctccttcccttagtttagaaactgcccgggaagtgtggctgggagtagccttggctgcttggctggagtggttcagtaactaatgatgatgaagatgatgatagcatctttccttgtgccagacagcaggatgagggttttactggtgtaagagcggcactgcagagcaggcgccatgtaccaggtggctcagctccagcccgatttccgaaacatctcctggtgtcgctagcttattctgaatgcttaactctattctcccagggtggatgctctactcctttttcccccatcttccccaggacgctttcacaggactgcgttcagcggggactcccaagaaaatctaacacattgatttgattctgtgctgtttctagaatcaaacaattcttcttgcctgtgctgtttctaggtgatggagccaatgatgtcagcatgatccaggtggcagatgtgggtgtgggaatctccggccaggagggtatgcaggtaaagaccaatcaggctattctgtgtgaccaattggccctactgacctcttgtcctgtcaccctgtgggctgtccccgacttcctctgggctctactgaacgaggctaaagggtttgcccttaatatagctgatgctcaatacagctgctaagccactagtggaaggtaaggaggaatgccattcttcctgtttatgaagcagtgtgcaataagcatgtcttcccatgtcacaagtctatttttgtgaaataagtggttcagagagaggcaaggtgagtcatcgccttctgtctggctttcgatggctcagtcccagcaggcactttttactgtccgtgaacacggagcaataccatttgaaaaaatgcctttgatgtaggtggagcctggcgtcactgtacaggtggaatgtagccatcctcactcacatggaagttcacctctgcatctttcctctgccactgtgttcactctcggtctgggagtcagacattgaacaaatgacttaactaaaaatgtgctgcttttggatttagtattacaacagtttccaacatttgattaagtatgaatcacaacatttttgggttggtggagattttagggaacaatttatccgaagttctaaaaaccaggatgttgataccacttactcgctggttgattcatttgctgactcagtggttcgatcagtaatgatctgttgggcatgtgctacatgtcaggcctgtgcagagctcattaatagttttagctgatgttccaccctcagatggagggtcccaagctagatgcacagtagttccgtcacggctggtccttgacacttgccttactccccccgccgtcatctgactggaatctccgtgttacgttactcgcacattttttcttcctccagaaaattgaaaatggtgttcatgtttgactcacctttgtgtcttcacagtgcccagtgtggcaccttgcacaaggggaagctcaagaaacatttgctaagtaaatgtacaaaatacagtggacccttgaacaacacgggtctgaactgtttgagtccacttatatggggacatttttcaataaatatttggaaaattttttggagatttgtgacaatttgaaaaaacttgcagatgaaccacatagcctagaaatatcgaaaaaattaaagcgggccaggcatggtggttcacacctgtaatttcagtactttggaaggacaagacaggaggatcaccagaggccaggagtttgagaccagcggggcaatgtggtgaaaccccatctctactaaaaatgcaaaaaccccagcgtggtggcccatgcctgtagtcccagctacttagggggctgaggcaggaagatcacttgagcctgggaggttgagcctgaagtgaactatgattgcaccactgcactcaagcttgggcaatacaatgagacccagtctctctttttttttttttttttttaaaaaaaggaaaaaaaattaaggaaaacgtaggtgtgtcatgaatatgtgaaatacatgtagattccattgtgcgtgtttatcaactgtttatgtgatcagtaaggcttcccatcaaccgtaggctattagtagttaagttttgagggagtcagaaattgtatgtggattttcgactgttcgggggaacccctaactccagtgttgttcaagggtcaactatagttcattcattctgactttgttggcattgcttctgttttcactgtttcctctactgaaaatctgatgggggcagtgcctattgacctcatatgcttggaaactcgtctagtaaacatcttttggatcaaacacttgaatgttgagcatgtggctggggaggggccggagctgccatgcctgctctcctcctcaaggtgggagcaccagcccaagccctggggctctacatgcaaggtgatgggaacagctgagccatagggcaggtgcccagagatgcagctttgaacaggcgtagctgctggggaggaggttgctgggcacttctgcacatatgtaaagctgtgcatcctccctggggatgtgttaggtgagatggggacgaggcttgatacctttccttaccatcctatgcacttgggttttccagcactgggaccctgttgcttgcattttagtcagtccctgctgagccctttgagagatgagctgtgggttgctgagggagagggatgccagagatgtcagagctgagccgtggaggatcaggcaggaggagcaggcactccccagctcagccaaggtggggagactgccccaggcagggggcaagaggaacaaaggagatcccacagctcctgggaagttctgtcttcgtgagctctggctcatctggttcaccctatttgtcctgcaccctctagagccaaggctgactgggagccagggatacaaggtgaccccaacatctctgatcctgctctcctagaattcccagaaaagctgggaggctttggaaaggccactttgacggaaggacaagcattgtatttgaggcctggatttaggggaggaaggagctgcagaaggctggcaagccaggcgtcctcagaggggtttgactgtggttctcaagggcgggggtttcttcttcaaaggcagcctagagtttggccttgtaggccatcagcctctttttaacactggtcccttttgactgagcttttcagactgattctgtggaggacggggactgtgtctaatggtatctgtttctccaagtctgtggctggcaatagtggagtcttaataaatgatttttgagagaatgaatcatggggttaatgggtaaagcattacagaacacgaaaaaccttttaagcccctatgtgttgacagcaagaggtagagggacatttgctttgaaatccttaacttttggttcagaaaattgatgttctaaggttttgtgtatcatgacactattccatttcaagcgtaccacttgaggcataacttactgctttctacatattatttgaatatagggaaaccagttagatgttaaaggcaggttggcattctgtttagaataaccttctgttgataagcagaaatctagcttttcctgccactttgtttgatttttttttccaaagacatttattgtacagtgggtttcaaattattctggggacaaaaggtatcattttgatggtgttttccagcctagttggcttcactgcgtaagcaccttgcttgatgatatgcaggggaagcttccatggcaggctcctgcctgtccatggaggaaacgtcttctccactccctcctgcacacggccactgcccgcacccggcgtcctgggttgggagtatgtgggaggccagtggagctgtgggcctggctttgcccatcaccaaggcttctggggggaacagcccaaaatgcacctcccaggacaggggaatgtctgtctctgatacatacggcaggagcagctttgggtcatccttgggttgtgaccatggaccgatttagaggaaaatgacatccggggcaaagaaaggcagataaacaccatgtatctctgtgtgttttcatttgttgagaaaacagcaggaaaaaagaaaaccttttaaaccccattagtgacacatatttgaaagcgtaaatgaatcttataaggtgacatccctgaactagcgtgttgggtgagattgcctcttttgtaacggaaggagatgctgagggagacgacagcgatggagaccctggccggccacgctcgcactgtgttcagaatggggattttccttccctgttgtgtaccttgcattttgagaagagaagacaaatctgacgccaggtcggcatcaccagtaacaggaatccctctccctttgaaggcagtgatggccagcgactttgcagtgccgaaattccgatacctggagaggctcttgattcttcacgggcattggtgctactcccgacttgccaacatggtgctgtacttcttctacaaaaacacagtaggtattggatacctgtctagagttttgggattggaaggttcggttcttaggaccatcgcctgaatggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcctgggctggctctgcactctgtaggctcagagtctaattcaggggcatgagagcagctgcatctctagggagaggtggtggaaacaggtggataacactagcaagtccactgatggctgcagagtgagaaggggcataattatgaggctagcagtttgcacaggggcacacagctggtaaaccttcaaggctgcgttcaccccaggccacccagtcctgctcccaggctcctaaccactctgtccataggtttctcaggagcatgctgctgaaatatccccaaacaggagtcctctaatcagcattttctctagagtagacggaaaatccaatgataagcacaagtgtgctttgtggtctgggatcagaataagggaacttagcctcactctgattcccatactgaatggcctctgttgggacacacccacaccaggacaggtgacaggcggcaagcccctaggtcagggaggctcagacccagcaggaagggggtgcccttcgggccttcccaccctctcccacctcccaggcttgcagagcagacacacccctctcggatgagctcattctgtagctaaagtgaccctgctgtaaagccacacccagggcagattggctgcagacatttctgtctctctgagggttctgcatggtcatttcatgtggatcttcacgttggactcttcgttccttcttcactgcttctttggcagatgggctcctccatagccctgcaggatggaccacatggccgtctcagagttctgccccatttgtaagagatttctagatattttactgaggagttgctaggctgctgctgcttttggctgaatgtacaaacaaagagacaaaataaactcttagggtaagtgatcttccaaggtagtcccataaatctacctggctaaacaccagaactccagtgtcaagattatcctatactcttctgaaaataaaataaaataaaaggtgtattctttttccagttctgtataaaaactctccagttagctagctctaaactgtcagtggttgttcatgttcattttatttttattttttgagacagggtgtcactattgtctcccaggctggagtgcagtggcaccatcatagcttactgcagcctcaacttcctgggctcaagtgatcttccagcctcagcctcccaagcagctgggactacaggtgcgtgtcaccacgcacatctaatttttttttttttttaattttgtagaggcagggtctcactttgttgctcaggctggttctccatgttcttaattgtttttctggaggctacacctgcctttcttttcccaacctctctttccccttcacactcacccccttcatttttcggagcgtcttctagcaaatgcatacagctgctcagatccagtcagggcatgtttaacttgataggtttggtcccagacattaattcagattaggctgtgcctgggactatctgaggaaggctgtgtcacaccactcctgggcttgccggctcatacctcctttctcccagccctggcattaaatccccagaactttgaggcctcaagtgcacagttgtaagcctaaaggttctcagctcccgaaggagtggagggatgaatgggggtgggcagggaagaatccaagccccctttctatcacttgttagctgtgggttcttgagcaagttaattcctgctttggatttttttttttttttttttaaagacagggtctgattctgttgcccaggttggagtgcagtggcgccactctagcttactgtatcctcaaactcctaggctcaagcaatccccctacctcagcctcctgagtagctgggactacaggccaccatgcccagctaattttttctattttgtagagacagggtgtcgctatgttgcccaggctggtgtcaaactcctggcctcaagctatcgtcccatctctgcctcccaaagtgtggtattataggcatgaaccaccatgtccagtcttcttttaaatcttaaaaaaacaaagcaaagcctgtgagttgagccagctgatccctaattcccagttaaaatgtctcagatcgaagggagggcaagaatgatgtaggccaaatcattaaacacttcagatgcaaacaaaggccctagtggtcacctggaacgggcacagcctcctgcctgctgcgatgagtccctccccattgaagggtgcagaaaggagaagaggacgcctgtttttattccataaaaatgccaggcctttgttaacaagcattaatctacatgaggagttcaaggataatcactctgcctcctgaaatgagaaattcattagttttaggaataaggtggcctttctttccaataaaaagcagagaagaaaggtttccataacaacagtggtttgggaagaaagctttttggtactataggaaaaaaaatctcaattatctgagtacttatcttctctttctcttgactgtatttgctaccgatgactcactaggccaagcctgcgggggtgagtgagcgagagccagccgtaggagtgaggaagggaagaaagtcaatgaataaaaaccaaatgttcgttttcagcatgtagggaaaggctgcatattaagacatttaaatcatagtctgacacaggacttggaggctgtgtggcatggtgggttatttcaacataagctattatttcttatgatcttcacaagtcactttcaggtcaagaagccaaaagctcagggaggtgaagtgactgagtcagggtcaaaagggtagatagttgcagctccagaaccaagcccaggccttgcggtgcccagcagaaaatgtctgtctagcgtcagagttccctgctgggactgtgcctgccctccaagccaagacccatcgcagttgaacaagttgggttccttactcacaccgtgacctcagccaagtcatttgatgtcttggaacttcaagttccctctctgtatgtgggataagagcactcgccctgcctgagtcccaaacaagggaactaacgataccactcaccaccatacaccgtaggcgatcacctatagctctccagggactctggtgagtcctctaaatgcactgggtcgcttcacgctcacagcagctgcattggctgagtatcattggtatgcccatgtcatgagcaaggaaagcgagactgaggagttcatgctctgtgcccagctacatagctcatgagtgttagaatgctttgcaatcactaaactgtcatgtccaccgtataaatgcactcaggctgctgatattcaggaatctagcaatagtgagaagagatctgaccttgctcccaccccagtgagcaggggccagaggtggctgttccacctccctgaatctcactttcctgttctgctgagctgggtagctgtagctatgaggatcagagatgatgcctctccctctccccccagcagaggtccccgtggacaatcaggtcactgcagcgatgttgatgaggtcattggctttgctattgtgcttttgtgtgtcctcccctcagtgggagtcagtcactgtccactgcacctcctcagagagtatgcaggtcactaaagaagagacaggagcagagatatagccacaggtaggctttgtctggggtcacagacagaggagggccactagggaagatgccacagctcatactcaactggccctcttgaaatgtgagcagccctacacccctgtgaaaccttgattttgttttatgttaatgatccagagcttgtcaagcacaaaaatctcatccccgcaagtgctgctcctgggaattcccaattcccactgccagttcttctttcttaagggagtgaggagggcgaagggaaagaggaagagggagaggcagaggccagcagcagggctcaaggtcatggctgtctttggcagaaatcgctgccaatacatttaatcttgactgtgaaactctgcaggcctgtcagctccctcggatgagaatcctcagcaatggctgaagactcgcctgttcctgttcttcctttcttgatttcagatgttcgtgggcctcctgttttggttccagtttttctgtggcttctctgcatctaccatgattgaccagtggtatctaatcttctttaatctgctcttctcgtcacttcccccgctcgtgactggggtgctggacagggatgtgccagccaatgtgctgctgaccaacccgcagctctacaagagtggccagaacatggaggtaaagctcccccgagtctccgccttccacctcctgagctctgccctccacgttcactcttccaaagtgccagtcccccagcctcccttcagatggacaccctggacaaactgaaattctagaattcaccattctagaggatggagaaaaagggctgccctctgcttggctgcagtgcatcaagtgttgtaagcgaaactgtcccccctccaagagtctccaggagcccaagaaaagcccagagtccagtcagtcacaggggatcactgaagctagaggggggatttttctaaagcaaggaagaaaatgtgacttattttgaacgggaattaacaagaagacaaacccacaaggaagccactgagccactgaaagagcaaatagatttaaatacatactggcattaatataccacatagattcacacactgatgaccagctgtttctagccagccattaaaatagacagcaagtgcttttctttgccttgaattattccatgtgggcaaaaagaacatggagtctcatttctcctgcaataatccctaattccagattcattcactgatgagttaacttcccctggccacctctgagaatgttcagttcccacagaagcaggccgcatgcacggggtgccaggaggcgaagggccagggaggggagcagggcctctgcttgttatctgttgcttcaggggagttcccatccttggccaggcctcagcctcctcggccacctgtgggacaaagacgctgggagtgtgtcctgtcctgtggaattaagtggcccacaggaagagcctagccagcactttccctaagtgctcagccagagctccttccccagtgtgtgtttcctgcaggtcccgtgccagctgctctggtacttggcagggtcaaatacacatttggtcacccgggtaatagagactattcatctatatcaaggttattttcatttctgcccatgggtatatagctgtttgcttttaacattgggacacatccatcgtgtaattttaaaagtgaagactcactcttaagaaacattctaagggacccaccaccaagagaggcaaaacctggtcaaagtggaaggaatagaagggctcaaactgggggagaatgcccggaatttcaggtgctattcctacttcctacttgagagacatgttccctgggaagatgcagaaagcagtttcatcttttttttttttttttttttaagacaaggtctcgctctgtcacccaggctggagggcagtggtgtgatctcggctcactgcaagctccgcctcccgggttcacgccattctcctgcctcagcctcctgagtagctgggactacaggcgcccaccaccatgcctggctaatttttctatatgtttagtagagacggggtttcaccatgttaaccaggatggtctcgatctcctgacctcatgatccgcccacctgggcatcccaaagtgctgggattacaggcgtgagccaccgcacccagccagtttcatctttttactgtgaacctggagctactgaagctcgtctttttggtgcaggtgttcccagtgagtgacgcagctgcagatagttttgtaggtgtttggtagtgcttttcatcgggcctctggggcctcgcgtctccaaaagtcctgagagagtgagttttccttgggtgcttgccttgtgcattaacttacgtgtagcatcctaggaaatgtcattcgaggtgtcaacctaaatagcaaacagagagaggctctctaaaagagaatggtgtttattcgggaatagggcactgcaatgggaatgtgtgtgctgtagtaagctatgtgcatatttagcgaggtaaaggaagacaaatgtatttaaaggaaaaaatttcatgatcgttttgagatgctctttccttgactacaaggataaacgacaaagatggtgcctgtttgaggttggacagacagttgctgggcacatgtccttatagatatatttttctgtggatatgatcatttttgttatcaggtatttatgcatgagaaccctcccttcatggcctttcccagctctactcctcagggtgggtttttgttgttattgttgttgtttttaacacaagtgactccatttttattctaactgctttcacagaggatgccaatgcttcactgtaacatcactgattgtttttgtgtcccaggaataccggccacgaacgttctggtttaacatggccgacgccgccttccagagcctggtttgcttttccattccttacctggtaagttggcccctgggtgcagtttttcttaccagctggatccggggacctacagatccaggaccccactgtctttcaggcctactatgactcgaacgtggacctgtttacctgggggacccctattgtgacaatcgcgctgctcactttcctgctccacctgggcattgaaaccaaaacctgggtaagagccgcctgcatggccacgtctcagaagagcactgatgccgtggaccccacacttccctgcagattcatgaggtctgggaggtcgttttgagtagacaggagactgcaaagctgacctcagtgtgatgagaaggacaatgacacattcccgagccctgtggtgtggggagccgctgcagcctgatgctcgcacttccccggccatgctcatctccctcccgcctctttcccgcttccaccaccacattctctcctttccctcctgtcttgccctctcgcccctgactccatctcacctcatgtgcatctcccagggcggtccatgggttctggaggcctcattgagccccaccggttacccgcgtcatagaccgcagtgtgtctgaaggcctcagaacctcacacctgctcattgatgactggcacgtttttgttattgtcattgttgtcacttttaggtggaaataaaagccctttctttctcattccccctcagacctggctcaactggataacgtgtggcttcagtgtccttttgtttttcaccgtggctttgatttacaatgcgtcttgtgccacgtgctatcctccgtccaacccttactggactatgcaagccttactgggtgacccagtgttttacttgacttgcctgatgacgcctgtcgctgcactgctgcccaggtgggtgtcggagcgggatagtgcctctgagccccgagtgagcccagacgacattggcattgcttctgctctgtgtgggtctctggaagctcaaagacaccaccgacaggaatatctaactttttgttttaatgtactttttctagattgtttttcagatccctccaggggagcgttttccccacacaacttcagctggcacgtcagttgaccaggaagtcccccaggagatgcagtgctcccaaagagacctttgctcagggacgcctcccgaaggactcgggaaccgagcactcatcagggaggacagtcaagacctctgtgcccctgtcccagccttcttggcacacacagcagccggtctgctccctggaggccagcggggagcccagcacagtggacatgagcatgccagtgagggagcacaccctgctggaggggctgagcgcaccggcccccatgtcctctgcgccaggggaggctgtcctgaggagtccaggagggtgtcctgaggagtccaaggtgagagctgccagcaccggcagggtgacccccctgtcttccctcttcagcctgcctaccttcagcttactcaactggatttcctcctggtcgctggtcagcaggctggggagtgtcttacagttctcccggacggagcagcttgcagatggacaagcgggacgtggacttcctgtccagccccactcaggccgatcaggacttcaagggccagaccacagactacttataggagcatcttcaaggcggtcacagtgaaaaccttgaaatggccttttttaatatatataaataaatgttaatattatttatgtttattatttgcacagaagagttctagggagatgtatttctaaatgtttcccaggctaatacaggaaacaagaggtaccaaaaaagaaagtttattttttaaaattctaagtagagtatattgaaaagaaaaagaagagccttaacatatataaaagtttaaagaagagtaacacttgaaaagtgtgtttagatttattttttcatctcatttttaagaacaagcagtacgatttgttttcttcaacatgtgtgactgcgcactgagtacaaatgtgtgactgctcatggttaatgcaggcaggtgtgaacatgggggaacaatgagcagagatggcagagggcagagcacatggcccccagaggcttccagtctcactgacacaggagggctgggctccacttcatccagatgaaggaaaggaagacctcaagaaaaattcacagttgagtgcatcccagcattctgttccgggcaggcatttcaggaagaccgccttgtaggtattacatccctggtgtcgtattttgcctgttaaatcgtaacaagcaataaacaactttcactttgcaaagacagtgtgtccagttaccactggtgtatgaaatgattaatacctgacctcacagagtatgatctgagggcacttccgtaaggcaagtccttttagaggctatgaagaaaacagctgcatggcacataccaaagctgctgcacagccggccaccatggcaccctgcaccaggccatcagcaccacgtgccaaggagctcagcggtcttcaggcatttttgtaatgagccattagttctgtccctctaaaactagaaaaggaagggcaggaaatgataacaacccaaggcaatgatatggcatgtcatcttctgagcccttctttctactttgtcaaacagttcttagttgctggctctgctcggcaccggggctgtgaagggtgtactccctgctgtgtgggagggacctagggcctctttggatgctgtcttcgaggacagcaatgcagagagggcataggatctgaggacaaggaaattcctcagcatggcgtatcaggaaagcatggctcattctgcaatgagccatgagtgtgggccatcgcaagtcacagaaaatgcacctcattccagtcaagcagaaaaacaggcacaggctcagtgtaggtcccaagagagggtgcctggactcagcaactcggacctgggcttttctcccagctttcagggacagctttgtcctgagtctgcctctgttcacggggatgcttggctggagtcacccccaggacttatccatgcatcactattcagaagacacagagggcccctctctccacattccaaacagagtcctggtttcctcagcctcaccctgcatagcttgcacaacatcctcagaaccattcactggcaaatggaggggaacgtgctgactgggactcccagctggagctgggaggagaggtccacttcccttagaacacctgagctgctgcatgagtggacgtcagaagaatctctatgccctgttaaatggggagacaaaggggtggtgggggcttcagccagtgatttcggaccgaaggtgacagccgtcccaaccctgcccagcctgatgccacctcctctgttcttggaacaacgcataggaaaagaatctcctttggaaggtgacactgctccctgaattaaggtaatggttgcgagcaccaagtacaaggactagacgcatatttacctgcgtatctgagagttccagattcccagcttccagatgatccttgcacagacaacctaccttctttccagaggatgtctttctcctctggagagtagatgcttgctcttgggaaacggaatgaccttggcgctggcttcaggaatatgcatcccacagccagtttagagaaatacatgttgtaaatggcattgacagctgctctttaggatggggagtattatggaaatccacaataac

SEQ ID NO: 12981 - DNA, 11230 bp, Human
gcagggacagaaatgtaacattactctgccatgtacagtatggtaagtactagactagaaaataaacgggaggaaatgggaccaaatgaaagggagaaggtgatctctagtaggggtccccaacccctgtgccatggaccagtaccaatccatgacctgttaggaactgggccgcacagcagaaggtgagaggtaggcaagcaagcattaccacctgaactctgccttctgttagatgagcagcagcattagattctcataggagcacaaccctattgtgactgtgcatgcgagggctctaggttgcgcactccctgtgagaatctaatgccagatctgaggtggaagagtttcatcccaaaaccatctcatcccctcgcaccgcggtatgtggaaaaatggtcttccatgagaccagtccctggtgccaaaaaggttgaggactgctgtcctagagggcacacagatcaacacatcaagtgtcctaacctaaggaagggcctgagtaagggtctgaaagtgcattgaatgtctgtggaatggcagccatttctggtatacctaaagcataaggaaacaggaggaaggaaagtgaggttagactaggttgtgaaagggattatatgtcccacaaggagtttgaactttattccttcaacattaggaacctgtgtcaggagactgatgtgattagatctgctttataacttttggtagcattgtggcaagtgctaagaataatgtttctggtaggccaggcacggtggctcatgcctgtaatcccagcacttttggaggccaaagcggacagatcacctgaggtcaggagttcgagtccagcctggccaacgtggtgaaaccccatctctactaaaactacaaaaattagccaggcgtggtggcaagcgcctgtaatcccagctactcaggaggctaaggtaagagaatcatttgaacccaggaggtagaggtcacagtgagccaagattgcgccactgcactccagcctgggtggcagagtgagactctgtctcaaaaaataataataataataataatgtttctgaaactttgatcattcatcctccatctttgctatttttgccatacttgaagcatgcttttggctgatgagatagaccagtaggaagaagaggacataactaatgaactaatggattaaatttcttgtcttttttttttttttgagatggagtctcactctgttgcccaggttggaatgtagtggcatgatcttggcttacagcaatctctgcctcctgggttcaagcgattctcctacctcagcctctggagaagctgggactacaggcacctgccaccacgcctggctaatttttgtgtttttagtagagacggagtttcaccatgttggccaggctgaatttcttacacacttaatggccataatattttagtatctgtgaatgctttttatagtgttaaagttcctccttgttaacattgccatttcacattaataatagtgtgcttgccaaagcaggccctttcccccttgtcttctaatatatagctggctaaaaaatttaaatgaataagcttgtgtctgacccaaggtaaagtacttaacattcaatgagttggcctggagagatttattttgatctttagaggacatttttttctgattcttatcttattctagatctttgtaactgagctatccagccacttcatataagtgaactataactataatttgtttaaaagatcatagttactcattttaaaacattttaaaatttattttaatgtaggtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatgtaagttaagaaaatttttaatctgcgtatatgttcatcaaccacatacattttgaacagtcaccttgttgtatcagtcatcttcatttttgatattttctgaagtagtttttcttttccctaataagactaggtaccactagtatagctaagagataaatgattatcatgtgtagttttattattattatgtagagtttaatgtcttaattattatttttcatatgaattgggttttttttactttgttttgaaggaaagttacccaatctctatgaagggagactggcaggcaggttgaggggattcacaaacaaatactaaagataactaaaatgtattttattgcaatgcccccttcactaaagcttcattttttgcctatttaaggaaataattcaaaaatgaaaactaaaaagaaggggaaaagtacaccaaaggaaagacttacccacagggttgaggattgtgcagttttaggaaactaggtgaaaatgggtatcttttcatcttcattgcattgctcccaaaactttactagacttttaactagagtttaaaatgctttatgtatttatgaaattactcagtatctttttagtaatttataaaattactcaatatctttttctgttaaaagtcaaaggtctgttttaggccatatataaattcatgtttgcttaggcggcatctgtctttgaaaactgtgatataaattatttctgttttagagatcaaaaggcaaataacagatttgatataaacccaattgcttaaaatatcttttcattctttggtataaaacaaacctgctaccagcactaacattgtatttgatttaaagtatatctctgtagtcttaaaaatgcaaataaatatggcttaaatttgaaaggttttggcatgttccttaaatcttagttcttttataaattggattaattaaagttgaactgtagttgcaaatcagatacctgctttggagttaggaattgaattcttaatacttctggaatttaataacatagttttattctttgctattctttgttttggagtgttccggggtaaaagtacactgttttgaaaacaatgcagttgtcatgaaatgtttgtgtatgtctgtcagtagtccaaatagcatcttgctatcagaaatgactgctgtgttcaaacagtaaggaaggaaatgagacgtagaccctcattattattttatacgtgagcatgcttacttatttccttggctttttgcatgagtatcccatcccctacttttatgctctgttattctgtgcagtttttccttaattcccttacatcttctctctggttttatttattttaacaattatttatagagagcttaatatgtaccaggcactattcttactgcttggcaatcctttttcaggttttctccttgttaatattttttaagggataacagatgaaactaaaaatgtacctgttttaataagcagtataaatatcattccaggttatagggtataatgtaatcattttaggttataagaagttaaacagtttcatacagctttatcctgaagtgcagccctccatttcctaatgtcagaaatcttcagagcaggctttcttctgacccagatacataaaatatttttaacaggcattttttttattgctaaacacaagaatgtgcactcagccaagattaaatcaacaaatttgttgctgcagtgaatgttgttgttgtaacctctgcaatgatttttttggggagttgcagtcttccaaaaataatgtgaatttttctgtacagtttagtttgacctttaattttgtatagataattcttatgttatatattaacactgtaatggatactaattctggtcagaaaattcatcctaaaactacagttttcaaaagactgtatgatgtatgctatacatgcactgtattagtccattttcacactgctataaagaacgacctgagactgggtaatttatgaagaaaagaggtttagttgactcacagttttgccggcttaacaagaagcatgactgggaggccccaagaaacttacagtcatggcagaaggcgaaggggaagaaggggaagcaagcacatctcaccatgaccgaacaggagagagagcgaaaggggatgttccacacaactttcaaacaaccagatctcctgagaactcactcactatcatgagaacagccagaggggaagtccacccccatgattcagtcacctcccaccaggctccctcccccgacactccctgattaaaagttatgtatgggcttatacaatttcaaatgtaaaaacagcctatttacatatgttgaaacaataagattttgtggtatcactgtcccttaataattacaattcaaggtaagatttggatggggacacagagccaaaccatattatatacttttgtgatagcatagaagcatgcctttttaaatacacaaaagtctaaatttctgaaacatcaagttatccttggctgagtaaaataatttttcacttataagaggattcaccatagccttctctaaatagttatttcttcatttaaatattgttcaatttaccaaaaaagttaccaaaaccttcccaaaatagttattacaggaagtgaggtacatatatatcttttgcaccttgtatagaaatagaaaaaagtacaagtctttagatttcatagtctgcttattacagatactgacaatgaaatatatactccctgctcatacagtttgaaataaattattacataaagatgataaatgtttataagcaaatctagcatatgaagaacatatacatagatgagttgcacacaaagcctagtgtattatggaagacatatgtggcaggtaatctcaagagaatacaaaagatgtattttcacttttatttctaaaagtagtaaaaattaaaatatggttttctttaaattttcagttttttatgatgtttttcttttttagctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagtttacagtgaccttttttttttcattttattaacaaagtcaatttttaaaacattgtggtaaaatatatatcacatactatttgccattataccagtttttaagtgtaaattcaatggcattaattatattcacagtgctgcaccaccttcaccacttttccaaaagtttttcatcaccccagacagaaactcggaaccattaagcaataactccccattcctcccagcccctggtaacctctaatctactttttgtctctatgaatttgtgtattcttgatatttcaaagaagtagaatcctaaaatatttgcccttttgtgtctggcttattttaacttataatgttttcaagttcatccatgttttagcgtatatcaagactttgtttcttttcatggctgatttatgttttattgtgtgtgtgtgtgtgtgtttgtctgtacacgtgcacttcctcccacacacattttgtttatccatgtatctgttgatggaaacttgtttttttcccgccttttggcaattgtgaataatgctgcggtgaacattggtatacaaggatctgagtacccattttcagttcttttgagtatatcaaggagtagtattcctgaatcatgtggtattctgtgtttaatttgttgaggaaccaccaaactcttccacagtgctaaaatgttctctgaagcatctgtaccattttacgttccactagcaatatacaagcattccagtttctccacatttttgccaacacctttcattttcagttttaaaaagtgattataagcccagtgcgatggtctgtgtctgtagtcccagctaccagggaggctgaggtgggaggatcacttgagcctaggtatttgaggccagtgagagcaatatagtgagaccccatctctaaaaataaaataataaaaattataaccatcctagtaagtatgaagtggtgtctcattgtggttttgatttgtgtttccctaatgatgagtgataatgtcattaggaaaatgcaaatcaaaactacatcttttcacataattatttgtatatcttcctttgaatatattgaaagtttgttcaatcctttgcccagtttttaattgggttgcctttttgttgctgagttttagttctttatatattctggatgttacagctttatcagatacagttgcttcttgacttagaatggggtttgtcctgataaacccattgtaagttaaaatttttgtaagttgaaaatccatttaataccctgatgaactcaccataaacttgaactatcataaactattactattttttgagacagagtctctgttgcccaggctggagtgcagtggcaccatcttagttcactgcaacctctgcctccttggttcaagcgattctcatgcctcagcctcccaagtagctgggattacaggtgcccgccaccatgcccatctaatttttatatttttagtagagacggggtttcaccatgttggccagattggtctcaaactcctgacctcaggtgatccacccacctcagcctcccaaagtgccaggattacaggcatgagccactgcacctggtcacaatcataaattataaatccatgtgtttctcagtttactatggggttaggttaccatgggattatgtgttagtaaatccatcttaagtccatcataagttggggactgtctgtattatgatttg

SEQ ID NO: 12982 - DNA, 157866 bp, Human
cactggcagattcaaagccagacatctactctcagatacacgccctgggcctcaaggccagtttgcctgggcatttccctttaatgtctcctctctggaagtgaatggtgtcatcagaaaggttccagtgccagcaccaatcaatgactgtcccagtgagagcttggtcaaatccctttacccctgcagggactcaattttctcacctgcaaaatgggggtattaataaagccaccccccgcacccccggcccccagcccctccacctggttgcaagaggagtggttgtagactaagggcctgcgtcaagtacagaacccaggaggggtctgcccaactttaaccctctctccaaatcctctagcctgaagcagcagaaacccacgtgggactgggggctgcccccttccgggccttccccaagcagaggggtccccatctagccccgcggggcaacggcggccggtggctgcgtgaagggccccctcccccgacgccggggagcaggaaggccactcggcaccatatttagtcagggggagccggcagcccagagctggtatgcggcgctgggaattcctgcaggaaggagtccgcgcctgccctttttgggttgtctcccgcccgccgctcccgccgctcccggggagggggaccggcccggcccggcccggcccgggaacctcggaggagctggtgccgcgcggggagcggagcgcccgggctgcccgcgggtccccggcctggcgcggggccagcccaccgcctcgacttccttttatggcctgtgtgtgcgtgcgtggacaggagcggggagggagggacggggagaagacggagagcctggggaagagagagagagaaagcgcagagataggagtgagacacgcgggagagatggagagcaagagacacagagaccagagacaaagtgagacaggagggagagacagatacatcgacagatctagagaagcgagagggacagagacaaaagatagagcgagagacagcaatgatcagagtgacagacatgcagagacagtggcagagacagagcgagagagcctgtgatggagagagacagggaatgcaattttaggcgaggaatccttggggaagggaagttgttgaagggaactcgcagactctgggggcacacccactttctccttggatcttgacacttgcatcttgtaaataacgtaattatcaccgccaccgccttcccccattttgtagctatggacaccaagtctcagagaagtgaagtgacttgcccaaggtcacgcagctggcgagtggcgcacaggggagggggacagctgaaataatcacagtgggcttatttttaatttttatttgtattttggtcgtggtgatgtgggtggaggtggagatggcaagttgggaaaagtaaaaacttccccttcctgcacggttcccagcaagggtgggggcctcctgtcttgcactttgcaaagttcaagaaatcccctttccctacccttcacgctgcacagccggccctctttccagacagtgcgatgccaataaaatgggaagtggggtgggagatgtcaagtcagatccaccacagccccgacacggggaggaagaggttaaagcctttgcggccggaaccgactcagggaagacgttctcaagcatcccgcacagacactgcctgctcgaccccctttctctagggatccggagcgtctgcgaccgcctggggccggggctgagactcccgtccctgtgcgcacctgttccgtgcgcccttgtgcggtgcgcacctgttccgtgcacccttgcccgagcgccccagctccttgcgctcccgccgggggtgcgccctgcagggggcgcggcgagggggccgcgagggaccctccccaactccaccccttcggcctcctcccctttcccagccgcgggcagctccgggtctataaagagaggcgtccgaggacgcgcagggagatttggacgctccggcctgggaggtgcgtcagatccgagctcgccatccagtttcctctccactagtccccccagttggagatctgtaagtagtagttgtcattctgggggcagattgcagggcaggggggtgttaaaagtcctatagggtattctataggggctggggtgcacttaggggtccctgttgtcaacctcgtaagggccatggtgggggcagagttgtgatttggatctctctctgccttatcgtcttagattatcctagactttccccaaacagcatttcttaagattgccagtgagaagtaccattttgggggtgcttattaacgatatcaatgcctggacccaactccatttcccaactctagaatccccagaaaaactgccttaaaaaaaaaaaaattagtcccgagtgattcttgttaagaggctaatccaggagatatgctcccttggaaatctcagaggtccggtgcagacaatcaaggcatctcacttttattctaggcaccaaaaaatttacagctgaacttcactgaaaagtcacttgctatcacacagaagggcaaagtgaggctccttgtggatttgaccgtattgcacagttgtgttgataatgcattaaatcagttaaaaacacatgggcataggcttagcagaaaggagtgttgttgttttttttttttaatcagtttaggggaggttcttctatgttgagaacccctgggagataaggctggttgtgatctagtttgttacagcccactttttcctcttctccaaattaaaaaaaaaaaaaacaactcacccaggttgaccccaaagggcccccagatacccaggtgggctccaaagtctccatttgcttccacgatctgcaggtgcgttaggtaagattacactagaatttcccgcagagccacctgtgtcaatgccactctcgtgcccaaccaaatgggtaaaacgagagaaagtgtggctactgcctgttgtaagttttcttccagcacagggtctggtagggattttgccacttgagaaaaggtaccatccaaagccatgcttgtcaagaagtaaaagaaaatatttagaaacccaaggtgggagtgtttagttgcagtatgaagaactgagagattaaatggtgaactgtccgtccggggtttggcaaaaagaatgcaggctattaataaactgctttgcatagttttttgtttctttgatttactcaacgatactattttagaattgttcagagacggaacttgacgctgaactgaaagtcattaggtggcagggtgtgaaataagatagagaattttgtttgaaggaaattgatgttttccctttgagatagctaccgttgatggaacacttcagtgccacatgctgttgcaacatttaacttaatttatctcatttaatctttgcaacaacttcataagaaaggctttatgatgcctgtttagtatacaaggcagctgaggctcagagaggtaaagtgtcacacagccagcaagtggtagaacccattcccgggtcagtttgagtccaagttcatacccttgaccccactatctttcttctttaccatggacacaaacttgttggggtcaggtttctggtgggactaaatgcttccaacaaagtaaatgtttatcaccgtgtcctttgaagaaaacataaactgactttttgcacatttaaaataaaaggcactgtttgtcccctgattgagggggtgacctagctgaaaccagtgaccctaggtgggctgccatgccgagagtccagaacgtgaactagctgggtcttttccgagaagccgccaggcttgccttgtaaacaccatgtttttttattatcatgtccgaaatagatgtgttattccgtacaaggtatctgttatggatttgttatcattacttttccgtgggagggcagagattgaggcaaacatgcccatttatggaagcgttttccatgaggccatccccggccccctcgtcagttacccagccttgcaccgcagcccggttggtcctggccctggggatttgtctaccatgtccctcacccattgaagaactagtggagaaaccctaaggagaagagatttgggaggaaagtgggattcttttttcctaccccctcttattcagaggtttgatttttttgggtggggggtgggagggaattgtctcctttccacaggtcttgaatccaaacaggtgggtcttccacgttaggcacaagcgtgtaattccaagagcagatatatagtagatttttcttgaaaaccaagttcaatattcaatccagtagaatcatagaaggccataagcaaatttaaaaatcatctcccgcacctccccaaacctcactttctcatccgggaaatggggctaatgagaataactcatgttttttgggcacttttgcctggcgagatgctaaacgctttgtggacattatcttacgtcttcataacaaccctttagagtagatactgttattctaactggctttattttacacatatggagtctgaataacttgcttaagatagctcagctaaccagtaaggaaaagaagattctacaaatctaggtctttctaactccagagtttcacagattaccctcatgggaggatttgatgagctaatgtgtatgaagggtttagcacagtgcctggcccctggtaagcttcagtgatggttatttatagcaaacacaaccagagagttcaagatgtttgctcagtatggcatggctcatctttggcagaaccgggaagcctaaactatgtggccgttaaaggagaagcttctcttaattttcttccctttgatctcataaacctcgtttctatttgggctgaaagtggtgattagaatctttaatatattaagctaccattccttacctggattgggaatgttacaaattccaattacatttgtttagggttttgtttgtttgtttttgagacagagtcttgctctgtcgcccaggctggagtgcagtggtgcgatcttggctcactgcaacctccgcctcctaggttcaggcacttctccagcctcagcctcctgagtagagagtagctgggtttataggcgcccaccaccatgcctggctaattttttgtatttttagtagagatggggtttcaccatattggccaggctggtctcgaaccgctgacctcaagtgattcgcctggcttggtctcccaaagtgctcagattacaggcgtgagccaccgcgcctggcttatttagggtcttgatggcatactttaagggatggcctttttgctctctaggtcttctccttccactcctgacctttcaacttttaaccctggccacacaatggaggaaagactgaatttagagaaaggcaggcaagaatttgaaagaaaccttgtatgtgatccaaggacagaggaagaagctgctcacagtggctgaaaggggaggtcggacatctgtgacttgtatcagggtttcaggggctaaggaggaacaacctcatcaaagttgctaggaaagggccatagaggccaggtatggcaggtcatacctgtaatcccagcaatttgggaggctgaggtggggggatggcttgaagtcaggagtttgagaccagagtgggcaacatagcgaggcaccatctctacaaaaaaatttttaaaatgagctgggcatggtggcatgcatctgtagtcctagttattcaggaggttgagtgaggcaggaggattgcttgagcccaggagttcaaggctgccgtgggccctgattgcatcactgttctctagcctgggcaacagagtgagactctgtctcaaaaaaaaggtgaggggcatagaactttactgtaccaggctgaaaaatacaaggcccagagagggcaagtgacttgcctagcatcacccagcgagttttgggcagagctgagacttgtaactcgaagacctaaggatcttccacaggctaatgaatagcttgtttgtgctcaagggatgaagcagtgagttgttaggacaggactgtgaatagggctgacatattcagatgtgtcaaacatcgctaatgccatctctgagtaaattaggcttcaaacagatcgggattctaatcctggttccccaacttttgcaagggagggccttgcatttacctttcaagaccccgataggcttagcaggaaaatgggaataatagataatgccactctttcatccttggactttttgtctaattatatgaatttatctgtaggataaattcccagaaatgcgcttgctgagttaaagggcatgcgtatctaaaattaatagatattgcaaatgactggctaaagacattgcagaccaggtgcagtggctcacgcctgtaatcccagcactttgggaggccgcagcaggtgggtcacctgaggtcaggagttcaagaccagcctggccaacatggtctctgctaaaccctatctctactaaaaatacaaaaattatctgggcatggtcgtgggcacctgtaatcccagctactcgggaggctgaggcacgagaatcgcttgagcctcagaggcagaggttgcattgagccgagatcacaccactgcactccagcctgggcaaagagtgagactcggtctcaaaaaaaaaaaaaaaaaaggcattgcaaattgcaacttgttgcagtcacatatgacagcagtccccatcctcttggcaccagagactggtttcgtggaagacaatattttccagggtggagtggggaggatggttttgggatgaaactgtcccacctcatcatcaggcattggttagattctcataaggaacgtacaacctagatcccttgcaggtggagttggcaatagggtttgtgcttctgtgaaaatctaatgctgcttatctgacaggaggcggagcttaggcagtgatggtcactcacccaccgtcccctcctgctatgtggcctggttcctaacaggccattgactgatactgcagcacaagggttggggacccctgacataggagactatacatttattttaagctgtggtatgccagaattgtaaaatataaaacacagtggggcttttagggccagaaataatcagttcttgctcgcttccagaagcatccttcacaggggctaccgtaactcttgccaaccaagttctcttggttgggaggaaaaaatagtgttatgcattaagagaacttctttctggagttacttgaaaccattggtattcagatgattaggcagatgtcacaaggcaataagaatgtgacaggttcaccattcactttttttcctgtaaaagtgaagtagggctttcttgggaacaagcccttgggaggtggggggatgtgaatggtgaggggagggtagaaatggtggagtagggtcaggggcaagaaagggactttctgctaagaattaatcgggtgtccatttactcttagcagaaaactaggattagattctggattgtactcctgactccaaattttacaagtgggggtcttgcatttaccttccaggacctcggtcatcttagcaggaaaatagcaatagcaggtgatgccaccttacagagcgcttaggagacagtgagatggtctatataggaagctgtctggcctgatacctgatgaatacaaggggcccaataaatacagtggctgttatgaataatagatctaaactgcctttttggtactactggggacctgccaagcaggtgcatttagagtgcccagtgcctctccctgcgacacatttgatgcctccctacacctggaccaggccttgagcaaggatttccactgcagaggtccttccagctggcgaattgtgttgcagatcaggttcagagaacttctgttttgcctgtgtggcattcattcattcgtttatttgaaatagagatgggatctcactgtgctgcccaggctagtctagagctcctaattcaagcaatcctcttggcttggcctcccatagttcttggattacaggtgtgaaccactgtatccagccctttatgacatttagaatatgagcaatttttcttttttcttttttttctttttgagatggagtctcactctgtcacccaggctagagtgcagtggcatgatcttggctcactgcaacctctacctcccaggctcaagcgatcttcccacctcagcctcccgagtagctgggactaccggcatgtgctgccatgcctggctaatttttgtattttctgtagagatggggtttcaccatgttgcgcaggctggtgtcaaactcctaagctcaagcgaactgcctgccttggcctcccagtgttgggattacagacgtgagccacagtgctgaaccctgcatggtatttagaatataagcaatactctaacatctggtctgggtcactctgtattacttacctgatctccaaaaacatttgggtttttgtctctggtccaaaatctttagccaatggcttggcagtaaaatcctaagggaagctgttgaccaggtgaggtgatgtgcaaatcctatactctctgggctctgggatatttaatttactatttatttatttattttcaagacagagttttgctcttgtcgcccaggctggagtgcagtgatgggatctcagctcactgcaccctccacctcctgggttcaagcgattctccttcctcagcctcctgagtagctggtattacaggcgcccaccaccacacctggctattttttgtatttttagtagagacggggtttcaccatgttggccaggctggtcttgaactactgacctcaggttatccgcctgcctcggcctcccgaagtactgggattacaggcatcagccaccatgcccggcctaatttactttttattaatgctgaagcagagagggcaagatcttttgcccctgagttcttctgggaaaaatgaaactgatggtaaaacaaactaaagcaacctgacattctcagttggtccagtttcagccctttgactgggagtcacagacgggtcccataaaatggtagagctgggccagcctaccattgatttattttccctaaatgaaaaatacaaggcccagagagggcaagtgacttgtccagagtcacccagcaggtttggggcaaagctgagactcgttacttgacatcctaaggtcttccagaggctaatgattagcttgtttgtgctcaaaaaatgaagcagcctgggcgcggtggctcatgcttgtaatcctagcactttgggaggctgaggcaggcagatcgcttgagctcaggagtttgagaccagcctgggccacaaagtgagacccctgtctctacaaaaaaatgcaagaattaaaaaattagctgggtgttctggtgcgtgcctgtgatcccagctacttgggaggctgaggtgggagaatggcttgagcctgggaggcagagtttgcagaaagcagagatcgcgccacttcactctagcctgggcaacagagccagaccctgtctcaaaaaaaaagaatgaagcagttgttggtcaggacaggactgtaaacaaggctgacacactcagatgtgtcaaacatcgctaatgccaaaggtgacagagtcatttgttttcatccaaacattcgagaaagttggacgaggtgactcacgcctgtcatcctagagctttgggaagccaaggcaggaggatcatttgagatcaggagtttgagaccagcctaggcaaaatagcaagacccccatctctacaaaaaataagccgggcatagtggcccacacctgaggtgggaggatcccttgagcccatgagtttgagcctgcagtaagctatgattgcaccactgcactccaccctgggcatatagtgagacccttcccccaaccaaaaacattgagagcagctcttgatgagtgaactgtacttcgtggtcagcagttctgggtagtaatttcagagatgtcctttcagcccttggagctgatgcaggaccttaaacatgagcgatggtggaggagggagggttgggaaggtgcatcaaggtagatgaagagtgtccctggggttgggccaactggcggtccgtctctggtccagtgtgttcaccttgcccccgtctgatcttctgcagttggtattccgagttgagtttgactaagtgagagctgctctcagctttaactgcctttcccaagacagcccttgtttttattctaaagctgtggttctcaactggaagcagttttgccaccccaggggacatctagcagtgtctggagacatttttgattgtcatgagtggaggaaggggtgctactggcatcaggtgggcagagaccagggatgctgcggaacatcccacaatgcacggaagagctcccctcacgacacagaatgacgcagcccaagagtcacagtgcagagtttgtggccagctgcggtggctcacgcctgtaatcccagcactttggggggccaaggtgggaggattgcttgaggcctggagttcaagaccagcctggccaatatggtgaaacctcatctctactaaaaatacaaaaattagccaggcatggtagcgcatgcctgtagtcccagctacttgggaggctgaggcacgagaatcacttgaacccagaaacgtggaggttgcagtgagctgagattgcatcactgcactccagcctgggtaacagagcgagactctgtgtcaaaaaaaaaaaaaaaaaaagacttagcaactattattactagtattagtattattaatttgtcaggctcactgaattttctcaaaaatttggcaaatttttaggaaaacattctcaaaacatttggcaaatctgtggctaaatgttgttttggggacccaaggctcgtaggagcaaaacagctttcaggtttccggatctgccagagactcaagtgtcctgttgtgtgttttgtgtctcaatgagggaaaggggaatatgtagcaccttccagatggatttgaccttgactgcgccactgtttgaagagcttctcaacctccgcagctccaccccagcccagatatttcagggaattagggttccaaggggcatgctatggaaaacaccattctagcatgagtcgaagcttctcatcccccatcttgctgtcttttgaccaaagcagattttgcacgtcgtaactgtcagagacatcaaagccagagggaatccagcctgctccaagctctccttttttggacagagactgaatctttgcacttgatcttgtttgtgtttttaagtctgaggttagacagggtcccaggcaatggaggcgtgcgtgtccttttatttttctgttgtagcttttgctattttttctgacttttaaggcaactcatccacatggcaattaggaagagcccacttagggctgggcgcagcggctcatgcctgtaatcccagcactttgggagaccgaggcaggcagatcacttgaggtcaggagttcaagacctcagcctggacaacatggtgaaaccccgtctctacaaagaatacaggaaaatagctgggcatggtggcaggtgcctgtggtcccaactatttgggaggctggggtgggaggatcacttgagcctgggaggcggaggttgccgtgagctgaggtcatgccactgcactccagcctgggcgacagagcaagaccctgtctcagaaaaaaaaaaaaaaaaaaaagaagtccactttacttgtcatagtgcttagaacaaatgaaacactctcctagccctcttgggatgtaattggctaccatctgcacaaactcttcattattgcacaagaatatcaatatacttaatgctactgaactgtgtttaagtggccgaggtggtgaatgttagctgtattttaccacaattaaagataagagggaaggaaaatgaagtgtactttacaaccaaaaaagtacgcttgatgtgcaaaaaagtgtgcagcttgatgaattttcaagaggatatattttttatagatgggggtctcactctgtcacccaggctgcagtgcagtggcatgatcatggctcactgcatccccgacctcctgagcttaagtgatcctcccacctcagcctcctgagtagctgggactgcaggtgcacactatcacaaccggttaatttttgtatgtttgctagagacaaggtttcaccatgttgaccaggccggtctcagcctcctgggctcaggttatcctcctacctcagtcttccacacaggtaattaaaaaacattttttcttagagatgggtcttgctgtgttggccaggctggtctcaaactcctgggctcaagtggtcctcccatcttggcttctcaaagtgctgggattacaggcgtgagccatgtcacctggcccaacagtttgatgaattttcagaaagtgaacactcatagggctggcattcagatgaagatctagaggtcaaccctcacaagcccccctcacgttctgtccttgcaatcattgcacacccgagactcattcattccttatctgagttctatcaccgtagattaattctgcctggttttggacctcagttcaatagtcacagaacctgtgctttttgtgaccaccttcttttgctcaaggatgtgttgtgagatgtccttttttgtggtgtggagctgtagtttacttcacctgattcgagtcctattttgggtgtttgtaatgtgtcaggtactgtgccaggtgccttacaggattgattcctttatgggcatctgacaagcccacccaccttatgtgaaaggcagaaccaaatagactccagaatgagacccaggtttgggtcccagctctgacacttctttttttttgagatggaggctgactctgtcgccaaggctggagtgtagtggtatgatgtcggcttacggcaacctccacctcccgggttcaagtgattctcctgactcagcctcccaagtagctggggctacaggcacgtaccaccaatcctggctaatttttaatttttgtatttttagtagagacagggtttcacaatgttggccaagctggtctcaaactcctgacctcaagttatcctcccacctcagcctcccaaagttctgggattataggcatgagccatcacactcggcctacttgtgatcaatcttacttcatcttcacaccctcccatttctcttacgcatcctccagtttctctctctctctctccttctttttctctctctctctctcacacacacacacacgatctgctgcgacaccttaagaaacaagagattatcagggaatgattgaatattttgccgcatttcctattttgctgcctgtttaaactaaccttggttatactattaaaagaagacgcgtcgtatcaagccacttctgtgactatggctgtccagaaataaacataattaaaacatccaacagtagtaaatgctattggttaggaatgagcgaagtggcttagagtcaccggaagtgagaaagggtatagaaacagaaggtacttggtgtagatcaggggtgtcctatcttttggcttccctgggccaccccagaaaaagaagaattgtcttgggccacacgtaaaatacactagcactaatgatagctgatgagctaaaaaaaaaaaaaaaaaatcgcgaaaaaatatcatactgttttaagaaagtttatgaatttgtatcgggccacattcaaagccgtcctgggccccatgcagcctgtgggctgcaggttagacaagcttggtgtagagagtttcatctaaacttcatggcagctctgcagggcacccgttaggtccccagtattaatatacagtaaatctgagtctcagatctacgtaagtcacccagaagcacgcattctgcagtggcagagtcacgtttgaattagcatctgattgcaaagtctgggtgtctttacatgactacaggttatcttacctctcaagaggaggcaaccaatcaaatgttgccagcaccaatgaacttgtactttatttaggctcagaaagatcttttaggctaatgaaaatgccctatatttatgaaatgttctcgttctctgtggctttctcttttttgagacagggtctcaccctgacacccaggctggagtgcagtgatgtaatcatagctcactgcagcctcaaactcctgggctcaagcaaccctcctgcctcagcctcctagtagctgggactacaagcacgcatcatcatgcctggctgatattttttttaagggatggggtcttgctataatgcccagtctggtctcgaactcctgggctcaagcaatcctcctgccttggcctcccaaaatatgggattatacatgtgggctactgccagcctcttttctttcaattattttttaatctatgggttcccctcctttttgtttgtattttatttgttaaagaaagagagtactggccgagcgtggtggctcacacctgtaatgtcagcactttgagaggccaaggccggtagatcacctgaggtcaggagtttgagaccagcctggacaatatggtgaaaccccgtctctactaaaaatacaaaaatcagccaggcgtggtggcatgcacctgtaatcctagctcctcgggaggctgaggcaggagaatcacttgaacctaggaggtggaggttgcagtgagccaagatcccgccattgcactctagctgggcgacagagcatagtctctcacctttgggagtttactgcattgtttagcatgctctcctgtgccttgcattttccatagacaggcgtcagatctggaggcttcatcaccttcatcccccatctccatccccttttcttttgagcaagaatatgtcattagtggtaacggcacttcctgtagtggcccatctgcaggcatgtaatgtttataatgtctagtcagctctctctttttgtgatgttagggttaattagtagatttaggtgatggcaggcggacccatcccttaaaaattccacaagagctcttcatctgatatagtcagtcttgtggtggggaccctagaccagcatcatcatcatcacccggaagctggttaggaatgcatattcttgggccccatcccagtcctactgactcagaagctaatgcaccaggaaatgtgagccccattggcctaatggttttagcaattactggtagaacttgccaacttgccaagaccctttctttcttcctttctttctttttttttttttgagacggagtctcactctgtcgtccaggctggagtgcagcggcgcatctccactcacccactcactgcaagctccgcctcccaggttcacaccattctcctgcctcagcctccagagtagctgggactacacgcggccgccaccacgcccggctaatttttttttttttttttagtagagacagggttttgccgtgttagccaggatggtctcgatctcttgacttcgtgatctgcccgcctcagcctcccaaagtgctgggattacaggtgtgagccactgtgcccggcctcttccttcctttcttctttctttccttccttccttccttggcaaagtcttgctctgttgtccaggctggagtacagtggcatgatctcggctcattgcaacctccacctttggagttcaagtaattctcctgcctcagcctcctgagtagctggaattacaggcacatgccactatgcccagctaatttttgtattttttagtagagacagggttttcccatgttgaccaggctggcctcaaactcttgacctcaggtggtccgcccacctgggcctctcaaagtgctgggattacaggtgtgaaccaccgtgcccagcttgagacccactattagctttataaacagttacatcctagttttattgttctgcatgtattcgctggaattcttccatgtagaagggagtcttttttaagatagggtaactggagtcaggggcaggacactgttggtcttactatgagctaagccaaattcaataacaattttaaaatgcagaaaggaggattgttaaacttaggacaatacatgttgtctaccagatctttatttctctttctggatatctgaagtgattattcagatttagatgggatttcctcatttctctgcccttttttttttttttttttttttttttttggatgaagtcttgctctgttgcctgggccagagtgcagtggcaccatctcagctcactgcaacctctgcttcctgggttcaagcaattctcgtgcctcagcctcccgagtagctaggattacaggtgcctgccaccaagcccagctaatatttttgtgtttttagtagagatcaggtttcgccacgttggccagctggtcttgaactccggacctcaagcaatcctcctacctcagccccaacaaagtgctaggattacaggtgtgagccaccgcacctagccgccacttttttttcatcagctacgatatcaggtctcccagcagaaaatctctgagcaaatcaacttccaggtttgtttttcgtttttttgagactgagtttcgctcttactgcccaggctggagtgcggtgagaggcacaatcttggctcactgcaacctccacctcccgggttcaagtgattctcctgcctcagcctcccgagtagctgggattgtaggcgcatgctaccacgcccagcaacttttcgtatttttagtagagatggggtttcacatgttggccaggctggtctcgaactcctgacctcaggtgttccaccggccttggcctcccaaagtgctgggattacaggcatgagccactgcacccagcagcaggttcttaaaattagttttttaattattattttcagccctgaaaggaaaaaaataggtattggaatatctgccactcccattctgtcttgcaaaatctgcatcacccaaaaggttgggtttcaggagttggctgctcagctctagggatccaggagtgggacatgggtctttattctgtcgctgtgggatttggggcccaagcgtggggattatcagtgaattcaaaggagttgtgaattccctgctgaaggagggatgtcaaccacgcatagatcctggtggccatatgtcctcacttagccagcaactcagttctttggagcccagcagcaagaggtagaagggactgtaagccagtgtttccaggacagcccctgcagctatggtcagagagtcaggaacggggggccggacaggcctatagagtgtgttgtctctgtccctctcctcataaacacatctggataacgacagataacgtgaatctaccatccatgggcttcccatgtagacaggacatttaatgacctaatcttccatcaagagagacttccccttcttaatttagttaccctaaggaacaatttgtatagaaaacgcagaatcaagattttcacatttccaccccactttctgtacccatttaaaaaataatgcatttggggctgggcacagtggctcatgcctgtaatcccttcactttgagagcccgaggctggtggatcacttgaggtcaggagtttgagaccagcctggccaacttggcgaagccccgtctctactaaaaatacaaaaattagctgggtgtgatggtgcacgcctgtaatcctagttactcgggaagctaaggcaggagaatcgcttgaacccagaggcagaggttgcagtgagccaagattgcaccactgcactccagcatagacaacagagcaagactccatctcaaacaacaacaacaaaaatcattttgaacaaatgcatttaaatatatttgtctttccaccctttttggggtgttagggtgatggacatataattatttttcttattgatattcacactgtctcgtatttgaccagatagaaccctagtataatattttggtatgcagttttctagacttttagaaatgtacacacaaacatataaaatgaagacaaatactttatgacaaatattttaatcagctttattgaggtataatctatataaagtaaaactcaccgatttaaaacaaattcaagtttttttaagtgtacagcttgagtgagttttttcaacttaaaaaatttatttcttaattgacaaataatcatacatgttcatggggtccataatgatttttttagttgtttggttggatggttttgagacagggtctcgctctgtggcccaggctggagtgcagtggcatgattacaactcactgcagccttgacctcctgggctctagccatcttcccgtcttagcctcctgagtagctggaaccgtaggcatgcaccaccgtgccaggctaatttttaatttttttacagagacaggggcttcttatgttgcccaggttggtcttgaactcctggcctcaagggatcctcctgtctcagcttcccacagtgctgggattacaggtgtgagccactgagtccagctcttagtaatgttttgatattaatacatataatgtgtggggagataagatcaggataattagcatatccatcatctcaagcatttgccattacttttattttgctacttcctatataatgacatttatcatctctttgtgttgggaacattcaatgtccttcttctagctcttggaaacgatgtaatattttattgttcactttactcatcctatagtggatagaacattcttaatgagttttgacaaatgtatacagtcttgtaagcaccaccatgaccacagggaatacttttatcaccccgaaaggtggtgcctcttacctcttatgtacctcttctgtgcctcttactaatccattcctttccttgccactggcaactcttttttttaatttttttgagacagcgtctcactctgtcactcaggctggagtgcaatggtgcagtctcggctcactgcagcctctgcctcccaggttcaagtgattctcctgcctcagctttttgagtaactgggattacaggtgtgcaccaccatgcccggctaatttttgtatttttagtagagatggggttttaccacattgggcaggctggtttcaaactcctgacctcaagtgatcccccctgccttggcctcccaaagtgctgggattacaggtgtgagccaccgtgcatggcctcctctggcaactcttgattgcctgtcaccatagatatgccttttctattttgccattactttttttttttttcgagacagagtctcgctctgtcgccgaggctggagtgcagtggcgcgatctcagctcactgcaacctccgcctcctgggttcaagcaatcctcttgcctcagcctcctgagtagctgggactacaggtgtgtgccaccacactccattaatatttgtatttttagtagagacaggggtctcaccatgttgcccaggctggtcttgaactcctgacctcaggtgatccactcacctcagcctcccaaggtgctgagattacaggcgtgagccaccgcgcccggccgccattaccttctatctcaataaccacacttacgtttgcaccagcctaatagtttttcgtattgaaggagtaatagagcgtgtggcctttctggtttgtttcactgagcatgatgcttttgagactcatttattttattgcataatttctttccttttactgagtttccagttatataccttgggttgtttgtttgtttttaaggcagagtctcactctgtcacccaggctggagtgcagtggcttgatcttggctcactgcaatcttgacctcccaggctcaggtgattctcccacctcagcctcccaagtagctgagactacaggtgtgcgctaccatgcctggctaattttttgtattttttgtagagacaaggttttgccatgttgcttaggctggtctccaactcctgggctcaaggaatctgggtaattctatgtttaatcgtatgaggactcttattttgcagcgcacagttagacttgaccatcttcccatattagcacgtgtacacttacttccggcttcttcttcttttttttttttttttttgagatggagtctggctctgtcacccaggctggagtgcagtggcactatcttggctcactgcaacctctgcctcctgggtttgagcaattctgcctgagcctcccaagtggctgggattacaggtgcacaccaccacacctggctaatttttgtattttcagtagagacggggtttcaccatgttggccaggctggtcttgaactcctggcctcaagtgatttgcccacctcggcctcccacagtgttgggtttacaggtgtgagccaccttgtccagccctacttcctgcctcctgagcactgggtagtatttcacagtgtggaaatagcatggcttatgtatccagctgtatgttggtggacatttgggttgtctgacttttggtattttaggcgatgacacacatccctttctgaagggcctttgggtggtctctgttctttgaccacatacacaatactgcaggtctttgtacttggtgggatgtctctgcagaccgagttcctagacagggcaaggtgagtggttggtctgtcttccgggcttggttgtggtctgattctgaccctgttaccttattccacaggggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatgtgagtattgcaggcagccaggtacctactcctggcctcataaggaaagtaggcattagaaatgtgttgggagggctgggcacagtggctcatgcctgtactcccagcactttgggaggccgaggtgggcagatcacctgaggtcagaagttcgagaccacgctggccaacatgatgaaatgccgtctctactaaaaatacaaaaagtagccaagggtggtggtgcgcatctgtaatcccagctactggggaggctggggcagaggaattgcttgaatccaggaggtggaggtgcagtgagccaagactgtaccactgcactccagcctgggtgacagaataagactctgtctcaaaaaaaaaaaaaaaaaggaaatgggaggctgaaggtttgatcgagggagattgcaagatgaggtggaatcattccaaggtgggttcacatctcagcccttgaagaggttatttcctctctcgaagccttggttttcctatccgtaaaatgggaataatcaccctcattacagacaggaggtgtgacaatcccatgtcatcacatgtgccaagtgccaagacgtatgataaactctcaacagatttcattggcatcgttctctgtccttccttcctcttgaaagtaaagaagagctcataaccactttggaaaggctggtttgtcttggcagccaggtgggtaggagacatgaggatgtggctaggttttagggaggccttccttgtcacagaggggaatgttcaggttggtcgtaggactattttaggtagacttgcagaacagagtggactagagatggcacaatatggtagccactggccactcgtggctaactaaatttagatttaaattaattaaaagaaacattagaccaggtttggcgactcatgcctgtaatcccagcacgctgggaggccaaggcgggtagatcacttgaggtcaggagtttgagaccagcctggccaacgtgatgaaaccctgtctctactaaaaatgccaaaattagccaggcatggtagtgcacatctgtaatcccagctacttgagaggctgaggcaggagaattgcttgaacccgggaggcagaggttgcagtgagccgagatggtgccgttgcactccagcctgggcaataagagcgaaactccatctcaaaaaaaaaaaaaaaaaaaaaagaaacattaaaaaatttattagctgggtgcgtgggctcacacctgtaatcccagcactttgggaggccaaggtgggtggatcacctgaggtcaggagttctagacaagcctggccaacatggtaaaaccccgtctctactaaaaatacaaaaattagctgggcatgatggtgtgcgcctgtaatcccagctacttgggaggccgaggcaggagaatcgcttgaacctgggagatggaggttgcagtgagccaaaatcgcgttattgtactccagcttgggcaataagagcaaaacttcatctctaaataaatacataagtaaaagacaataaaaaataacaaatttatttcttttgttgtgttggccctaggtcaagtagtcaatagccacctgtggctagtggctggtgtactgggtagcataagtgcagaatgttcccattatcatagaaagttctgttggactgcttggactagatgattggggcttggagtgtgatgttgtggggcacgggtcgccagactgatgtgcagaggtcacccaacccggcctatgtctatgtcttctctctgaaaggccttgctcaccctcgagcaggttacctcatgcctctgaagctttgtttccttttctgtaaaatggatgcaagaatagtgccagcctcttgggagccgggcatagtggctcatgcctgtaatcccagcactttgagaaactgaggcaggtggctcacttgagcccaggagtttgagaccagcctgggcaacacaacgagaccccatctctgcaaaaataaattagccaggtgcagtggtgcgtactcataatcccagctactcagggaggctgaggcaggaggatcacttgagcccaggagttcaaggctgcagtgagctatgattgtgccactgcactctagcctgggtgacagagcaagaccttgtctgtttcaaaaaaaaaaaaaaaaaaaaatagtaccagcttcatggagtgggttactctaaatagaaagcacttaatacacttcctgctacatgttaagtgcaggcactgaaaatgttaagtgttactagattggtttttgctgtggtcatgatcacttttgattttactagtaagatgttcttcttccatcacttggcatccttgtgtctctttggttctggtctgtacattttgccaaatgaaaattacaaaaagccccttgtcatctctaaaaatgtcctgcacatttttttcctaattaggaaactaagacacgttcactatggaacacttggagagttcagaaagcatagtgaacacaaaacagaaaaattagtccttaaccagagatgcggtgcattctttgtctctttgtgagcatggtatctgtttacatatttaaaagcctattgggcacacagtttagtgacttgctcttttttccatttggaaatgctcagtgttgacttgtgtaatatatctcaggaagccccaaagataccccttgtaaggggtagtatagaatctgtcatggggataggccatttttccactgttcttatagatatttcagaaggagttagagtggctttttaaagagccaaatggtaagagtgagcaacttagcaactcataacttttttttttttttttgagatgggggcttactctgtctttgaggctggagtgcagtggttctatcgtagctcagtacagcttccaagtcctggattcaaacgatcctctcacctcagcctcctgagtagctgtggaccacaggtgtgcaccaccacacctggctaattaaaaaaaaaaaaaaaaacttctgtagagactgggatctcactatattgcccaggctggtctcaaactcctggcctcaagccatctcctgccttgacttttcacggcgctgggattacgggtgtgagccactgtgcctggccgtaactattaaatatgtcctccaatccaagtgctgtacattgacacattgtattttatttaacacagcatcccctgagttaaaaatgtttgccccttttagggaaggaagctgaggtgcagtgttgcaaaatgtatctttactttcttaagtaggggaagtctcttgtctgtggcactgtttgtatggaaaaattattgatctggggctgtttgtatggtggacattttctttttctttctttcttcttttttttttttttgagatggaatttcacttttgttgctcaggctggagtgaagtggagcgatcttggctcattgcaacctccacctcccgggttgaagtgattctcctgcttcagcctcccgagtagctgggattgcagggatgtgccaccatgcctggctgatttttgtatttttagtagagacgggtttcaccatgttggctaggctggtctccaactcctgacctcaggtgatccacttgcctcggcctcccaaagtgctgggatcacaggcctgaaccaccacgcccagccagtatgttggatatttctaaagaggcccgtctgtagggagctagagggaaaattggactctttggggcccaggtcttccatctaagacgtatcatcaccatctagggagtttcaggacaggcctgtgtattcatctcacctgctgtcctcaaatagaaatcagaaaaaaaaagggcatatgaaggtcctgagacccaaaatatcttctgacagcagattaaaaataaatgaatcaaagcttcaaattcctgctatgcttctctggacagattagattaaaatcctttcagccttgtgatgatggtcccgctcttctcttgttcctttctggtcagtttaattgcttaatagaaaccgtcgtccatgacggagaagataaagaaggaaaggggttggggtgggggagcacagtaacttactctcccagcccataatagcagcatgcatgagtcttgttaataggcgggtagtgaggtgataccaggtccgtggtctggcatgcatgactttgccctctgtgatgaagataaactttctcctccgttctgcaaggctcgcctcaaacgatgtgcccttgagaaggttctggcagacctcttgtgctcttggatctagaagagtctatagaagccagaggagctttcctcctaatcttagagatgcaggttctgggctcagcaatgtccagcagtctacctaaactgctgaagaccgtttgtggcatacctggcggggagcatggctttgacgcctggtcctaagggtcccttggtcttctgaatgctgtcttttggctgagttcgtctgcctcgagttagttagttcgttcctcccttccttccttccttccttccttcctccctccctccctccctctctctttcttcctttctttctctgtctttctgtcttcttttttctttcttcttttttctttttctttcttttgagatggggtcttactctgttgcccaggctggagtacagtggcatgatctcagctcactgcaacctctgcctcctggaactcaagggatcctatctcagtctccttagtagctgggactacaggcatgtagcacgatgcccagctaatttttttgtgtttttggtagaggtggggtcacaccgtattgcccaaacagatctcgaactcctgagctcaagcaatcttcaccacttcggcctcccaaagtgttaggattacaggcatgatattgtgccactgcactccagcctgggtgacagagtgagactacatctcaaaaaaaaaaaaaaaaaaaaaaaaaaaagatgaggttgctgaagctcagatgtgcttagtcccaccactggaaggtgggcagagctgggattcagacaaggtctgtgtgagtccagggccagggtgactacctgtgattagtagcaaagggctcttggggtaataggcttagagcaggaggtgatggtcgtgggctggagcaggaggggacagtgccagaggccttgttagctttgaggtagacaagctttaagtgcagagcaagaaggaattgaaccttttattatgattccttgagcacctaactaggtgctagactaatgattacaacctgctaacacagaggagtgatttttgtttttaaattgagttaacttaatatatcaaaaaaagaaatctgtttctggcattgctcgaaaaagcagaggacctgacactgcagaatgcagagtgcgagtagcagtccctgtgagatgggctttttgctctgcttttccgcagacctcaccactccctgtcgtctcccaggccatggtaaccattgaccgtggcacctcttttgttcactcacacacgccctgcttcactcatgccttacctgctttgtctctgtagacagtgggaccctccaccctataccaaacctctggggttgggaaaatcatgatccagagccaaggtggatgggcccccctgctcattggaactccaagcccaagtccccgaaccatgaaccccaaaggacatttttccagttctggttctgcttctggaatgcccagggggtcaggagaagccctccttccaaactttagcaggtgacaatttttccgccttagagacctggcccagcaatcttagcctactctggaagcagtgtccacccggggacacaaggaacaagcagattgtgaacagaggcctcctgggtgccagccactgcactggtccctagagggtagaaagacactgtaactggaagctgccctttgtcaagccccaagcattagcccttctgatctttttttttttttaacatggagtctcgctctgtcacgcaggctggagagcagtggtgtgatcctggctcactgcaacctccatttcctgagttcaagcgattcttgtgcctcagcctcccagtagctgggattacaggcacatgccaccacgcccagctaatttttgtatttttagtagagaagtggtttcaccatgttggccaggttggtcttgaactcctgaactcagatgatcctcccacctccgcctcccaacgtgctgggattacaggcatgagccactgcacccagccttctgatctttcaagtcattattgcttcaaagaacctcctccagtaatacaaggataatctatgcaaagacctcaggagaatatttaaaaataagtatgtatcacaaaaagcagccctcttccctggaggcaaacatgattcacaggttcatgtatgtacacacacacacacacacacacacacacacacacacaccccaaacataagaaaaagtcactccttgtatgttttgcagtatgattttttttccacttaaccctaccttatagttttttctgtctgttcataactatctagtcagacttaaaatatgtttttgaataggtaagacatgcaaatatgaaataaaatagtgtataagggaatatagaacttcccccttcgttcctatttctcgcccttccagttccccttcttagagacactgtggttgctggttacatatgtagccctccagtcatgttatttatttatttatattatttttcgagatggagtctcactctctcacccagactggagtgaagtggcatgatcttggctcactgcaacagccccctcccaggttcaagcaattctcctccctcagcctcccaagtagctgagactacaggcgtgtactaccacacccagctgatttttgtatttttagtagagagggggttttgccatgttggccaggctggtctcgatctcctgacctcaggtgatccacctgcctcggcctgccaaggtgctgggattacaggcttaagccactgtgcccagcctattgctttttttgtgataaagtctcactctgtcacccaggctggagtgcaatggtgcgatctcggctcctgcaacctatgccttctggattcaagcgatcatcccgccccagcctcctgagtagctgggattacaggtgtgcatcaccacacccagataatttttgtattttttgtaaagatgggtttttgccatgttagccaggctggtcttgaactcctgacctcaagtgatccacccacctcagcctcccaaagtgctacaattacaggtgtgagctgctccatccagcctccagtgatgttttatacacatgcagccacatagagagcccctcctgcacccctccaaaatggcagcacaggccccggctgttgtgcgtctcaatctttgcatctaactgtgtattttggccattcatccatggtagtagagagagggccactgcacagtcttctgctatagggatgaaccataatgattaagcctgtctgctattgacaggtatttaggttgtttctagtctttttgctcttaaaagcaaggctgcagcaaaagcacgtgcttggtggaccacgtctgtctctaggttgggtatttagaaagccgtgatattgcactgcagcttcataaagaagccgtgattatccatcactttactgaggaagctcaggggtaggtctgtatgcacaagtcaggcaggtgataaggcaaagccaacactctgcccaggcctgtgtgtctttttttttttgagaccaagtctcgctgtatcacccaggctggagtggagtggcacaatctcagctcactgcaacctctgccacctgagttcaagcagttctcctgcctcagcttcccgagtagctgggattacaggcacgcgccaccacaccttgctaatttttgtatttttagtagagatgaggtttcactgtgttggccgggctggtctcgaactcttgacctcaggtgatccacccaccttggcctcccaaagtgccgggattacaggtgtgagccactgcgcccggccatccctgtgtgtctgaaagccagtgttccttccacttccctcccttccctccctgttcctcatttctgctgcaggccccgggagcaccccctgctcagggctctgtggctgaccatataaagcgtcagagaaaaactggagctgcttcctaatacggtcacaagagggaaatcctgggcctgcagctgggacttgctggtggcacagggcccatgagatgccggctgggacacaggaggctgggatgttgaaacctctgaatttaaccagctggagaggggctcgtggggccagagaggcagaaacacagccaactatggttgggctgggtcgaggtgaaggagaagtggctgaataatgtgggaggaagagcccgatgctgaagccccacgaccctgccgtgagatgtgcggctgcctgcaccagtcttaccttcactccatcgtcataccctggcttgcttagaaagcttttacagaactcagcagagattcagatctacctggaagtatggattaagtgcttgttgtgtgcacggcactgggagagatgtcccaaacaaagaggatggaagtcatattcctctttcagaagctagtgatggagttgaaaaggcagtgtggtccttccttctttttaaaaattcattttattctttttttttttttctttgagacagtctcactttgtcacccaggctggagtgtggtggcatgatctcggctcacataacctctgcctccttggttcaggtgactctcctgcctcagactcctgagtagctgggattacaggcatgcgccaccacacccagctaatttttgtatttttagtaaagacggggttttgccatgttagccaggctgttctcaaactcctgacctcaagtgatctgacctcctcgatttcccaaagtgctggcattaaaggtgtgagccaccatgcccggcctcttccttctttttaaaaattccttttattcttttcttttctctatctctcatctctctttcttcctttctttcttactttccttccttccttccttcttttttttttttttttagagtctcactctgttgcccaggctggagtgcagcaccatgatctcagctcactataacctccacctcctgggttcaagtgattctcctacctcggcctcccgactagctgggattacaggcgcctgccatcatgcctggctaatttttgtatttttagtagagacggggttttgccatgttggccaggctggtctcgaactcctgacctcaagtgatctgacctccttggccacccgaagtgctgggattacagctgactgagtgtctaccctgtccctggcactgtgcggggtgcaggagatacagtagtgtgtgggtcacagtccaggaggtaacatttaggcagagctctaaaagaggagagggaaccagctgtgggaagatgaggggaaaagtgttccaagtggagagaacagcatattgaaggctctaaggtggcaagacttccctctcgtgaaatgaagggagcatagtaagagtcactaaataacattgattgagcacctactacataccagccgccatgctaaatgcttttcgagcattatctcgcagcacatctatgaagggcttgttcgtatgcctccctgttttgtagatgaggataagtgagactcagagaggttaagggacttgcccagggtcacacagcgaagaagtagcaaagtgaaggttcaaattcaagtaccccatacccagttctgagcccttagccactgccctttactgcctccaggtcaagggcttgagtgaggacaggttgggctgtaaatgatacctacattcaaaaggggcgtggcagtggacatggccccagaggagctggagatggagtcgaggcctgaaggagggtggggcttgattgacctttgttcaggtgaccacagactgggctcttctctttgggaggcttgtcctggggacaggggacactgattgaacaggaaatagcccctggcctggctcagtgtagtccactgagtacctactgccgccgtgcaaggcccccaggtcacggaggtgaagtcaggctgtccctgctcccaggaagctgtatcattaatttattcccctggcatgcatttagcaagcatttagttagcacctattctataccaaggcctgtgctgggactgaagaggagaaagggggttccccggactcaaggcacttgcagctggtgtttgcaggatgggtgggagggtcctgggtgatggaatggggaagaggggtgtccaggcaggcagccccccactcccagccccaccaggctggatgttgctcctgggccccgcttacctctaacccttgctttgcttctccatttcggtccgatggagccgcttataccaagctgcttatagttcacccccacggaccccgtgtcctgtttttctgcccatgtccctgctttgtcttgagctggttaacaccttgttgtcctttaagactcagtgcagggaatacctccccacctggaggtttccctgaccacccccaatgtgggttagggccttcccttccttgttcctatcattctctgttcttacgacgtgttttaatgtacttgtctccccctctgatttaagttctttaagggcaggagctatcattgatttctttatctccagcctctgacacagatgtggtatatagtaggtgctcagtaaatggttgatggctatttagacaggcatatgttgactcattcattctccttttaggggatggtgagaacctccgtctccatcaatcctgtttcctttttttttttttttttttttgagatgggttctccctctgtcacccaggctggagtgcaatggcaccaccttggctcactacaacctccctccacctcccaggttcaagtgattctcctgcctcagcctgccgagtagctgggactacaggcatgtgccaccatgccctgctaattttttgtatttttggtagaaacagggtctcactgtgttgcctaggttggtcttgaactcctgagtgtgagcaatctgccctccttggtctcccaaagtactgggatcataggtgtgaaccactgcgcccaacaatcctgtaccttcaaagaatattcctctgcagcacccccagacattacataccattgtccctgagtggactgagccctggaaggaccttcccactctctctttttctttctttttcttttttgagacaaggtctcaccgtgtcacacaggctggagtgcatggcacaatcacggcttactgcaacctcaacctcccaggcttaagcaaacctcccacctcagcctcccaagtggctgggactacaggtgaatgccaccatgcccagctaatttttaaatttcttatagagatgggggtctcactgtgctgcccaagctggtctcagacttctgggctcaagcaatcttcctgccttgacctcccaaagtgctgggattacagttgtgagccaccacacccagccagactttcccactctctaattggctccagcccttgactaaaaggcccttgagggctgggatcctgtgtttttttaatgttctaatgtagtcccagcaccttttgcatggcatctgggacgtacagaatgaatgaatgaatgaatgaatgaatgaatgaatgaacgaacgatcagtagtttctgtttctgttggatgggcctaggctggatagcataatggaccatgctcatacctgggggcgggccaggctgggcttggtgctgccaggatcttctttggtgacctcggtcaagtcacttaaccctctgttgcttggttcaccctagctgtaactgagagatggatctgtggttctccctaagtcacttgcagggaagaggatacgctttatggccatcagagtcttgggcagtactgatgtttatcgtttggggaaagcagttcctgtgagacgggttggagcctgtctcctgaactgtgacctcaaccatgggaaaatctagtatccagtaaggaaaaatcatgacaatagtgccttaccacgtacagcatggcgggactcgccttgtgccttgactcctccgtccctgatctgattattttcagatgctcctattcacccagtagaagaggactgctattttttaaatggtaaagtgcatatgacataaaatttaccattttaaacattttaaagaaaacagtgccattaagtgcattcacaatgttgtacagctatcaatttcaagacagggtcttgctctgtcacccaggggctagagtgcaatggtacaatcatagctcactataaccttgagctcctgggatcaagcaatcctcctgactcagcctcccaagtagctgggactacaggtgatcaccaccatggccagctattttttttttttttttttttttgtagagagggggtctggctgttgttgcctgagctggtctcaaacacttagcctgaagcaatcctcccaccttggcctcccaaagtgctgggattacaggcatgagccactacacttggccccagagcatttttatagcctcaaaaggaaaccttatacccatgagcagttcctcctcatttcccacctctttccagcctctgggaaccacaagtctgttttctgtctccatggctttgcctactctagacacttcacataaatgagatgatagagtacgtgacttttcgtgcctggcttctttcactaggcatattttcaagcttcatccacattggagagctcatgtcagtgttggtctctgttttgcagatggggaaggtattaatgatcaggagcaggcgctgtggggtaaacaggagttctagttcccaacttccctccagctgtgtaacctggtgacaacctcaccatgcctcactttgccctcctgtcaaacaggcggtggggaaatcactgttactgagtagttgtgaagatgccatgcggagatgcctctgccatcttctagagactgagtcactggggtttcttcttagatatggacattgggaggtcccagaaagagatcagagggtggtgggaggagagagagcttggaggattattaccttttcctccctccctcctggaccacagttttggcagctgtgtttctgtatgactgcggatccctctggacagcccctttttaggggtgtgtggctttctatgcctccaatgttcagttaacgacattccctctctggctgagtgcggtggttcccacctgtaatcccagcactttgggaggctgagactggcgcatcacctcagctcaggagttcgagaccagcctgggcaatatggtgaaaccctgtctctacaaaaaacaaaataaaaattacctgggcatggttgtgcacacctgtggtaccacctacttgggaggctgaggcgagaggatcacttaagcccagaaactcaaggttgtagtgagccaagatcaccccactacactgcagcctgggcgacagagcaagaccctgtctcaaaaaaaaaaaaaagtaaacaacattctcttctgttcttgctcttcagacttaactgctcccgtcactggttgggtttctttaattctgcacacatatctgtaaacactttctttattaaatgttcctgagttaatatcttaagcacactgttcattttctgtgccacctgttaaatgatgagcatttaatatgattgtcagcatccaaaaaagatcctgcgtagtgcttagttcggtgcccaacacatagtaagtgctcaatgaacggtggctgttatttaagccagtgaggtccggggaggtaaagtggcagctcggaggagtggagctgagatttgaacccagagctcttcaaaactccacagtttggccaggtgcaatggctcacaactataatcccagtgctttgggaggctgaaatgagagaattgcttgagcccaggaatttgagaccagcctgagcaacacagtgaaacccatgtctctacagaaaatataaacatcagccaggcctggtggcgcccgcctgtagtcctggctactcaggaggctgaggtaggaggatcacctgagtccagaaaggtcaaggtttcagtgagtcacgttcacaccaccgcactccagcctaggtgacagagtgagaccccatctcaaaacaaacacaaaaccccccacagttgcaaaataaaacataggcagcttggaaacccactctcgccctttctcctcttcccacgtacctggaatatcagtgaggcccagggtttccactaagactccaagctccagtttccccatctctaacatgagaatattgagtgcttctgtgcaatctgtctaccctggaggaggtctggaagtaagctgggttctctgtctgcagacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaaggtgagtgaactcagggctgcacggggccagctccagggagcccctcctgtcctgcttgtctgcagttcttgccaggaatgtggagtttggcaggcactgcgagggaccaggagttactgtggctgaaaaagggaaaaagcaaaaggaacatctgtgtttgcagcctgggagggtgagggagagccaagagcttgggcaaatacgggcatgggcccgctccagctccagctccggggctcgctgcccaagggccccgtcgggccagctgtctgcaaaggatggaaagagggtggggaacagccctggggctgagccattgtggtctgtgttgacacctacctgtccctcaacccctgtgggactgtgggtaaatatcttttcctcttcagcctcagtttcctcatttgtcaaaaggggtgatagtctctatcttgtagcttcttgtgaagattgttaatgctggtttttccaaacttaagacttgtgcctattactttcatgtttatacgttattatttttactattgttttattatttttgagacagggtctcactttctcgcccaggctgaagtgcagtggtgccatctcggctccctgcaacctccgcctcctgggctcaagcaattctcctgcctcagcctcccaagtagctgggactataggtgtggactgtcatgtcaagctaattttaaaaaggtgggtttttttgttctgtttttgttttgttttgttttgtttttggaagtgacaggatcttgctatactggttggtctcaaactcttggcctcaggcgatcctcccactttggcctcccaaagttctgggattataggcatgagccactgcacccaggccttctcaccttctatttagaacactttggagcccctgaaatagccacccccaagtcaaacagagggactaggcagttaatgcaaacaagtgtaccaggtcaggcgaagagtacaagaaactcgaaaactcacaccccctctgaaagggcaccaacaggtgggaacccagggatctgagttgggagttgagaggagcccaattctggaagttcttgaggcaggaatccaggtgtgcctgagagatgccacgaccccgcccccaaggtagagggactcaggtataagtgccccaactttctgacagttagccagactccacaggtaggaccagaatcttggcccttctaggcagggcctgccattacctccaaagaccagcaggtggagccttgcaaaggcaatcttggagctgtaatctcaggttgtaaagtgacggctcctggagtcaggtatctgtctttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcataagccaccatacccagcaattcctggttcttttctggagctgaggtcccactaagcacattttaatctaaataccaaaaagaaagaaaattctgttagcaaaggagaaggagggggagcgacagatgggtaagcatttctacagtgctctgaaaaaatttatttgtaacttgaaaaagtctttaatattgtatattcattctagaaaaacttaaacatatatttaagtaaaagagaacttgctggcacctatgattctatcatccaaaactcatcaccattaacattttgttacgtgacctttcattacactaactgaactaaatggcatgaaatgaaggaaatttttactatctgaagataattcgttccagaaaaagatcacttaaaacagagaccaaagtttcactgtagatagtatgtgtgtggaggagggaaagagagtgggcaaaatatttgactgagcttgaaaaatgacattgcaggccaggcacagtggctcacgcctgtaattctggcactttgggaagcccagatgggtggattgctcgaggtcatgagttcgagaccagcctgggcaatatggcgaaaccctgtctctacaaaaaatacaaaaattactttggtgtggtagcacatacctgtagtcccacttcttgggaggctgaggtgggaggatcgcttgagaccaggaagtggaggttgcagtgagccgagatcacgccactgcattccagcctgggtgagagagccagaccttgtctcaaaagaaaagaaaagaaaaccaacattgcaaattataaaaataggttaatttcagcttacatgtaataagaattttattttaattacaagtaggtgctaatttgtagattcagtataaaatgaattaagagtgggtgtggggtttttttctgtaactttttctgggctgagggatgaaatcatgtgagcataaaacgacatcttcatgtcatgcttgacttctgcagcccgagctaaaaaggatcattcttacagatttatttgatgggtcaccagttttcctaagggcttcttttacttctttagtgtttaagtctctcaaagcccctgtggtcttagcgttcattcagctgtgaattgccctgaatctttttctttcttttgtctttctttctttctttttttttttttttttccggatggagtttccctcttggtgcccaggttggagtgcaatggtgtgatctcagctcactgcaacctccacctcctgggttcaagcgattctactgcctcagcctcccaagtaactgggattataggcatgtgccaccacacccggctaattttgtatttttagtagagatggggtttcaccatgttacccaggatggtctcgatctcctgacattgtgatctgcccgcctcagcctcccatagtgctgggattacaggcatgcaccatcacaccaggctaattttgtatttttagtagagatggggctttaccatgttggtcagactggtcttgaactcctggcctcaggtgatcctcccacctcggcctcccaaagtggtgggattacaggtgtgcaccaccacacttggcccctgaatcttttttttggcctttccaaggccactgactttgccagtcactgcaccttgttttccagaactgccactttgttttgtgttcatatcatgatggtggctattgatacccaataattggcaaggtgaagccactgaatcgtcggagaaggaggtttcggtggagtttgatcgctcttgtagtcattgaagaatacttttgtgttgtggggacttttgctttcctagaccagcagtccccaacctttttgacaccagggaccagtttcatagaagtcagtttttccatggaccgcaggggagagatggttcgggatgattcgagcgcattacatttattgtgcactttatttctatgattacattgtcatatataatgaaatcattatacaactcaccatcatgtagaatcagtgggagccctgagcttgttttcctgcaactagacggtcccatctgggggtgatgggagacagtgacagatcatcaggcattagattctcataaggagcacacagcctggatccctcttatgtgcagttcacagtagggttggtggttctataagagtctaatgccgcctctgatctgagaggaagcagagctcaggcagtaattggagtgatagggagtggctgtaaatacagatgaagcccactactcacctcctgctgtgcagtaccagtcggtggtttgagatgcctgcgctagaccacctcttaactgtgaggcaatgttgtaattgacaaggacaccctgtgttcatatatttgattcctcatggtctctaggttttaacacaaaattgcatagtcagctctcttgaaactacttagaaatgctcacttgacacatagtaagctccaataggaaatgactatcatgattgagcacagcagcatgtcttcagtcctagcactttgggaggccaaggcaggaggatcacttgaggccaggagttagagaccagcctggccaacatagtgagctcttgtctctacaaaaaaataattagctggccacagtgcgtgagtctgtagtcctagctactctggaggctgaggcaggaggatggcttgagcccaggacttcaagaatgcagtgtgctatgatcgtgctatggtactccagccttggcaacagagtaagaccctgtcacgaaagaaagaaagaaaatgaaaaccgtgaatatgcacatccataaaagataaactctttacttaatttaaatgttaaccaacacctgctatgccctcgtctattttggcatgacctggtgctttctggcaaatcattgatggcggactccaaaaataaaaagaatcgggcacggtggctaacgcctgtaatcccagcactttgggaggccaaggtggggggatcatgagatcaggagatcgagaccatcctggctaacgtggtgaatctccgtctctactaaaaatacaaaaaaaactagccaggcacagtggcaggcgcctgtagtcccagctactcagggggtgctgaggcaggagaatggtgtgaacccaagaggcggagcttgcagtgagccgagatcacgccactgcactctagcctgggcaacaaagcgagactccatctcaaaataaataaataaataaaaaataaaaagaatgtcaaaaataatggagaaaaatttaagcttgggaagaattccgttcacctgcttaattttttctccattcccaagtaggaaattggtttttgtgaagaaacacgtaggcccagtgtgttgactccattgataaatggcacgatctcattctgttaagtcactgggctgcgatccacactaagcttaccatgaaggtggagagagaaagctagcacatgtggcttcttccttgagttcttcatggaaaagatggggtgtgaaaaggcgggattgaggagggatgggtaacacacatgcactgaatataagatgaagcattgcagttgtgtcacatagacagtaagttcctgaggacctataaactccatccttcttgcatgtgcatcattgtatctccagcacattttctggtgcctggcacatagtagctgctcagtatttgttgaatcaatgaattattagagttatttatagaaaagaacctaccagggtcaggatggatggggtgggttatttgagagaggtggggctttataagcctcgaagaatggtttgctaaggtgagagaagggggcagggatggctttctagccaagaataataaaagcataaatgtaggggtgagaatgggtatgatgagtgtggcaggagctggtttagaggggttgactagtatactgtggcagggagctcagagccagagctcagccctttgctgcctcacaggagttgggaaaatgggagggactttctaagagatacttcacaacatggcaccctcccaagtggaagccaagccccttgagggtatgggaagagaagctgatatttaaaatatgtatcttatatctgcatatgcataaattatgtcatgtttattttttaaattctccccccctttttttttgaggcagagtctcgccctgccacccaggctggagtgcagcagcacgatctcagctcagtggtatgatttctgctcactgcaacctctgtctcctgggttcaagcaattcttgtgcctcagcctcctgagtagctgggactacaggcacacaccaccatgcctggctaatttttgtatttttagtagagatggggttttgccatgttggccaggctggtttcaaactcctgacctcaggtgatctgcccgcctcaacctcccaaagtgctgagattacaggcatgagccactgcgcccggccgtggtttgtttttggaaagatgttacatacaaattcaaaaggtgaacttctcccttcaacccttgtgcattagacccttagcttccctcccaagagacaattatggtttctagtgtatgaggttttctcctagagatatttttgcaagtataagcaaataggtatctattttcttccctaagatttccctacaaatactagcattccatatatatacagtcctatattttgccagaggatgttacatatcagtgcatgtaggaattccttgttcccttttttaaaaaattggtttttatttttgttaaaagtattcatgcagacggcttagagtcaagtaatttttgaaggcttattaagaaaaatagccatcctctgctacttctcaactcctttaattgattttttttttttttggtatttaccaccatatctctgaaaacaacacttgatcattgtgctgctatcttaattttgttttcaattttaggtatcatctattgactttcctccatgaaagatgaaatttagctcattcaccctctggatttgcccctatttcctcgttccaacacacatgcctcatatcagagtcccagtataattttatcttagttttgacaaactcagtgttcagagtttccattattatgactatgtaatgctatctagagtttacattattatgattatgtagatgttattcaaagctgagctttgcactgctttgtgactatttttcttctttctgtatgacttttctttttcctggagttagcaattgccttttttttccccaatcttgttttccatgtatttaaccaccaattctgccccaaaatctctttctaaatgtgttaatctccttttaatatgtccagacatgtattggatatcatattgatatcatctccttgaatgtgatctctactatagccttctgatctgccctggctttctctatagctagtaactgtcatataggatctttttcaccatccttgaaattccccttagtgctttcatagtggattccttgtttcccagttttcatgtcttcctctttcttgctttactctcctgcttaaatcaagcactttgtccagtagcttcccaagaaagaatgtacgtgatcttgaggcattgagaacttccatatctgagaggcttgatgcttctctaacacttaaaggatagtttagttgggtttaaaatttcaggcaagaaagttgttttcagaaagttataaataactttttttgcctgagctttttaaggcatttgtgttgttgccttctagtttcagttttgagaagatgaaacccaatctgattcgtatgtgtgtatgtttgtgagtgtgtgtgtgtgtgattatattcaccttcctggctgggaatattcttgatcctttgtacatgaccagtttttgtttttcctccttctctagaagcttttagactgtctttgtacccctattcaggatgatgggacttgctatgagtccatttttatttgttatcctggacacttagtggcccaattaatctataaacgtgtgtccacaaattctgggaaatgttgcaaattatttcattgatgctgtctttctccctgtgttctctgtttctttttcttagaagtctttttatttccataatggaattcctagaccaatcctataatttaaatctctttcttttgtcattttcatcactttaatgtttttaatggtattttctgggcacttacctcaacttttttccctaacccttccattgcgttttaaatttctggtatatattttattaaattccaaaaattctattttatttttaaatgtttctttcatatgacattctttttctgtggttgcaatatcctgtttctcagaggatatttaatgcagagtctatttcctccaagatacatattttcctaattgttttaacttctgtctgtcatattagtggatttcttcagatgtcttgggattcttggctatccattcatcttggatgctttagtacacaggataccaaattgttgatggaagctcagtgcttataggatgggcttgctgatgtgcttggctataatatgaaagcactgggctaccccattaggacacttctgtttcgtctttcagtcttttgttcatgggctaatctgattcttcagagaaggtttgtagaaaaatcttctgcctggaggttaaagatttgtctagcatcattttgagggtctagttgaaaagaagctgagggtttcaaaatgtgcagtgaaatttgtacattataccttccttctttcagtatggttcctggtgtccccccaggacggagaccctctgtttaaccctcaccagagactaaacccaccaccttctgtggggtgtgagaagggcagtcacttggcttcagggagtgtagaagatatgggaggggtctaacagtgccttatatttgacccagtccttatgtttttgtctcctccttgatcttttcttccagaggcccctggcattgccagtttctgaggtttggggcagaaatggggaattcggtgttgaaattaggtcgtttctcacctttcctcactgctcacctagacttttttcttggtacctttttttttttttttttttttttttgagatggagtttcactctcgttgtccaggctggagtgcaatggcatgatcttggctcactgcaacctccacctcccgggttcaagtgattctcctgcctcagcctcccaagtagctgggattacaggcatccgccaccacacccggctaatttttgtattttaaatagagatggggttcaaccatgttggtcaggctggtcttgaactcccgaccttaggtgatccacccaactcggcctcccaaagtgctgggattacaggcgtgagccacggtgtctggactttttcttggtacttttcaacgcttatcccattttctgtcttccaagatggctttgctgttctcccctctctagttctttttaaactgcctcatgtatttttacactttttggtttgtttgtttttttttgggggatggagtttccctcttgtcgcgcaagctggagtgcacgatctctgctcactgcagcctccacctcccaggatcaagcgattctgcagcctcagcctcctgagtagctgggattacaggtgcatgccaccatgcccagctaatttctgtatttttagtagagacgggttggccaggctcgtctcgagctcctgacctcaggtgatccactcacctcagcctcccaaagtgctgggattacaggcgtgaaccaccacgcccggcctttttacacttttttttttttgccttttcccccctcttttgtgtggagaatggggtcttgttatattttccaggcaggtcttgaactcctgggctccagctttcctcatgcctgtgccttcctaagagctgggattccaggcatgagccaccatgcccggctaaactggttcatgtatttttggaaagtcttttacagttattttagtaaggtttaggaaggaagagagctaaatgcatgcactcagcctaccatcttctcatgggaattctctcatgccttcttttacaaagaagtgataataataatcatggatttttattatatgcttcctataaagctcagggctttacagaaatattctcagttaatctttaccacaaacctacaaggtggacaggaccagattaggaattttaaaattaagccctgaaactattaaggtgcaggcatatgtcataaaaaaaaattaaattataaagtaaagaaggctgacaaaattgtttttgtttttgctttttttagagacagggtcttgctctgttgcccaggctggagtgtaatggtgcgattgtaactcactgcagcctcaaactcctgggttcagcaatcctgcctcagcttcccaagtagctgagactacagagatgtaccaccatgctcagctaattaaaaaaaaacaactgttttttgtttgtttgttttgagacagagtttcacccctgtcacccaggctggagtgcaatggcacgatctcagctcactgcaacctccacctcctgggttcaagtgattctcctgcctcagcctcctgagtagctgggattacaggcacatgccaccatgcccagctaatttttgtacttttagtagagatggtgtttcaccgtgttgaccagactggtcttgaactcctgacctcaggtgatccacccaccttggccttccaaagtgctgggattacaggcatgagccaccgtgcccagtcttttttatttttgagacaggttctcactttgtcacccaggctagagtgcagtggcacaaacacggctcactgcaggcttgacctcctaggctccagtgatcttctcacctcagctccccaagtagctgggactgcagccatgcaccaccacacccggctaatttttgtattttttgtggagacgggatttcaccatgttgcccaggctggtcttgaactcctgagctcaagtgatccacctgcctaggcttctcaaagtgctgggattacaggtgtgagcccactgtgcctagtgaaaaaacttttttttttttttttttttttttttagagataagatcttactgtgttgcccaggctggtctctcattcctggcctcaagtgatcctcctgccttgacctcccaaagtgctgggattatgggtatgagccaccgtgcccagcctaaagttgctatttttcccatgatgtttatcttcgtggtgcttatgaaatggcaactatggcattcttccttctcgtgcatgcctgtgtgggtgtgccctcagcatatgcttacaaggtttattgggtgatccaacgctagccgcaagagctattattagcccccttttacagctgggaaaacagactcagaggagtggagaacttgctgcagatttgttaagtgtcagagccaaatatacacttggattatcctgactccaaagccggagccctgctggtcagtcggtgacaccgggcaaccacagggatccccctcaatcccacggaaggctgtctactgtcttcatctcagagtgttgacagctcaaagcttaggaggctggagctaagttcaataaatgaacgtgatgaataggagaaaagcgccattaaagccctccagacaagaaccactttggagcccctccatgggtccctggggtgtaggaggggcaggaaagcagataagattccattctgagcctctgcacttgccctatgcaagatagccacaagtaatgttttgtcctcacctcattagcaacaaatggccacactcaggggattaaaaaaagaaataacagccagcctttatcagcttggggctcttggctaattcctctttaagcttaagacaactctgcgggtggagtgatccaaacgactttctccactttgcaagttcccacactcggctgtatccttctgcttgagattggcagccccctggggatggttcctgctcacccaactcccctgaggctgctccccagtagaggcagagagaggaagggcactgatgtcctcagggcccctgcaataggtcaggacctgggttcactgctccatcaatcccacattgctcggccctcactagcaccacacagggtgggtggcagcctccccatttgatcaatggggaaaactcagcacacctacttggccccagaactgagagtcaaacctggggacccagcttcgctgccctcagaatgttactcttccctcctgggtagcgtggtatagatagtgtagtattcttgtccccatataacggaagaggaaactgaggcccccagaaggctaagggactagcataggccttgtgtcttagcctgttaaggctgctatatcaaaataccatagactgggtggcttttaaacagatatttgtttctcgtggttctggaggctgggaagtccaagatcaagcttggtatctggtgagggcctagtgctgccttctcgctgtgtctcacatggtggaagggacctgctagctctctgggtctctcccccaatgaggattgaacccccatgatctcatcacctcccaaaggccccacctcctaatatcatcactttaggggtaaggattccagcatatgaatttgagggagacatgagcattcagaccatgacaccttgtaatcagaaaggggttaaatatctttggttgaatatcctgtcctgccgattcagaatcactgctgtctataacctcttccctagatcactattttagatgatgatgataaagatgatattaacggcaattaccaagctcttaaatgtgctgtgggtaaaacaattttaagctctttctgaatccagtctctttcaatcatcttcatgcccttgaaaggtctggatttttgtcgatttccctggtgaggaaacgggccctgggggcagaggtgatagggtggagccaagaagtaattcccagctgtttctctgcagaggcagtgctgctacaaacacatctccaggaaggggtacagccaaatgcttctctgtctcttgtgggttttgcagtggctgtcagctatgtgtctggcccggttgggaatgatgggggactgtgtgtgggaatgaatggctctgtctggctggctcagtctttacagaggtgctaggagtgtctgtttggtgctctgactaatcatgaaaagttcacgtttttatctttattttatttttatttttggtacccatggtgcattacagggaagggagacagcgaaggagaattatttgttataaaatagtaaatattggccaggcacagtggttcacacctgtaatctcagcactttgggaggcagaggcaggcagatcatctgaggtcaggagttcgagaccagcctggccaatgtagtgaaaccccatctctactaaaaatacaaaaaattagccaggcatggtggtgggcgactataatcccagctactcgggaggctgaggcaggagaatcgcttgaacctgggaggtagaggttgcagtgagccgagattgccccactgcactccagcctgggcaacaagagcaaaactccgtctcaaaaaaaaacaaaaacaaaaacaaaaaccgtaaatattaaattgaaaaagggacatacttaagggagtgaacctgaaaagccccagctgacacttggcaacaccttccttgtttgttttgggcttttttgagacagagtctcactctgttgcccaggctggagtgtagtggtgtgatctcggctcacctgagcctcagcctctccaggctcaggtgatcctcccacctcagcctccagagtagctgcatacaggcatgcaccagtacaactggctaatttttgtattttttgtagagatgaggttttgctatgttgttcaggctggccttgaactcctgagcccaagcaatccacctacctcggcctcccaaagtgctgggattataggtgtgacccacagtgcctggccagcaccttccttgttaaattgcatgtgtcagccacctccctcggtgtcctcccagcctctgggcagtctggctccccattcctttctttatccaacagcatttttttgtgagacaaggccttgccctgttgcccaggctggagtggagtggcacactcatagctcactccagcctccaactcctgggctcaagtgatcctcccctctcagcctcccaagtagctgggaccacaggcgcagatcatcacgcctggctaattttttgattttttgtagagatgaggtctcattatgttgcccaggctggtctcgaactcctggcctcaagcaatcctcccgcctcggtctcccaaagtgctggaattacagatgtgatccaccacgcccggtcattctaacaatattgattattagatgttgccctagacacagcctactgtgcgtatgtgtaaatacgaattgaatcatcccacaagtagctgctaagtagaggaggtccagagagtggggaagtgtagccctggggaccttgggaggacaggggaggcttccttggaaggtgaagtgtaggcttggctagggaacttgatataggttctatgaggctgctggggctggagcagagagaagggggagaatgtaggaggtaggagtggaggcccaagagggagagcgttggttttcctgtctcctacaccccttcactggccagttctgctttcatgtttttatttattatatattttttgagacagagtttcactctttcacccaagctagagcgcagtggcacaataatagctccctgtaacctcgaactcctaggctcaagcaattttcctgcctcagccttccaaatagctggggctacaggcacacacctctgtccacagctaattaaaaaaaatttttttttcatagagataggggtctcgctttgagtctcaaactcctcgcctcaagcaatccttctgcctcagcctcccaaagcactgggattacaggcatgagctcctatgcccagcccagttctgcttttacaataccagggcttcctgtaggtttggaaaacacctgttgggttgcagcaaaggctctcaaagtatctcttcttactcagcatgtcatcctaaccaactctgccgggagagtagagtggggagatgaaggctggagaaagagaagggccctcacttacagaatggcttaggtcatgggctctggagctgggttcacctcccagctctgccccggctattactttgtgcctcagtttcctcacttgtcccgtgaggatgatgactgtgcttactccagttgttacaagggtgattcggtcagtgtgtagggacacggtgcatggacaggacaagttcaacaggcattagcagtcagctgccgaggacccaccgtcaagggccatgcagtggccaccttcacagtcacaccacagaagatccagaacctctggcatctgcctccgtgcggggcattaggtagagagccacttttctgcaggcaatggaggctgagacctttcttctttactagcccaggggtattgatggccctgcagagacgggttttgattacctctcactggatcccccagcagcctgttaccagaaagaagggcagacgcagggagcctgggtctgtgctcagtccccgctgggttttctccttttatggtcagcctacagtgctctggcttcccagacagaatccaccagcttgtgtttgggcttgggccgaaatagctggtctgtggggagctgggtacctcctgggagtcctcaggcccacagcgggggaggaaccgctgaagccctttatcttctcaggaaacgtgcctggggccttacacatccgaggctgggtggggagtctggggaggaggaagggagagaggcatgtttaaggatggggtgtgaggtgacatgagccccagggatctgggctgggaagctcagccccaggcgggtcctgatgatggccggccgcccccagctccagccttcccagactccacggaggctcggtactgtgtccccgcccactttggagcttctgtcccaggccctctgcttgggatgctctgcctcgacctctccccaggagattctttcacatttttcttaatgctgttcagtggtcacctctgccgtgaaggcttcctgtcttgctcaggtcagtgtgaaaaaacaaacaaacaaaaaacctgacgtctatagcacttgggttcacatccatcgtagcactgctcatctcttacggtcatttctttgcccatctgactcccaccctgggtcatgaacttctcaaaagcaaggataagcaagtcatgaagctcggtgcattggcttgagcctgtgatttcagttacttgggaggccaaggcgggaggatcacttgaggccaggagtttgggaccagcctgggtaatattactaagttaccttactaggccctgtctctacaaaaaaaatgaaaacaaaaaacaaaaaaaccattagccaggcgtagtggcatgcacctgtagtcccagctgctcaggaggctgagatggaaggatctgttagcccaggagttccagactgcagttagctatgatcgtgctactgcacttcagcctgggcatcagagtgacacctcatctcttaaaaaagaaaagaaaaaaaaaaagcagatcttattgacttttgtgctttcggtacctggctcaggactcgtttgttgaatgaatatgtgaacacgtgaatatgcattttccattgcttctaccttggttgcctctctgagccagagagcaattcaaaataacaagcatttcctgagcacctactgtgtgtcaggcattgttccttgtacccgggatcaggcacagcccttgaccttcaggagctcattggttcaggggaaaagcattgaaaatgaacaattttgtaattgttggaaacctaatagagctgcatgaagtggaagaagtcagatttataatcattcagaggtggtataaaatgaacatcatttttaaaaaaggtttatgcggtataatttaaataaattcattttaaggatacagttcacacctaaaattgcagctatgtctgcataactgtctaaattcactcataatttacatggttatgcagccattgctgcaatataattttatatttctatcatcccccaaagaaatcttgtgcacatttttttgtcactccatattcctacccgcagctcctggcagccacgaattcacaaatctactttctgtctctatggatttgcctattctggacatttcatataaatggaatcatatgtgaccttttgtggctggcttcttttttttttttttttttttttttttttttttttttgagacagagtgtctcactgcactcgcccgggctggagtgcagtgatgtggtctcggctcaccacaaactctgcctcctgggttcaagtgattctcctgcctcagcctcccgagtagctgggactataggcacgtgccaccacacctggctaatttttgtatttttagtagagacggggtttcactgtattggccaggctggtcttgaactcctgacctcgtgatctgcccacctcagcctcccaaagtgctgggattacaggtgtgagccaccgtgcccagccggctagcttctttcacttagtataatgttgtcaaggttcatccacgttgtatcatggattcatactatttatatattttttaagacagggtctgtctctgtcaccccagctggagtaccgtggtgcagtcgtggcttactacaacctccacctcctgggctcaagccattgtcccacctcagcctcttgagtagctgagaccacagggattgtgccactatgcccagctaatgtttgcatttttttttgtagagatagggtttcaccatgttgcccaggctggtttcggactcccgggctcaagcaatccacctgcctcagcttcccaaagtgctggaatttcaggcatgagccatggccgccggccataacatcctttcttttcatggctgaatactatcccactgtctgggtagaccacattttgtttatccatctacccattgatgaacatttggttgtttctattttttggatattatgaataaagtccataatttttaccaatatggaaaagaaaaacaagaaaaactctgaatgccatatcatggatagatggcctattatcattccatatcatctgtacctttttccgccagaatgttttgagacatttattaagtaaggatcacaatgatgataattactaaaatggagagaacctgtggaccatgggaaccactaggccatgtgacactcatgtttatattagagaaaggcaccgttttctcaaagcacttttcctccatctgctgaaagattattacaataaatacacaatgcaatacaataaatgaccaatgcaaatagtttctccatagagttatgcagtgtacaacatgcaccacggtccatggccatcctgcaggtaggaggtcaagtggaaaggtctccaactcagctctagaaaagtgcagagttagagaaggtatcatagaagagttgactcccaagacgatgtttcagatacagattagggtatgtacccgaagaattgaaaaggtactcaaactaaaacttgtacaggaatgttcatagcagcactatgcagaatagccaaaaggtggaaataacccaaatgtccgtcaactgttgaatggataaacaaaatatgatccatccgtacaatgtgatatgactcagccacaaataggcataaagtctgggacctgctacaacatggatgaacttcagccacatgctgagtgaaagaagtcagacatgaaaggccgcacatgttataattccatttatgcaaaaatatctagaataggtaagaccatagagacagaaagcaaattggcggttgcaagggcttatgggggagtggctgcttaacgggtagagggtttcatttgggggtgacagaatattttagaactagataaaggtggtagttacgtaacattgtgaatgtactaaatgctcctgaattatgcactttagttatttttttatctttattactattttttgagatggagtctccctctgtcacccaggctggagtgcagtggcgcgatctcagctcactgcaaactccacctccctggttcacgcgattctcctgcctcagcctcctgagtagctgggattacaggtgtgcaccaccgcgcccagctaatttttgtatttttggtagagacggggttttgccgtgttggtctcaaactcccgactttaggagatccagctgtgtcggcctcccaaagtgctgggattacaggcataagccaccgcacctggcttgaattattcactttaaaatggttctttttatgtagtgtaaattttacctcaatggaaggaaaaaagagagagagagagagaatggattaggccagagaagaagtggtggtgggtgcactgggcagaagaaatcacttgtgcaaagcaaggagggagtgaaactgctttgtacggtggagaacactgcttttgagtccaacacaagctcaggcttggggaaggaatcagataaaaatttccaggatctcagagttccctgtgctccacacgggttggcagacagcacccacatggagtccttctgctcgtaaccagcaccctgcaagcttcccacgcctggaagtggtgtgtttttgatgggaacgtcaggccagaggtctcccagcagcccccagctcggagccgcgctggcagctcccaggccttctcctggagcccgctccctctcctgggggccctgtgagcatctgagcctataaatctctcctgctctgggcctaggattcacaaggctgccaggaaagcctgcctctctccctgaagtagtggatcaacacagcccatctgtctgtccatctcaaaatctttccttaagatagtggaggttgtctgggccggtcccaggaggttctctctgtctgggttctaatcacagggtacctggttcttctatccttcaccctcttttaaaaaatcactttttagtactttgggaggctgaggcgggcggatcacctgaggtcaggagttcgagaccagcctggccaacatggtgaaaccccgtctctacaaaaaatagaaaaattagccaggcgtggtggcacgcacctgtagtcccagctactcggggggccgaggtggaagaattgcttgaaaccaggaggcagaggttgcagtgagccaagatcgagccactgcactccagcctgggtgacagagcgagactccatttcagaaaaaaaaaaaaaattaaactggtttcccattttgctctgtcctcgagtgaatttctccccctgggtggaagctaaaggcacgggtatctgtctgtctccagagtataatggagagattaaagtttgattgcttttttcctgctttttttttctttgagatggggtcttgctctgttgcccaggctggagtgcagtggcaaaatctcaactcactgcaacctccacctcctgggttcaagtgattctcctgccttagcctcccgagtagctgggactacaggtgcctgccgccatgcctggctaattttttgtatttttagtagagatgggtttcaccatgttgcccaggctggtctcgaactcctgacctcaggtgatccacccacgtgctgggattacaggtgtgagccaccacgcccggcctcctttctcttataaatagggacaccattgatttaggtctcactccaagccaggatgacctcatctcaacatccttcccttaattacatctgcaagacccttattctaaataaaatcacaggtgggatacagtggctcacgcctgtaatcccagcactttgggaggctgaggcaggtgggtcacttgagcccaagagtgtgaaaccagcctgggcaacatagcaagacccaatctctacaaaaaatacaaaaattagccgggcatgctggcatgtgcctatagtcccagctacaggggaggccgaagagggaggattgcttgagcctgggaggttgaggttgcagtgagctgagatcacgccactgtacacccacctgggcgacaaagtgagaccccatctcaatcaattggttagtcaataacatcgcagtctgaggttctgagtgaacatagcttttgggagtcacagttcaacccaccctagtgaccttgggcaagttgcctcacttctgaacctcactctccttatttgtaaaatggaggcaatgccagtgcccaccccaggagctgctgagagaattcagtgggtcacttcaacacagaagttcagcatacgcctgcagtgcagtgagtgctcgggagatcggagctgttagtgggatcctaatgcggtggctctttcttttctgtctttttttagctttgtggtcatgatggtttcataaagaacaataccgactctttttctattgaccatttttggtgggatgaggaaaagattgtatgtgttcatagcacaaacataaccaggatagaagtagaatgggtgaaagtaggtcttcctcctgtcccttttctcaatacttcaggctcaggcctgtttgttggttttttttgtttgttttgttttgtttttggagtctcgctctgttgcccaggctggagtgtagtggcatgatctcacctcactgcaacctccacctcctgggttgaagtgattctcctgcctcagcctccggagtaccttggattacaggtgcatgctaccatgcccagctaatttttgtatttttagtagagacagcgtttcaccatgttggccaggctggtcttgaactcctgacctcaagtgatctgcccgcctcagccttccgaagtgctgggattacaagtgtgagccaccgcacccatcccaggtctgtttttagagatagggtctcactccattgcccaggctggagtgcagtggtgtaatcacagctcactgcaaccttgaactccttggctcaagggatcctactgtctcagcctcccaagtagctgggacaaggggtatgtctatcacacatagctaattaaaaaaaaatttttttttgtagagactgggtcttgctatgttgtccaggctggtctggaactcctggcctcaagtgatcctcccatctcagcctcccaaagtgttgagattacaggcatgaaccactgcatcctacctatatatctgtctttttaaaacacaaaaggtataacactatgctacctcatcttttatttttagcttaatatattttggatatttttctgtgtccatccacaaagctctgcctggttcttttcaatggctgcctattttatttatgtatttatatcttatttgtttttgaaacagagtcttgctctgttgcccagcctggcatgcagtggcacgatctcggctcactgcaacgtccgcctcctgagttcaagcaattttcctgcctcagccttctgagtagctgggattacaagcgtgtgccatgacacccaactaatttttgtatttttagtggagatggggtttcaccatgttagccaggctggtctggaactcctgaactcaagtgatccaccctccttggcctcccaaagtggtgagattacaggcatgagccactgcgcccggcctgcctatttttaaatgtgccattatataaacacaccagaattgaaaccccagagctgactagtctttaggccttttgtcttgaggatttcgttcaaccaggccacccaaacatccatctataatccgagggaagagagagagaactgattggagttgggcatagaatctgaggaacgtgcccacatccaatcagttctctcttaagattacagatggaagaaagagtcatctctttcaccttgccttcttcagtcccatccatcctcccattcatattcccatccatccatccatccatccatccatccatccatccatccatccaactcatttaccggcctatacactctgtcctccctcccattcacccacccatccactctctcatccactcactcatccttccctcctccgtccaaccatccgtccaaccagctatatacccacccatctacccatctacacacccttccctcctttcttctttctttcttcctatctatccatccatccttccttctttccatccatctattcgtccacctacccacccacccactcatccatttgtcttcctgtctctctacctgtccatctatccatccttccatccagccatctgtctgcctattcacccagcctcccatccatttatcctcccgtccatttacctatccatccattcttccatccacccatcctttcttccttccttctttcctttcttccttccttccactcacttgcccatccacctcttcttccatcctcccatccatctactcatctatccatccattttcccacccatctgcccatccacccacccacctactcacctactcatctgcttatccaccctcccgtccatctgtctattcatccacccacccacccatccatctacctacccatctacccacccttccattcacccatctacccttccttcctttcttccttccttccgtccactcatcttcccatccatctactcatccatccctcaatccatccatctaacaagcataattcagcacctaccatctatgtgccagtactagagatacaatgtaaaaccaagcctaggagatttttgatgaaatgaagcttgtgagagctgagcactgaactagtaggactgaagccagggagtggatttaagaaatgcttgccactgtggcattgtctaccagcagatatgatgctgggatttctacattgttaggtgaccattgaacgtattggtaactgttctcagatctctctttgggaaggaaatgggtcttcagagcctggctccacctcagaggcctctttaagagtagaaggtgatggataatgtctgcttaatcacatctagttctttgatgacctctgtatcttttgggtttctctggtggtaaacaagagagactgactctgtcatctagtagaggaaagggatttgtaggggagtatggaggagctcacagttgcagtgggaacactaggaatcaggctaggtaaatgacagaaactgggctgcttgggcccaggggcagaaaggaagtctgcctcagggctctgtccacctgctgtgcttccctgtccttgactgagcttggagttttaggccagagagtctgaccaatgcagcctggaacacattcttacctctttgttgaaggtacttatgaggcagtcccactaagactgtacatgacggtaggggtgatgggggaaacctcaaggaccacaggatgcttctggaagaagaggaaatggatgctggatttacaaaaaaacacaaatgtgcacaatactatattacagatgaaggaactgaggcatggagtttaagaatatttgcccaaggccacagagcggagaagtggctaagggggaccccaatctgtatagatccaacatctgcgtttggtccctaacctaatctgggtggggtgggcctcccgggacacctccagagctgatgtggctggatgctaatgactcctggatcagtcaggctccagcatctttctggggctgcctctgggactttggggctgcccttttggctttggtcgtggcccctgtagcctgggcaatgagcccagctgacctgttgtcacttccaatgaggccagcatggagaagctttagaatgggagggccctgggaggagccaagtccagacccttagctcagagctcattttaattcatggctcttttttcttctttctgtttgcagatcgggaggaccagtccattctatgcacgtaagtggaactgctttttcttctgttttttttttgtttttttttttttttaatctgtagtcgagatccaacctatgaaagaaaagatccatgagtgcagagatctttgatttgttcatggttccaagtgcctctctttatacctggcaccatgtagatgctcactaaacatttgtgatatatggtcttctgcggaggcaggcaaacttaaactcttaatgacacctgctatcatttggttccatacctctcctccttctaaaaaactagcatttattgaacatgtactctgtgccaggacttgaactaaagattttatatgcagaatcttatctaattgcataacagccatctgtgttgatagggaagatgttaaactgtcactttagtatttcacatttatcaagccacaaacacatcagtgccatatttggtgattggtatcactgtttctttgaagacctaggtacataggcagaagatagtaactcaattttagaatcattgagagagttttcactattgtatttatatgcaagtaacatatattaatatatattgttgattcattgacattgaactcacagccagcagctctgtggctgatgcctggatgaagtttatctgatgtgtatttattacataatgggtatcacaactttattgtgcttggaaacatgagccaacacttgagcactatgctggggacatttttgtatgtgtgctgccgaagggagcacatctgaggggacattttaaactgcaaaataactaacaaaaagccacaaaaatacaaaaaaaggtggcactaaatacactacagaaaggacacttgtttacagtatgagagttgaaactagaaggtagagcattcccctgttcaacctgagctgggaacgtgtgcattgggggaatcgaattttccttactctgcacatgttcacaaatgactacaaaagtgccatgaatattgattttggggttacaaataactttcagcaggtcggtgaatttgaaaatatagaatatataaataatgaggatagactgtgcatatatatatttacataatatataatatgtattatatttaatatatttatatttatatatatatatatttgaaggtctggaagcaactaaagctataatcaacagaggttatttaaataaaatatagcatttccaggtagccactacaaagagtgaggctgatctatttatgctgagagagaacgctctttatagataataccgttgagtggaaaacacaggggcaaaccagcatatgcataatgtaaccgtgtgtgtctttaaaaagagcaggattgcatggacgtgcatatgtttcctatttgcatgaaattatctggaaggacaattaaaaactagtaattagaatttcagatggtgatggatggtaggatggcaatgaactgtattgagagaagattgaaacaattaataagtttggggttgatatagatagaaaacctggaaacaataaaacaaaggcaattataaactccaggaaaaaacaaaagttgggatggaaggagaagtaatcacattggactaaggagcccagctgtgcaagtttggagtatttatctaaccagaataactccctgtgatggacttggctctgtggggaaagggaagaggattagatgggaactgaattctcatattccatggtaggatgtacacatttgatgtttgacaatgaatagtctggatctagagatataatgctacctagctatgaggatataaatgctaaaacaacctgccgacttggtttcctagttttctggcttctaggggtcacctgcattccttggctcatggtctcttcctccatctttaaatcctgcagcatggtatcttcaaatctctttctctggtccccctacctctctcttataaggcccagtacctttgtggttatattagccccacctagatgatccaagacagtctcctcatctcaagcaaacatattcacagattctgaggataggccatggacattcttgtgggggctgtttttcagctagccacagaggcatttgatcccctaggagccaaacccatgtgtgagccacatgtcatctccccaggaaccaaaatagtgtagctcaactgccctctgttgagtgaatgaattaagtgtggtaacagagaggtgcaggaaagagtaggactttcagatggcttcctagctatgtagctatgcacgggtcacttgacctctctgagctgagcttatggagaggctgtgaagatgaagaagaggccaccctgctctcatttccagcacccatgccatcagcaggtgctgtttcatctaaaacggtgctatccaaaagaactttgtgatgagcacaaagttcacttaaaagttcacttaattgagctcttaaaaagtggcaagtatattgcagaactgaatttttaagattttagttaatttagatagcggttcctgccttggacggtatgatgctgaaatatttctcatctctgtccattcctctgactccaccgcctcttcctagttcagggtcccgtcacctctcaccagggcctctgtagcagtctcttaagctccctgctcccattgcttgcttgcttccttcctttaataaatatacattataagaatattcactcattattcattgaataaatattcattagcatgctgtcataaagtgtggattccagaacctaaccccttgggtttgaattctggccccatcatcgtctagttagttgtatgctccaggaaataagtcagttcacttctctgagcctcagtttccccatctgtaaaatgggaacaataagcaccccattgggttgttggaaggatgaaatgagtcactacatgtgaagaactgagaaacaggccactgccccatggtgagcactttgtaaggatcagctgctattgtagtgaaagtgctcactattttttaaaaatccttcctgcaatccagtatccatcttgcagtttgtttgtttgtttgtttgtttgtttttgagatggagttttgctctcattgcccaggctagagtgcaatggcgtgatcttggctcacagcaacctccacctcccaggttcaagtgattctcctgcctcagcctcccgagtagctgggataacaggcatgtaccaccatgcctggctaattttgtatttttagtagagacagggttttgtcatgttggtcaggctggtctcgaactcctgacctcaggtgacccggggagcctcggcctcccaagtgctgggattacaggcatgagccgctgagcctggcccatcctgcagtttgttgttgttgttgatttttttgttgagacagagtctcactctgttgcccaggctggagtgcagtggtgcgatcttggctcactgcaacccccgcctcctgggttcaagcaattctcctgcctcagcttcccgagtattatgccatcatgcccagctaatttttgtattgttaatagagatgggttttctccatgttggccagcctggtctcaaactcctgatctcaggtgatccacccacctcagtcagcctcccaaagtgctgggattacaggcatgagccacttcgcccagcccatcctgcagttctgattctccccacactggttctaaagtcccgttcccctcgtgaaatggtttcctgcacccatgagaataaaactcagattccttactgtgacttggaagactgagtgtgatctgctcttccctcttcacttcctgctgtcctcctctgttgtggccctccagccatgctgggagccattctgtctcatacctgggcccagcatttccctcccttggacctctgtccatactgtttgccctgcctggcccacccttccctccatccttcccacagggctctcttgtaactttcaaggctcagcaactccctggcttccccatccacagcctcccctctcctcccttcccctcgatcttctcagtcacatcacccagatgtagcaatgatatctccaccacgaactatcttgattatttgtttacttggctattgtgtatctccatctcctggaatgcagcgttagcaaggacttggcacactgcccacacacagccagtgctggagaaggaggccttagccattgttaggaaggaaatcccaaaacgatcagacttttatttgcaaatgcatccagtcagcccagaaccaccaacatcttcagtctctgtattcaattttattttgcttgttgtgaaattcagccaaagtgacttgaaggacctacaagttgacagcagggctgagcttttacgcgtagttggtgcttaagagaagccaggctggagccaactgtttggttatgcagttaagaaactgaaaattggccgcgcactgtggctcaggcctgtaatcccagcactttgggaggccgaggcgggcggatcacgaggtcaggagttcgagaccatcctggctaacacggtgaaaccccatctctactaaaaaaatacaaaaaaattagctgggcatggtggcgggtgcctgtagtcccagctattcaggaggctgaggcaggagaatggtgtgaacctggggggcggggcttgcagttagcagagatcgcaccactgcactccagcctgggtgacagagcgagactctgtctcaaaaaaaaaaaaaaaagaaaagaaaagaaactgaaaattggccacgcaccgtggctcacgcctgtaatcccagcactttgggaggccgaggcgggtggatcacgaggtcaggagttcgagaccatcctggctaacacggtgaaaccccatctctactaaaaaaaatacaaaaaaattagccgggcatggtggcgggtgcctgtagtcccagctattcaggaggctgaggcaggagaatggcgtgaacctggggggcggagcttgcagtgagctgagatcacgccagtgcactccagcctgggtgacagagcgagactctgtctcaaaaaaaaaaaaaaaaaaaaaagaaaagaaaagaaactgaaaattggctgggtgtggtggcttatgcctggaaactcagggccttgagaggccgaggcgggagggtggctggaagccagaagtttgagaccaaactgaggaacacagtaagaccccattactacaaaaaatttaaaaattagctaggtgggatggtgcatgcctgtagtcccagctactcaggaggttggggagggaggatcacttgagcttgggagttagaggctaagtgagctatgatggcaccactgcacctcagcctgggcaacagagcaagacccagagacaggaaggaaggaaaggaagggaaggaagacaagaaaggaaggaaactgaaagctgaataaatgtaatttttaggcctgagttgtattttgtctagcatgtaatccatccagtataatcagtttaattagaggccatgggcctggctggagatagagctgtgtgatcagggggctaaagtaagaggaggagggtggtttcacataaaattagagagaggtaagggggtgcttccaggccctggggaggagtttaaactttcgtctaaaatggatgacaggctgggcatggtggctcatgcctgtaatcctagcacttcgggaggccaaggcaggctgatcgcttgagctcaggagttcaagaccagcctggccaacatggccaaaccccctctctacaaaaacaaaaattagctgagcgtgatggcatgtgcctgtagtcccagctacttaggaggatgaggcaggaggatctcggttcactgagcctgggaggcagaaagttggcactgagccaagactgcaccactgcacttcagcctgggtgacacagtgagaccccatctcaaaaaatatatataacaataaaataaataaatgaaatggatgagaacgtgctaagggactcaagccaaggaaggacaaagtttaaccagtgggtcaaatcaggcccttgtctgtctgttccagataaagttttattgaaacacagccgcacccacttgtttacgtatttgcttttgtgctgcagtggagagctgagcagatgtgacaaagaatgcgtgaccctcaaagtctaaaatatttactgtctgaccttttacaaaaagagtttgctaactcctagcttaaacagtgggaaaatgtgaatattatttatattgtaatgataggatgaatgctgaaaatcattatacaaacaatatataacttctgtggaagcagtggttataaaagtaataataggtgggcacagtggctcacacctgtaatcccaacactttagggggccgaggcaggaggattgcctgaggcctggagttcaagactatcctgggcaacttagcgagaccccacaaaatcaaaaaattagctaggtgtagtggcacatgcctgtcatcccagctactcaggaggctgaggtgggagggtcacttgaacccaggagttcgagattgcagtgagtcaagattgtgccactgcactccggcctgagcaagaagcaaaactctgtctcaaaaaacaaaagtaataataactaacattttggcataccaggcattgttctaagcattttatataaatgttcactcatttaatcctcataagaatcatataaaaggtcaggcatggtggctcatgcctgtagtcccagcactttgggaggctgaggctagagatcacttgagaccaggagttcgagaccagcttgagcaacatagcgagacccctgtctctacagaaaatttaaaaatcagccagctgtggtggtgtgcacctgtagtcccagctacctgggagattggggcaggagtatcacttgagcctaggaattctcagctgcagtgagctatgattgcatcactgcactccagcctgggccacagagtgagatcttgtctcaaaaaaaaaaaaaaaaaaatcatacaaggtaagtgtttttattatacccattttataatggggtaaagaaactgaggtatggagaggctaaatgacttgcctaaggtcacccaggtaactggcagaggagggatttgaacttgagcaacctggtcctggagcccattatgctattctgccaattgatgctataggggagagaggcgttgcttctgcctggggttttgcaggacgtgtaggagttgtacagtacaaaatgccagggtgctttgccagtcacataaagaccagggactgaatagctgtgaggttcatcagagacaatttggctttcctaccagtggcaaaccacaggctgcaatggacttggcaatattcgaccctgggagccaggaccagctgcagaatttgtagaattttgcaaaatgaaaatgctggctgagtgcagtgactcacacctggaatcccagcactttgggaggctgaggcgggcagatcacatgaggtcaggagttcgaggccagcctcgccaacatggtgaaatcccatctctactaaaaatataaaaattacccaggcatagtggcgggcacctgtagttccagctacttgggaggttgaggcaggagaatcacttgaacctgggaggtagaggttgcagtgagccgccatcacacactgcactccagcctgggcaatagagcaagagtcagtctcaaaaaaaaaaaaaaaaaaagaaaagaaaaaaaatgcagagcgtttataaagaattaggaagaatttccagatggcaacattagagtatgaagcacagggtggtccctgtgagacggtacaggtcacactcatgaagccagcctggctgggggattaagtggccattgggtggttcttcccagctgctggggctggactgattaaaaggacttggcactggggtagttacaaggccaggaggccataacgtggtcatgagtctggtccttctccgggaagagggagctcagtaccaaattccccaagaaataagaaaggagtttagggtgctcagaccaggaaggcatcttcacccctagaggtcaggggtcagaaaagccaagctatgaatgtttctagaaccagctctaagcacatcaaccttcagacgcccacgagcctggagcttgggatgttttctttggcagaacctcccagggcaatttatttttctcaacagaacttggaaacagtggagcccagcagcaacatgggaaggggtagatgcccagagtttatgtcccactccccatcccaggcaaagtgggagaccatagccacggatagggcacattgatgtctttgtttttttttttgtctgtctgtttgtttgtttgtttgtttgttttttgagatggagtctcattctattgcccaggctggagtgcagtggcacgagctcagctcactgtaatctccgcctcctgggttcaagggattctcctgcctcagctccccaagtagctgggactacaggcacccaccaccatgcccagctactttttgtatttttagtagagacagggtttcaccatgttggccaggctggtcttgaactcctgacctcaagtgatccacccgcctcagcctcccaaagtaccgggatgacaggcgtgagccaccacacccggtgatgtctttgttgtaaaagggaggaggtgagagaggttcaaggccagggtggaaaggaaggaactattgtgggaaaggagaagtgagcagcagcagtctaggagcactggtttgtcagcatgaagagtgtgatccacacatgttgtttgtgcacactgctgtcctgattcttgtcttggatctgaataggttcatgaccacctacgcaagtggtttcctacatccaaaaatttctctcctttctcttgctttaatcagaatccaaccccttcactttagaatgaagtcaagcaaggttctgacgttagcctgattgaagtaattcatacttaggtgtgaatgactgagtggcttggttcattgattggggcaagtaaagcctcctggaatatatggcagaattccagtggagtggggctgggacttcactctgtcttttctctttgctgatttgttaaaataaaagggtaggaggcagaacatgggccctggtgtcaagtggacctacgttcaaatcctgcttctcctccatttcctatctgtgtgaaagcaggagcaattgtgggctggagcaatttacttcaaacctctctttgcctcagtttccccggatgggtgatggggataattaataactctctcattagattgctgggtagagtaaatgaaaagatctgtgagcccaaagcctagtactgtgcaggccttcaacaaatatcaattccccttcccctgcccttcttctggccttagaaagcaagtccctagagggttgggcctgtgtcatggaacaacttggtgaaatgtagtaaaaggaattctgactgcattagaatcagagacctgactttccattctgactgtatcccttctttgctgtgtgacctagggaaaattgcttacccactctgggcaagactcttccttctataataacatggaagcaggaagaggataaaggaaataattcatgtagagcatttagcaaagggacccttccccctatatccccccaatgacaaacgccaattcttctctgtcttaagagatgggatcttgctatgttgcccaggcttctctcaaactcctggcctcaaggcatcctcccaactcagcctcctgagtagctgctattataaacgtggccagttctctgctgcacctggccagttctcctcttttacacacacacacacacacacacacacacacacacacacacacatatattctggtcttagtttccccttctggggaaatggggtaatgccttcatggtccccatttcataaactgcctctgaggccatgtgaaataatgtggccattgggaaggaaggcctctaggaagggaagggaccacacaaagtcaccgcaagatgtttcatcattcttggccatcagacacttgatttctggacagtgggacctgtaggattaggcacagcaatttggggcactttttttttctttctctttcttttttcttttcttctatttcttttttaagccatgagccaagttattaatgggcctttggcagagaaaattaatttctttatttcctaattaggaagaagagcagagactgtactagctttggtggcactggttcagcacagagaaccttgggctgacctcggggtgaacaaattcttttttcaacttaaaaaaaaaactctcttatattttagagtattaagtgagctcagaaaataaaagagataaggcaaagaaaggaaacacaaaaaacaaaagtaaactgaaaaatagaagaagacgataaacaagtgaagttttggtcaaggcactgtccttatctttcactaggagtggtggaacatagaggcagtatctggatggagcggttccattgtgatgatttctggtggccaaaacaggcagctagtgcacgaaagccatcttggtaaaaaaaaaaaaaaaaaagatctaccttcatattccaggaggacatacttttttgatacgacaaaccatgtcgtgctgatctaaacatatcagtcatttacactttagtgtgaattacttcaactgggtttattcttagatacttggctgagatcatcagccagcttcctgatacatggggtgggattcctcagaggataaaggggcttgcatctgcccagtgaccaatgggataaccggttttttggtaaatttttctttccataagggagcttcttaaactttaggtcctggtactccagaggcacttacatcctttcttgaaggctgccttgtgcctggtctttccatttctagcaatgctaatgatgtctgcaggcggatcacgaggtcaggagatcgagaccatcctggctaacatggtgaaaccccgtctctactaaaaatacaaaaaattagccgagtgtgctggtgggtgcctgtagtcccagctacttgggaggctgaggcaggagaaccagggaggtggagcttgcagtgagctgaaattgtgccactgtactccagcctggggacagagtgagactccatctcaaaaaaaaaaaaaaaaaaaaagtagataattccaaataaacctgtttggacctatgtaagaaaactaaggttttcttgttcactctatttttttagagatgaggtcttgctctgtcacccaggctggagtgcagtggtgtgatcatggctcactgtggcctcaaactcctgggctcaagccatcctcccacctcagcctcctgagtagctgggactacaggcatgcaccaccaagcctggttaatttttcttattttttatagagtcagggttgtgctgtgttgctcaggctggtcttgaactcctggactcgagtgatcctcctgcctcaacttcccaaatagctgggactacaggcatgtgccaccatgcctggctaatttttaaatctttttctagaggcagtgtctctctgtgttgctgagctggtctcacactcctgggctcaaatgatcctcccacctcagcctccccaagtgctgggatcacaggcatgagccaccacatccggcccaccttttcactctttgtatctgaattcttttctatgtcctcttggaaggaatagattgggcattggacctaggctggggacccagttccgctcactaccagagatgtggccttgggcaagttacttcccctctgggagcctctgtttcaccctctgggaaatggtggtgatgatcattattgtcctgcctggctcatggaactgcggaaaggtcaccatggaacgtgtgcatagatgatgttcccgtgtctttcagaggcgagtctggagccgggaaaaccgaaaacaccaagaaggtcattcagtacctggccgtggtggcctcctcccacaagggcaagaaagacacaagtatcacggtgagtggcagttcccaatcagaggccatgatttagccaaccggtctccagcttgcagcccaaccgagatacaaacagaacatcattgcaagaactcaggccccatctgactacccctcccctgaagactcaaagagggaccgtctttttggcgagcaggcctgttgagtgtgggtgatttcttggctcagctagaagcatccctccagaagggggcccgttttgtgaaatgagaataagccctttccttccatagcgagatcttcctccacgtcggggcttctcagtggtggcactgatgtcattttggaccagataactcttccttggaggggcttccctgtggctcgtagaatgtttcacaacatccctggcctcgacccgccagatgccgacagcccccttccctccagttgtgacaaccaaaaatatctctagacattgtcagatgttccctggggtgggacagttgcccttgattgagaagcactcctttcatgaatctctgtaacgtcccaggggttaaggtaccttttgggttcccggattcctccacgtgtccccctgtccctgggatggagatgctggtatcactcggcccgtgggcttcagtgcaatgccattcagtaactgtggattgagcacctactgtatgccaggaaccacttggggtggggacctggggataagtctgagagatgctgttattctcttctctgagcttccagacctgtggaagagcatgtagttgtcaaagaatccctcaaataaacagatgatgacacggtatgactaagagcttgggaggaaaagaagagcaggtttctagagtcatcacctctagggcccatccttctcttcctcctcgtgtgtcagccctgccccatctatcccacaggagggggcacgtggtagggccgctaggactggccggtgcctccgtctgcaggtttgtgggtgggaagatggtaggatggagatctgaccacggcatggggtgtctccagtgttcgccattccagatgtcactttgcgtcctcagaggggactctggggcagccaccatggccggcttgtctggaggcccttggagatctaggatgggcgctggtcgtggctttggagaactttccttctccaaacaaatgcaggaaactcaagattcagcatcctagaattgtctctggcaagttggtttccagccatagtgagtgggaacaatggccccagaggctgtgtggcagtttaaacacagtttccactgccttccctttccctaaagagtaaacacaggagataatactttctaacaactcatcgttatcaagggcctactatgtgctgcttgttttggctgcatgcgtaaacacatctcagacattgtctcactggatactgttttaaggagcctaatgtggccccagtaattatgaaaacctttgaaatgtctggatctctaagaaattagaaaaaggagggaatggctgagcatgggggctcatgcctgtaatctgtgttttgggaggccaaggtgggaggatggtctgagcccaggagttcaggaccagcctgggtgacatagtgagaccctgtctgtaccaaaaaaaaaaaaaaaaaaaaatcaagagaattagctgggcctggtgtgcatgcctgtagtcttagctacttgggaggctgaggcaggaggattgcctgagcccagtaggttgagactgcagtgagctgtgatcgtattcctgcagctaaacagagagaaaagaaacagtatcaaggaaaaggagctgaccagtctgtctgggagactccaggctgtttggggggatcaaagtcatatattctccagcccctgatgtccatgtgatggaaataacgctgacatttgttttatactgtgttgttcaaccacagcaaggcccatcttttgcctacgtgagtaactgagagtgttttcctggtgtgtaggggaggcacggagtgaacttagatctgcatgatcctcttgcacccaccgagtcccgtagctggtggtagaaatggggtaggccctagagtttcacaacttaaatcagtaaatgcaccaaaataccatcctgtgggtgtctgatgccagggaagggtgtgggggtgcatttaccacccacgggacgcctattggagtccccagggttgcgctccagcctgaaatggatttctccggttcagaatgaacccctgcacccttcaaagcatccactcctggtacccttgactggaacaacctagacagagatgtctgtcccatctggctgagtgttttaggactgtcaggccccaaagcttccctggctcgatggacagtcgatggcacagctgtggcatgcctccctcttctctccctgccatcatccctaagtgtcttccctcagccctgtccctggtgcaccagtgtgtccctgtgcatgcgtgtgcagtgcgtgtctgtctcttgcatgctggttgcttgactcaagcctccagaaacagtcttggaggtcgcgatgcactagctttggtggcgcggtaaggccccagctacgcaacgcataacctggtcctgcttggacctgtgcatatgtaaactcatctctaacacagagcttggggggctgatgtgtgggtcccagcctagaagaaacccacaggtgtcttccttggctcccgaaaagatcattcaatccatcttagttagaccctgggtgactgtgttgcagatcagaaggagaattacagttcttatttgggatctgcttttgtgtgaccttggccgagtcagttaactcctcggggctatggtttcatcatctataaaattgagggtttgaaccaggtcccccgatttaaagctctcttgccaagacttttcaaccttacctgccagaatccccattctagaaagggagcctttttcagagagcatggagaccccaagtttatgtgaacaaaagtgattcctttagtcgtcttcccaccaacaaagaaatgcccgtggtgctccttgtaaatttccaccagtctcagctgtggtgattccacttgtagctgagatttgtatgcggatgaggcttttgcttcatctttctctgggagctacaaaaaggaggatgtgtggacaaatcaaaacagaaacaaatagcagcttcctgctttgtcctgtagaccaggtaccctgatgccttcctagcatgcggaggaatgaggaggaagccatgcccatccttgtcccctctagacactttcccggctcctgtccagcccagccctgatgcctggaaaaataaggaagggaaagcaggaggggaggacaaggagaaaaactcccagaatccagggcctggaggcctcggggcccaactgcagccgccatgttttagggctaggccaagagcagctcgtttgctttcccagcttaacttaccacattggccctttcctgccatgattaatcacgtgaccgcgtttgtgcaaaggcatcccggcagagggggccggtgggctgtgtacagtctcagcttcctttaacccaatgaatggagctcaggcaacctgctttgaagctttattccgcagtccgctaagaggattcctggtgggttttgtgcattccttacttgtctgctgtagaagacttcagaaaaccagtcctgagaaagaaaaaattgcaacttaaaaaaaattgcactaaaataattagaaggaggcttgtagtggtttaacttgaagaaggctgcttgttaaacatgaacagcagcacgactgccatgtacagtgggacaggtggtgcactgcacaactccggggggcaccattcatcatgatgtaaatgacatcaccgacattgtgcaaggcagtggctttgagtggcagtgatgttgcacagatgagcaggccctggtcttgaaaaaagtgaccttcctagggagcagatgtcctagctattagagagctcagacagttgcttctcttctgaaatcctcctgtaaatctgaacattagcatcagggtctaagaggaggtaggagataggagagaacctgtgggttaagggcagagttttgtgacaacatccatccaaggtagaactgtcaggacctaggttgctttctccaataactagatgtgaatgaattttagggagagctggaaaagcagcttctacaagcaaacccgattctggaggctttcggcaacgccaaaacagtgaagaacgacaactcctcacgattcgtaagtagcaaagccacatggattttccagaaaagctttggtgtcatctcctgcctggggctgcagagtgtttgcgtgcagaggtgggaggggcatctgaccctggagagatgggctgtatctcacaatcttgcaagggctcctgcctctcactctctcattcattcattaatttattcactattcactcaacaaatattgattggcctggtgcggtggctcacacctgtaatcccagcactttgggaggctgaggtgggaggatcacttgagcccaggggttctagaccagcctgggcaacaaagcgagatcccatctctattattaaaataaaatttaaaaaattaggtattgagcacctggtatgggctagacccttatatccgataccattttatgtaacaaaacatgaattgagtgccaactgtgtaccaggcacacacctcctccaagaaatacttagtaagtacctactgtgtacaattactctggtaggcacttttacatgtaccaccattctctttgtttttttctcatttgctgtttttattaagtgcctactgtataccaggcactcagcgagtctcacaggattgcgatgaatagttcagatatggttccagccttcatgaagctggttcttccaactgaataacagagagtaagtgaggcagggggtactaccttcccatgcacactcccccaggctccaaagcaaaaagtttttgcctgagcccaacagggcaggggaactctgaaagtggatggttgatgataggtagacaacaatggttttattgtgcaaaagaagcggttgtctccgtaggagggtcagaaagatattttagtgagaaaagatgaaggaaaaattgcctctgcattccaggagaagggggtctctgaactgttgctcgctgagatggggccctgtgaaagactctttgcagaaagctctgctctgctgagcaaatgcacatggtggtccctgaccctgtgatccccaaggcccattttagtaacaaacaattacataatgtctcctttcctcgcccgaaattagaatcatagatagtatcacctcctacacgtattagatgaatacacatcagcataatgccctaactggaatatgaagaagaaataacataagacaattcataatgaaagtgtgcatttcaggccaggcgaggtggctcatgcccgtagtcccagtactttgggagactgaggcgggcagatcacttgagctcaagagtttgagaccagcctgggcaacatggggaaaccccatctctacaaaaataaataaataaagtgcatttcagcatatcaatgctcgggccaggccacaccaacagaagacacagtaagagacagacacttaggtctatccacggcgacagctacaaatacaaggaaaagggtcaagttcaggcactgatgatgttggcatgggattttccagaatggcaactgactctcagtgaagcgctgaaccaaagaacaatcttctctagagtcacacagatgggatattcttgtattagaacaacattttaaacacttgttaatgctttcatttaaaagcataaaaatctagaccaggcacagagtggctcacacctgtaaacccagcaccttgggaggctgagttgggaagatcacctgaggtcaggagtttgagaccagcctggctaacatggtgaaaccctgtctctactaaaaatacaaaaattagctgggcgcagtgacacatgcctgtattcccagctactcgggaggctgaggtgggagaattccttgaacccggggagatggaggttgcagtgagccaaagtcacaccactgcactccaacctgggcgacagagtgaggctcttgtctcaaaaaaaaaaaaaaaaaaaaaaaaagcgtaaaaatctaaagtcataaaggttaggttctaagcctggctaattacaaacagatttttacctccatgagtggcaggtgagacattggaagagtcataagggatatagacaaggattggcatcagagactctccaggtcattgcaggactcccaaaatatccttggccccactgttcactaacaacagcggcccccccccaacatgtgacaagccaaataatggcttccaccgatttccaaaatctccatagcagatgtgccgcctccactgagaagcactgcgtttgcatgttccaattctgtgcaatgtttctagcctgtcataaatggaagcacgtgcaagacaaatccctaaaaacatcctccactcactggcgtccctgccatcttgggaaggagagtgaagaaggtgcctgggccttgcctgtgaccagccggctctccctggctccatctgggatatggtcatcccaaatcactctactgcatgtttcccaatggggaaagtttgaaggttttgtcaaggactgagcaagcctaggggattgtgtccacacacgccaacacttcccaccatgttatgtcatgatgggggaaaaggatgaaatcctgtctcacctgttgaggaaacaggaaaagggttcatgccaacagatggaggattgggttccatccttggtttcatggcttagctgaggcaggtagatagggccatctttggagatacttgttgagcctctagggccaggaacatgagccattcctgcctaaaggacatcctacacagggcctgcttgggcagtgtggccaatgcatactcacctgtcccacagaaaaggtttaatccatagttggatgatgtggatgttttggagcagggtggggtctggggagggagccctctagcccctgaatatggaaaaaccttctttctgcttagggccctacctctcaggagcaacgtcacgttggacaagtcacttgatctcttttagccttagttttcccagctttaaaatggggatagtgggctgggtgtggtagtttactcctgtaatcccagcactttgggaggctgaggtgggaggattgcttgagtgcagcagtctgaggccaacctggacaacacagtgagatcctatctctacaaaaaaaaatttaaaaattagccagatatggtggtgcatgcctgtagtcctagctgcttgggagggtgaggtcatggggaaaaggggattgcttgagcccaggagttcaaggttacagtgagctgtgattgcaccactgcactccagccctcgctgacagagcaaaaccttgtctctaataaataaataagtttttttaaatagggatagccatgatggactacggtcattgcaaaagccgaatgaaattgatctgtgaacatgttttacacgttctgttgctgtcaggcctggggtggtttcagctcagcagatgttggttccgcctgacaacttgacctgtggggttctgagtgttcgcaagaatctccccgccccacctcccatcctctgtaccatctgcctcctgcttgcccacagcatggggttaacggctgaagttgggcagcaaagcctgaactgtgttttcctgttggcagggcaaattcatccgcatcaacttcgacgtcacgggttacatcgtgggagccaacattgagacctgtatcctttccctgagcctgggccaaatgggtacccctgccccctaccaatctcctgcccagaggctgggagagtccaagagccacctctatctttccagcctcttaggtttcttccagaacaaatctccccttaacagcaggcattgtggtgcagtggttatacatgtgtggaccggacccctggtttgaaccctaaacaagcagcctaggctgcatgtgatgctcaaatgatctgtcccttagctgagtgaccttgggctggttactccacctctctgtgcctcatcagcaaaatggggatgataatgaatggtatctgcctcatagaaatgtgagaatagagtgaatgaactcatataaagctctaggcaccatgcgaggtgcagagtaagggctggctacgtagtgtctatcgtatgatcttcacttcatccttattcagccattgtccgaggccaaattctggacctgtcgtcctcttagagagttggtctgtgatcggctccacttcttaggtaggaaattgatgaaaacagagtttacccagaagaatgctggtatcgcaaggaacaagtagagcatctctttcatgaacctgagcggtgaagtggagccaagttagaaatttctggacgtgggggaacaaccaggtctagagttcagtgactgatcagcctcaggagctttgcaggcggccctagggctcaggcttcctgtggaacacgtgcttggcaatgaataggacctgggggcctgacttagcttctttctgcacctgaggtcctctagcagcacctagtggtcccatttttccacgttatgtgccctggataagagggtgggttgtggagtagcttcctctccactgtacttgtctaagctgtggggatttgggaaaatcactgaagctctctgggcctcagttttgcctcggtaaaatgggggtgattgcacctagtttctggagctggtgcaggggttaaatgaaataatatgcataataatatgcacagcccttggtacggtactgggcccaaagtgagcatctcataggtggtggctattgcgttaactcaatgttttctacgtttctactttaatctgcccaaaccagccaggattcccatcctgcagctaggagggctgtcaggcttcggtcaagtccagagccagggccctcttgtcctgcagccctgcacacacctctcagcaattcatttcctgtgtttagagcgagccccaggcatagccccgtccttctggcctcagccttccttttagatcagtggttctcaaagtatgtttccaaaccagcagcatcagcatcacttgggagctctttagaaacacacatctcagccaggcacggtggttcacgcctgtaattccagcactttgggaggccgaggcgggcagaccacttgaggtcaggagttcgagaccacctggccaatatggtgaaaccctgtctctactaaaaatacaaaaattatccaggcgtggtggcatgcacctgtagtcccagctactcaggaggctgaggcaggagaattgcttggatccgggaggcagaggttgcagtgagccaagatcacacactgccctccagcctgggtgacagagcgagactctggctcaaacatacgtgcgtgtgtgtgtgtgtgtgtgtgtgtatgtgtgcgtgtgtatacccatgtacaccatgagaaagtctgagaatcactgctttccagattggacatgggctgtggtagcccgggcactgctagctggctttaggacttgaagaagacaaggtctgctgatctagccccatcatcccgcaccatcatgcttagtgctgtggaaatccacccagtacagtagcccagcctcctagctgccctttcccatcaccccggaccctgtgatctccatgccaccctcacctgccctcccctctgctctccctcctgccaccccgcatcgcggagaagctctcctgaaattaattagtgtggcgtgtttacggtctctctcgcctccatcccgtcagaccccactcttggaacagagggcatggaagacagctttgccacttgttagctgtatcatcttgagaaaggacttctcttctctgagcctcagtttccccttattgaaaacactgataatagttgcacttatttcctagcatactttgtgaggcttcagtgagacaatttatatcaatcatttcacacaggaatgaatcataaatcataggatcatagatggtgtcattatttgtattctgtcatgtctgaagacagctcattttaaagaagatttgctggtgatggctgttaggggaacatctcgttaccattaccttcttcctggagcctttttatgctttttcttttcactctattcccctcccttttttttgcatctgaagtctgctggcagcacccagcggttccatttgtccataggggcaatggtcaaagttagacattaccgatcccaggggtagaactggaaagtcatcccatgtgaattgggtgtgacagggatggaggtggaagaccagaggaacacccgcagtatccccagaatccctaactccctccaaaccagatctgctagaaaaatcacgggcaattcgccaagccagagacgagaggacattccacatcttttactacatgattgctggagccaaggagaagatgagaagtaagtgactagcaatgacatgtgattggatggcttgagccttccctttcatcagaatccggggttaagggattggctattaaaacagtctcagatcctgccagaaaggaccatgtctgtgagtgacatatgaacagttcttcatctcctcccaatgagtgagtgtggcttgtgttcagtcattctcatttactgagcacctactatgtgacatagtagccatcaactccaattagacattagatcattaatgattcatgtctcattagaccagagagcatcaagtccaactagacacaatctacgccttcaaggaaagggagaaagacatttgccttacttgccaatttataaaacttgcaaatataaaagatgcattctggttttataaggaatttgcaggggcagcaggactaagcatttttcattatacatgttttgccagtgactttgtagaacaggggtcaagactttttctgtaaaaggccagatagtaaatcttcaggctttgcaggccaggtggcttctggcacagctattcaactctgccattgtaatacaagagcagccacaggcaatatataaaccaatgagtgcaggcaacacataaaccagtgagctcaggcaacacataaaccaatgagcacaggcagtacataaaccaatgagcacaggcagcacataaaccaatgaacataggcaacacataaatcagtgagtgcagatgcatcactgtgttacaataaaactttatttacaaaaacaggcagtgtgcagaagtttgctgacctctgttgtagggaaaagtttttttatgtaaatataatacactgtataccaaactccagtaggaagttatgagttctggacctgcagctgtttactaactcttaaaaatatatacaaatcgcatagcttaaaaaaggaatggatcagtgactatctgtacatagtagagtctacatgttagtaataagttttgagtctgaaattctatgggaacaatacagactttgcttcccatctcttttgtggcccaaggttagttattttggttaagacagttaccaaaaggatctgtgtgagctcagaacttcgctgtgtcggagtgtattgtagacctcagctactagggggtggcattatccattatttaaatttccagggtggggcaaagtggctcatgcctgtaatcccacactttcggaggcagaggcgggcggattacctgaggtcaggagtttgagaccagctcggccaagatagtgaaaccctgtctccccaaaaatacaaaaattagccaggtgtggtggctggcgcctgtcatcccagctacttgggaggctgaggcaggagaatcacttgaacctagaaggtggagtttgcagtgagctaagattgcaccactgcactccagcctaggcgatagagtgagactctgtctcaaacaataaaaataagtttccttaatggctggctttcaggaacataggctatgaggtggagcaatttttggtaaagggggaatgctgaatggattttttatgtaccagcaaacatggtatattagcagttacagtgcaggaccctgtggaatgggccagggaaaaatgttgacattccttttccttttatttggcacccaagaaaacagtttggttgtttggtaccttgggttccagttttgtgctttgcctctggtcttccagaaatgggcaagtatagggctcagaactaaattcccaggggccgtttgtattctagatgatagaactggaaagatgttaggcttttagaaagaaccaaatattgctaaatgcatccaaactcgggataatgaagtcttggcaaatacctcaatcctcgtgacttgaatcaggcatttcaagttaatccaaaagtttgagttaactggtgccttcggtcaatttaacctcgagtttatcaagcagcttccaagtgacttgacccataaaagaccttgattttgaaagaaaaatatcttgctgacgtctctccaaaagtataaccgaatccatcctaattaaagattgatctggaagaggatccttgatgtattggagggtataataaaagcaaatggtgcaggagaaagaaaggcaattataaagttgggggtgggggagaagctgaacaacaacaaaggaaatgtaatcataggatacagtttgacacagaatatctaattaatgtcataaaaagggagttggcaaactgtttttgctaaagggtcagtagtaaacgttttagactttaaggaccagatggcctctgttgcaactactcaactctgttgcctagtgagaaagcagccatgagaaataaacaaggacatcagagcagctgtgtttcaataaaactttatttacaaaaacaacaggggaccagatttgccaacctgtgatataagccttatatattgattcaactaaaaatagctgggggtggctgggcacggtggctcacacctgtaatcccagcactttgggaggctgaggcgggtggatcacctgatgtcaggggttcaagactagactagccaacatgatgaaaccccgtctctactaaaaatacaacaaattacctgggcatggtggtgggtgcctgtaatcccagctactcgagaggcaggagaattgcttgaatccgggaggcagaggttgcagtgagcagccaatatcgcaccactgcactccaacctggacaaaggtgaaactccctctcaaaaaaaaaaaaaaaaaatagctggaggaaaggaaaggtagtataagaaagctgcatttttgcctaccatagcaggaagtcactagatactatctaaacttgacatatccagaaatcgcctattacagcgattgtgctttgcctctggtcttccaataggccaaaagcacctgttacttttggcactgaggactggtttcctggaagaaaagttttccacagactgggcgggcagggttggggggatggtgtggggatgattcacgtgtattacatttactgtgcactttattattacattgtaatatacaatgaaataattatactagtcaccataatgtagaatcattgggagcttgttttcctgcagtcccatcggggggtgatgggggacagtgacagattatcaggcattagagtgttataaggagggcacatgtgcagctcacgatagggtttgcgctcctatgagaatctaatgctgctgctgatcttatgggaagcggagctcagacagtgatgcaagcgatgggcagcagctgcaaatagcggataaagcttcacttgctcacctgctgctcacctcctgctgtgtggcccagttcctaacatggaccggtactggtctatggcctatgggttggggaacccttggcctatgatatgtaatacataatggtatatacattataataggctagtatatatagcaagcctattgtacagagagatagtggtaactgccagataaaaagcagctaaaagagataaaagcaggtattatggagtaaggtagagttggagaagggatgtgacaggagaatgctatttttcattataaacctttggtagtaattgatttttaaaactcatgtgcctgtttgaatttgataaaaattttataaatacatgaataaggccaggtgcggtggctcacgtctgtaatcccagaactttgagaggccaaggtgggtggatcacctgaggtcaggagttcaagtctagtgtggtcaacatggtgaaaccccatctctactaaaaatacaaaatttagccgggcgtggtggcgggcgcctgtaatcccagctactcaggaggttgaggcaggagaatcgcttgaacctgggaggcggaggttgcagtgagccgagatcgcgccactgcactcctgcctggacgacagagtgagactccgtctcaaaaaaaaaaaaaaaaaaaaaagagtaaaggttgatctaactcttctgacagctttgtctctgaaggctgaaggcagggtgcctctagacaattgaggtaaaggcatcccttcctccaggtaaatgtaacttcgtgccagggattgtggcttagcaagcagaaccaaggctggatatcagctgcagtcactggagcagtgcacaacctgcaccgctgtgtaaggctggcagtggttggtgaggctgtctacgtgacgatgcgtgagggctttaaacggttcaagccttgataaagggaaaggaattatgatggcccagacccttgaccagatctcggtctcatgttgaaattagaagtatgtcttattgaccctgacctgtcttcctctccttctaggtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatgtaagcctcacaccttgagtctggagggtagcttgcctggataccagtggaacctgttaagaactcttctctggtcaggacagatttctgctctctgaattccccaccttccattaaaaaaaaaaaaaaaaaaggaggaaaatgaattttattctaggtggtttgtttgtgttgtagaaaagtggctgtataactagggttgcaagtaacccgagctggcttaaaccaaagggaaagtgactaactcagaatgttgagaagttcagggaggttaggcacagtggttcaggtctgtaatctcagcgctttgcggggccaaggtgggcggatcactttaggtcaggagttcgagaccaacctggtcaatttggtgaaaccctgtctctactaaaaatacaaaaaaaaaattagccagggctggtggtgcacacttgtagtcctagctactcaggaggctgaggtgggaggattgcttgaacccggaaggcagaggttgcagtgagccaagattacaccactccactccagcttgggagatggagctagactccatctcaaaaaaaaaaaaagttcaggaattcaagcttcaggtacagtgagatctaggtgttcaaaagatttttctagaacctaatttcttgtcttctatctctctcgactacattgtttctctataggatgcagtttgttgacagcaacatagctgggttccagcccttatattctttgggtttatgtccaaagaacagagtagattcccggcttaagttcctgaatggagtgtcattgactctgattggttggcttaggttgatatgcacattcctgagctatgcagcataggcagggttgtggaaagcgcagggtggtttcattatggtccctaagaatggattcttggagctgaaggtagagatgttggcctcatcaggaacatgtgggcagggtttaggggagggggagtgatcgaggcagtggatttactcaggcttttcctggaggggttgctctggtgatcaattgatattgatcaaaatcatccaaccaatggccaagaaacacactgggtcttgagaacaggacagctcagaaagaaattcttggtcgggacactgtgtttccagaaacgattttccttctgcgttagatgtgcctcagtgttgaaggttaatctctttcaggaacaccaggacagaactgtggaaagtttcccttccttcccacgcctacgcccgtttggagccccagaatagcactgaggttgctgaaatgctgcataaggggaggggcagctcctccgaagataacttggggtctggaaaattaggctgtatgggtcagttgacaaatggatggtgtatgtgggtcttggccagggtcccacatcagaatctagtgctgatagcctccttgtctgaatgacataggccctccaagaatgattcatttcatttgggacaggggtcagttttgcttctaatcttgcttttaaataacaatgaacaatggttaagtatttgctgtgtgccaggaatttaccaaatccttttttcttgatgtactacactgttcagtatagttttatttaaataataaaaaactggaacaggctgggcacagtggctcatgcctgtaatcccagcatttggagacactgaggcaagaggattgcttgagcccaggagttcgagaccagcctggataacacagtgagactctgtctctacaaaaaaaataaatagaaaaaaactggaacaaactaaaataggttgattaatagagggtttattaaatcattgtctgtccttgtgaaagaaaacaatgagaccatttaaattgttttgctgggcatggtggctcacgcctgtaattccagcactttgagaagccaaggcaggcagatcacttgagcttgagtttgagactaacctgggcaacatggcaagatcccttctctacaaataatacaaaaaattaactgggtgtggtggtgcacactgtagtcccagctacttgggagactgaggcaggaagattgcttgagcccaggaggtcgaagctgcagtgagccgagatcacaccactctgtcacctaggctggagtacggtggcgcagtctcagctcactgcaatctctgccttgcaggctcaagcagtcctcccagctcagcctctcaagtcgttgagactacagacatgtgctaccacgcctggctaatttttgattttagggtttttgttttgttttgtttgagatggaggcttgctattgtcacccaggctggagtgcagtggcacgacctcggctcactgcaacctctgcctcctgggttcaagcaattctcttggctgagcctcctgggtagctgggattataggcgcccaccaccatgccccactaattttttttgtatttttagtagatactgggtctcgccatgttggccaggctggtcttaaactcctgacctcagatgatccacccatcttggcctcccaaagtgctgggattgcaggcatgagccaccgtgcctggcctggggttttttgttttgttttggtttgatttttggaggggtgggtagagacaaggcttcaccatgttatccagtattctctggtcttgaactcctgggctcaaacaatcagcccaccttggcctcccaaagtgctgggattacaggcatgagccaccatgcccagtccccagtgttctcaatgtactttggcacttgtttcccctttaaccacagagaccagactccaggcccagcaccttcggcagccccaagcatctagctagaatttggtaatactgttttccttgtatttatatttataattgccatctatttatggcaagtgaagatgatttttcactgaagatagagaaagttttctattaaaacaaatgtaaggaaagagaaggaagtaaatttaaagaaaatgattaagcaaataatggagcagatggtacacagagcaagcattcagacgatggcgtgcaaatgacgaactctcataggaaccaacttagtcctaaatgtacaccaaccccatttataaaccaagagctacttccaaaccctccatcaaggggcctatggagaagggggtgggtcaggcttcaggctggagcttcatgaggctccaagtgaccaggggacaccaggattttccccaccacattgggttctgcagccttgaactcctggcctcaagatatcctcatgcgccaccatgcctggcctggttatactgcttctaatgtattttgaagataaaaaataaaatcacctaaattgtccatcctgtgtatccctggtggtacacatgtctgatgttggaaagtcctgtttcttattcctcagcaagaagagaggtgtaaggccactgtaaaaaattagcacaaacttgatgccttaaaacaacaggaatttattctctcccagttctggaggccagggttctgaaatcagggtgtcggcaggagccgggcataatggctcatgcctgtaatcccagcactttgggaggccaaggcaagaggatcgtttgaggccaggagttcaagaccagcctgagcaacatagcaagaccccttctctactaaaaatttaaaaaaaaaaaatttttttttttttaaaagacaagatgttggcaggggttgttcctcctggaggcactgagggagatctgttccttgcctctgtcctggcttctggtggctctggctgttcctggcttttccttggcttgtctcactccagtctctgcctcatccttcatgtggcattctactctgtgggtcttctcttctgtccatcataaagacacttgacattaaatgtagggcccaccaggttaatccaagatgatctcatcttgagatcttgtacttgattccatctgcgaagaccgattttttccaaaataggccacgttcaggctgggcgcggtggttcacgcctgtagtcccagctctcagggaggcagaggcgggaggatagcttgagcccaggagttcgagacctgcctgggcaatatagtgagaccccggtatccacaaaaaggaaaaaaaaataaatgtaaccccccaaattaggccacattcacaggttccaggtggacatattttagaaagaccaacattcaacctaatataggtggcttccactctttatcacctactaggccaggcccttgctcagcatcttacaagacctaaacttcacgaagcaggtactactgttaccatctccgttttgcagatagggaaactgaggctcatgggacttattgagactcatgtagagtctctatcctctattcatccatgattcatccatcaatccatcctctatcatccatctatcctctactcatccttccatcacccatccatccatcacccatccgtccatccatctacccacccatccatccatgaacccatcctctatacatttatacattcatccatccattcaccctccatctgccatccatccatctccctccctccccatgtgtatctggacccggaactaggatttggaaattcagagataatgagatttataagaagcaaagctgggatttgaactcaggactctctaactgcagagcgcgtgctttgcaccagcacaccaggatgctgccagccgtcaccacccttgctgtgttgtgtctcctcactggtttacttctttgctgtctgctaattctgccccaaggttcatctcttatggcctgggagtggtggcattcttttgtcatttctggaattacatttaactataccagaaagtgcaaaccaatggttcctgagcccacaggagagatcggccactacaaccttcaaaatttttagaaattggttcctaaagtttaaatatgggtaggccgggcactgtggcctataatcccaaccctatgggaggccaaggcacatggatcacttgaagtcaggagtttgagaccagcctggccaacatggtgaaactccgtctctactaaaaatagaaaaattagccgggtgtggtggcacacgcctgtaatcccagctactctggaggctgaggcaggagaattcccctgaacctgggaagcgcagaggttgcagtgagccgagattgcaccaatgcactccaacctgggtgacagcaagactcagtctcacacacacacacacacacacacacacacacacacacacacacaccaaaaaacatgggtacacttcacataaaaactctgggtttccattatctagaaaaatcagaagttccagcaacacttggcttatatcccctgtggcaatgacggagtagctgctggccccttcagatgggtttgtggcctccttgggtccccacagtcctcattagttggctttgttcatttagaccagtggttctctgccagaggtgagtttgcctcccaggggacattgagtagtatctggtgacatttgtggttgtcacaactctgtcagggtaaccaccactgacatctagtggttagaggccagggatgctactaaacttcccatgatacccaggacagctccccacaatagagaattatctggcccccaatttctgcagtgacaagattgagaaaccctgagttggccggctcgcctgggctgtgcaggcatttcaggaatctttagtttaaattgacacttttaaaactgtgagtgcaactcttcatagtttacaaagactctttcatagatgttatggttaaaaggaagtgtgtttccaagccctgtcaacagcagcttcattcattttggggagaaggctttctaccatagtaagtgggagcaaatggatgggtggtcagcagctgggtccttttgctgagctgggccagggaccccatggcgtgagaatagctgttgtgaagggccttgtaatgtctggtttggcctgaggaaccagagaagtctgggatctctaggctttgttcctggaacatagtgactgatttgaagccagaactctgggtgatttgtacctgagttaagctaagccaagaatttgcattaatcatcatccatccattcatccatctaccatccatccatcatctgtccatccatccattcatccatccatcatccatccatcaatgctgtatccattcctccatcaattctccatccatctatccatcgtctatccatcaatcctctgtccattccatctatccatctatcctctatccatccatccatcatccgtctatcctctatccatgaattattcatccatcaatccatcctctattcatccatctatcctctactcatccgtccatcattcacccattcatctacccacccatccatccatccgtccattcatccatgaacccatcctctatccatttattcattcatccatccatccaccttccacctaccatccatccatctctctccctccctcccatgtgtatcaggaccttggaataggctttggaaattcaaagatgattagggcaggccctccactctccagaaactcatggtcttatggggatttcagacatagaaactattttaacagtaacatggcctgagtatggagtcagaaaggttccaagtattctgggaacacagcgtttttgtttggagacacctggacaacaagtggaaacaaatgtatatcttcttcatcccaacatgggcatctgttacacccagaagagtatgtaagaagcacagggtttttatttcaaaaatccttttattgacatatgatttacatggagaaaattgtgtatgccatagcgtgcagtgcaaagaattattataaactgaacacgtctgtgtaactagaatccattttaaataagacaatgccaccagccccatggaagctcccacatgcaccttctaagaacttccctcaattaaggataatcattatcctgacttctaacagcatcgattagttttgcctcttcttgaatggacggtctatatatggacttagacagtatgttcttgtttccatctgtcctcttttgttcggtatttgtgtctggaagatatgtcagggttttttttttgttttagagacaggatctccctacattgcccaggctgtatcaagctcctggcttcaagcagttctcccacctcagcctcccaaagtgctggggtcgcaggcatgagtcactatgctggccccaatacatcagttttgatttgtggtagttgtagctcattcattctcactgttctgtggcaggggttgctaacacatttttctgtaaagggtcagatagtaaattctttagcctttgtaggccagacgatctttgttgcaactcattaactctgccagtgtagcatgcaaatagttacagacaatatgtaaatgaatgagtatagctgttttccactaaaactttatgtataatagcaagcagtgggccagatttggtccatgggctgtaatttgccagtccctgctgcgtggcattccattgtaatgcaaggttttaagcaaccatatgaaaatattgagctcagaatctagtttcttcagaggaaagatgtaagctggctctgggtccccagtggctttaggctccaaaactccagggtaccttggcattgacctttgtgtctgctctgcccttctctccccacctcagccatattgaaggtggtatcatcggtcctgcagcttggaaatatcgtcttcaagaaggaaagaaacacagaccaggcgtccatgccagataacacaggtacttgccactttttcctgatgaccaatgactttggggttgggggggtgggggaggtgacatttaaccactggttatttttcaaggtgaaggtatctgggattttaacaacagttggactaggttcttatcactcactttttcaaacttttcagtgctcaagaccctatgtggaaagttattgaatcagagcgcagggattaaaaaaaaacaaacctaatagttttatttatttgttcttttttttaaatacaaaattttacaagttttaatagagacgaggtctcgctgtgttgcccaagctgatcttgaactcctgagctcaagtgatcctcccaccttggcctcccaaaatgctgggattacaggcaagagtcatcacgtcctacccctaatagtgaccagacaagatcccgagggaccatctcttctaaaataccccacttaattgttttgttaaagaaatatttctcaagcccctgcaatatgccactgggatacagcaggaaatgacacaagaatagctcttcttacggtatctgtggtcgtcttggggagacagacctcaattgccctgagaattaggggtgccagataaaatacaggatgtccagataaatttcaattttaggtaaacaacaaacctttttttaaattttaattatgtcccttgtaacatttggaccgtgattataccaaaagagtattcttgtttatctgaaattcaggtttaactgagcatcctgtaattttccccctaaatctgataaacctacccacaaataaacagtattttgtgttttgagaagctggcctggctaccactatgcttgttggtggctgagctgagagcaaaacttaggtttcttatttcccagcccaggctgtatattgtgttgctttttcccgctccctagagcccaccttgatcaaacctgttgcaaccgcttactgggtttaccttgcccacagcctagacagagccaattaatcaagacaggggaattgcgatagagtaagagtaactcacgcagagccggctgcatgggagaacagagttttattattactcaaatcaatctccttgagcattcgtggatcagagtttttaagcataatgtggttagggggaggccagtgagttgggggtgctgattggttgggtcagagatgaaattacagggagtcgaagctgtcctcttgccctgagtcagttcctggacagaggccataagatcagatgagccagtttctcgatctgggtggtgtcagctgatccacctggtgccagggtccgcaaaaatatctcaagtactggtcttaggttttacaatagtgatgttatccccaggagcaatttagggagggtcagactcttgtagcctccagttacaggactcctaaaccataatttcaaacctttgggctaatttgttattcctacaaaggcagtctagtctccaggcaagaagggggtttgttttgggaaagggttcttgtgttttaaactataaactaagaggctaggcgtggtggctcatgcctgtaatcctaggattttgggaggcccaggcaggtggatcacttgaagtcaggagttcaagaccagcctcgccaacatggtgaaaccccatctctactaaaaatacaaaaattagccaggcgtagtggcaggcgcctgtaatcccagctactcaggaggctgaggcaggagaactgcttgaacgcaggaggcggagattgcagtgcgccgagattgtgccactgcactccagcctgggtaacagagtgagactctgtgtccaaaacataaaaaataaactataaactaagttcctgccaagttaattcggcttacacccacaaatggttcagtggagcttggaggttagaagcaaggtggagtccgttaggtcagatcttgttcagtgtctcagttataattttgcagtggcagtttcattctcaggtgtttgttatgtattagagtccctaaatctggcaaattaatggaatccggatgccaaggaaagacctcagggaaagagaaatgaaaaagtgctcttgccaagagatggggaaaaaaaaatcctaaaatcactctatttactctgccttgcacatgcaaagcagcatgtaatgctattttcatgttaagggaccagctcgtggtcacaccactgcacttcagcccgggcgacaggaagactgcatctcaaaataaaagaagagcatttaggttgactctagcattttgctattgcaaacaatgctgcaacacatatcctagaagggtgaaagaaatatttattgaacagtaactgttcaataaatgttactattaataactatttaatacttactaagtaactgttaaataaatctcaagggccagtggctcacgcctgtaatcccagcacttagggaggccgaggtgggcggattgcctgagttcaggacttcgagaccagcctgggcaacacggtgtaactccatctcaactaaaatacaaaagaaattagctgggtgtggtggcaggcacctataatgccagctactcgggaggctgaggcaggagaattgcttgaacccggaaggcggaggttgcagtgagctgagatcgcgccactgcactccagcctgggcgacagagcgagactctgtctccaaaaataaataaataaataaacaaataaataaataaataaatctatctatctcagggactttacatactttaccttatttagtcctgggtaccaacaaggtaccgaagagctgaccctttttaaagctgagaaaagcaagatgctgggagggtaaagagcttttccaaagtcacatgacttggaagtgtgaagggacagggacttgaaactagaactacctgaccctaaacccccaactggggcctgcttcagcccaccccaatcattgcctctcagcaaaatactggggagtgtgaccactaatgacagcagcctttaggacacttcaagctatattcatggtcagcgggtcccatttccccaagagaacccgctgtattcacagatcacaaatatcccatgcgatgtgtcttcttgccaagctatttcttttgtgatgcactcacgatgtttcttttctccatccagctgctcagaaagtttgccacctcatgggaattaatgtgacagatttcaccagatccatcctcactcctcgtatcaaggttgggcgagatgtggtacagaaagctcagacaaaagaacaggtaatgatgtacttatcacttatccatccatgcacccacccatccatccattcatccatctatccacctgttcactcattcatgtattcattaatccattcacccatggtctgcctctgcatctgtccatccatccatctttctacccactcattcatctgtctgttcatccatccatccatccatccattcatctgcccatctatctgctcacccatcatctctccatccctcactcatccatctgtccatccatccatgacccagccatctgtccatctgtccgtccatccatcacccatccagctgtcattccattcattcattcattcattcatctgtccatgcatccacccatccatctctttatccctcatttattcaatactagaatattcacagtcccatgtcaggttttgtttgtttgtttgttttttgtttttgagccagagccttgctctgttgcccaggggggggtgcagtggtgccatcgcagctcactgtagcctctgcctcccagattcaaacgattctcctgcctcagtcccccaagcagctgggactacaggcatgcaccacaacgcctggctaatttttgtatttttagtagagaagggtttttgccttgttggtcaggctggtcttgaactcccgacctcaagtgacccacctgcctcggcctcccaaagtgctgggattacagtgtgagtcactgcacccggccaagaataaaaatcttcaccaccagcctggcttatgtgaaaatggagcccattgagaataaccgggttcccctggttgccctctgcaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtacagctcggtgggatcctaagagccatggtcttggttgtctgagatgggctttttcttggaggagtcatgattttggagaaaggcatgtagatggctactgtagggtaggaggctgtctagttaagggtggatcattgagggtataagagacagaaatccaacaggaaatgcattggtttctggaactgagaaggccagacatgtagctggatcccgtaggcagggtctgatctcccgccatcgttctctctctctctctgccttcctccatattggctccattctcaagcaggctctcccctcacgggggcaagatggctgccacagctccagactgcctctcagtaatcctggtaaaaaaaaaaaaaaaaaaaaagcacatatctcttttctaacagttccaaccaaaatcttggaattaagtctcactgactcttactcacctgaattgggctacatggtcacctccaagccaagaactgtttgcaggagcttgcaatacctcatgtagtagaaacatggatattggatcctttacccatgggtttgaagaaagttctcagagaaagggaaggttttttttttgtcttgtcttgtttttttttttttgagacagagtcttgctctgtcgcccagactggaatgcagtgtcacaattttgtctcactgctgcctccgcctcctgggttcaagcaattctcttgtctcagcctcctgagtagctgggactacaggagtgtaccactgtgcccagctaattttttttttttttttagacagagtctcgctctgttgcccaggccggagtgcagtagtgcaatcttggctcaccgcaacctccgcctcccaggttcaagtgattctcctgcctcagcctctcgagtagctgggattagtgccaccatgcctggctacttttttttttttttttggtagagacagagtttcaccctgttggccaggctagtctcaaactcctgatctcaaatgatccaccagcctcggcctcccaaagtgctgggattacaggtatgagccactgtgcttggccaatttttgtatttttagtggagagaggtttcgctatgcttgccaggctggtcgcaaactcctgacctcaagtgatcctcccgccttggcctccctaagtgctgggattacaatcatgagcactacacccagccaggaggttttaagattgatagatgtcccgaaagaagtgtactaccgagtcactttctctctgcgcctctgttttcacatctgtaaaatgtttccacatctgtacatgcagtagcgtgccttacgaggtttgtccatccatagatggttgtgcagatggaggagataagcatctttaaggtgtgtgagggccatgtgatatcaacttcaccagccctggtggactctaggcagcatgttttggggcctcagccctgtctgggtgctgggatggcagaacaggatgtgggcgggccatgggggcgctgtcgggtggagcttctgtggggctccttgtcttctgacttcataccaagatgctcacgccccgcccccacgccatgtgctcaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccggtgaggggcacgtgggcgtgcggggctccgtcacaccttgtacacgtgtgtggcctctgtggagccgacgtggaccccacactctccccatgcacatagcattcccccacccaatccatcacccagtcctgaaaggctgtaagctgaatccttgtgaactcttacaatttccattaacccacattttcatatcaaaggtattttctttaatttctgccttccttccatcctcttttttcttcctttttttcttccctaccctctttcccttccctttccttctctgccattgctttttttttttttttttttttttttatgacatggtctgactctgttgcccaggctggagtgcagtggcacaatcttgcctcactgcaacctccacctccctgcctcaagtgatcctcccgcctcagcctcccaagtggctgagactacaggcgtgcaccaccacgcccacctaacttttgtattttcagtagagacagggtttctactaattagccgggcctggtggtgcacgcctgtggtcccagctatttgggaggctgaggtgggaggattgcttgagccctggaggcagaggttgctgtaagccgagattgcgccactgcattccagcctggataacagagtgagaccctgtctccaaaaaaaacttttctaacaggaaccctaggtgaattcaagtcaagcaacaaattcatttgcaagaattatgaactcggccgggcgcggtggctcatgcctgtaatcccagcactttgggaggccgaggcgggcggatcacgaggtcaggagatggagaccatcctggctaacacggtgaaaccccgcctctactaaaaatagaaaaaatcagccgggcgccgtggcaggcgcctgtagtcccagctactcgggaggctgaggcaggagaatggcgtgaacccaggaagcggagcttgcagtgagtcgagatcgcgccactgcaccgtctgcctgggcgacaaggcaaaactctgtctcaaaaaaaaaaaaaaaaaaaaaagagttatgaactcttcatgatgttgcctgcgtgttgcccactagggggcggcagcaaacattatgttctgccttccatccctgttactggtccattgggcacagggtaatttgaaggtagatttggaagcatgggggtcataaactcatctttatatgtgggcaaatacagtatcagatctcggcggatgcccatgcgttgtgtatagttggccagctcttcatggaatgcctgaggttgggtgttctctctgattcaagccctacttgtctcccacagaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtaccagccacagggcccaggggactctgtctcaggggacccccagtggctgctcagcgcagagacagtctgagagtggcagaaccttgggctgcctggaaactgcaaagccatctgctgctaagcgaatcccaaccaagtcctattcgtaatttgtctacgcatctgtaaggcatcagctgtagccactctcatgttttccaaccgtgacgtccagacagttatttctttctgtttttgttggagacagggtctcgctttgtcgcccaggctggagtgcagtggtgcgatcatagctcactacagcctcaacctcctgggctcacacgatcctcctgcctcagcttcccaagtagctgggactacaggtgtacaccaccatgcccagctaaaatcttttttcctttttgagatggaattttgctcttgtcatccaggctggagtgcaatggcgtgatctctgctaactgcaacctctccctccgggttcaagagattctcctgcctcagcctcccaaatagctgggattacaggcacctgccaccacacccagctaatttttgtatttttagtagagaagggtttcgccatgttggccaggctggtctcaaactcctgacctcaggtgatccacccgcctcggcctcccaaggtgctaggattacaggcatgagccaccgtgcctggccgcccagctaaatttttaaattatgtatagatatggggtcttgctgtgttgcccaggctggtcttgaattcctgggctcaagagatctccctgcctcggcttcctgaagtgctgggattatgagcacgagccactgtacctggcctcagcctgcttttcttgtatagactctaaatccttcctgctacaagttatacccaacaggcggggccaactggaatggggtgactaatacatccacacctggcttcaacaaaaatctcccatgtcacggtcttgagtttgctattgccagcctgctctggccagggaaatctatgatagttgtattcatcatcatcatcatcatcatcaacatgccttggctgttattgtataggcccttgccctgtggctctcaagagtcctggataatgtacaaaggacatagcttagtctggcttgcagaattgtagtattctattgactcctcagtacctccactgcatcatgggcacaaacaatgctctctaccagggcctggcaacagagtccgatctggcccacagcttgttattgtaaataaagttttattggaacacagccatgcccatttgtatgcataatgtctatggctggctgcttttgtatactacagtgctagagttgagtagctgcgacaaagactgtatgacttggctgggtgtggtggctcacgcctgtaaccccagcaccaaggcaggtggattacttgaggtcagcagtttgagaccagcctggctaacatggcgaaagcccgtctctgctaaaaataaaaaataaaaaaaatttaaaaattagccagctgtgagattacaggcacacaactgtaacctcagctactcaggaggctgaggcaagagaactgcttgacccaggaagttggaggttgcagtgagctgagactgcaccactgcactccagactgggcaacagagaaccactctgtctcaaaaaccaaaacaaacaaacaaacaaaacattgtatgacttgccaagccaaaaatatctactatctgggccttcaccaaaagtttcccaactcctagcctatattcaagggggtatatgttcctttaagcatatagagacaacacttttcttttccctacttcatcagtggattttttttattattattttcagtcttctctcagatcaagcctacctattatcctgataacccacatcccatgataacccagcaaagctgtattatcagttcctttcatttaatattcaccatagtaaaaattacggctttgggcattgtcattgtttgagtcaggaatgtaaaaagcctatatgtcctttttctgtatatccatatatcaggatctctgagttacaaattatgctcattagagagtggaaaataggatgccatgcttaattaatttatttatttaattattttgagacagagtctcactctgtcacccaggctggagttcagtggcgcaatctcagctcactgcaatctccgcctcccaggctgaagcgattctcctgcctcagcctcccgagtagctggcattacaggtgtgcaccaccatgcctggctaattttttttttttttttgtatttttagtagacatggggtttcaccatgttggtcaggttggtcttgaacgcctgacctcaaatgatccacccaccttggccttccacagtgctgggattaccagtgtgaaccaccacgcttggctgccatgcttaatttctaaaccaggatgattgggaagatgatgaggggggagttttgcatgtcggcaggagggcatctgccgtcatgaaatctcttaatagtgtataactcacaggtactgtgctggcttaggaggagggaggctaccacagcagcgttagtaggagaatatggaatggaaactaggctttcccagcaatggctatcactggctgatgtcctactacgtgggcacaggtccctgggctgttggtctcttcactggtgtttgtggagtcccatcatggtggtcataaacgtcatttcctctctgacctcagaagatctggaaggacaatgggagggctggggtcctggccttggtttctaagtttctagtttcccaggggttctgaccagcagggtgtccttggcaggtggactataatgcgagtgcctggctgaccaagaatatggacccgctgaatgacaacgtgacttccctgctcaatgcctcctccgacaagtttgtggccgacctgtggaaggacggtaaggccttctctgctcgggtccatgttctgctttgagctggagaattgaacacccaagtcccccgactctcacacctgccccaggaggggaggcctttacatgggggcaggggaaggaagagcattggcatgggctggtgatgtctcgttgaaacaatttcttcctgagtgggggtccctgagcccctcaatcctacatgtcccgaggggattgaggtcctgaggtcagggctcaggcaatagaggagaaacagcatgccaggcacggggagttagactgccctgtccagagtcagaaggacttcactgtatcttgtctctgccacctcctagctctgtggtcttggatgagtcacttgatgtcattaagcttcattgtcctcattagtaaaacaggagatgcaataatagttgccgtctctactagaggtattatgagggttaaattagaccagtgatgctcaaactcaagcaggcatcatgaccccctggaaggctttgtttatttatttagggacagagtcttgctttgtcacccaggctggagggcggtggtgcaatcttggctcactgcagcctccaccttctgggttccagtgattttcctgcctcagcctcccaagtagctagcattacaggcacacaccaccatacctggctaatttttgtatttttagtagagacggggttcccccatgttggccaggctggtctcaaactcctgacctcaggtgatccgcccacctcagcctcaaaaagtgctgggattacaggtgtgagccactgcacctggccctctttggagggctttttaaaacccagatggctgggcctaccctaagatctaattctgcaggtctggggccagggatggggcgggcctgaaaacattcatcccaggtgatgctgctggtctagggaccacactccggctccctttgagaaccagtgaatagatgatccctgtgaagagctgctggagtgatgatgaggggagggggtttgctgtttgtccctggccatcagtgtccacagcaggttttattcttggcacagggcccatgggcctggggcttacaggactggtctccccttgttttaagcatgctaaaaaaagggctccaggaggggccagctgtgccctaaccatatgccaggctctgggcctagggaacaacatcgcaccctgggtctgtgtcatcccaggacacatgatgaagcctgtagtccctcctctgcgggacccacagtcttgtgggagagatgagactctcaaagacaagcagagagacaagcatgaggctgcgcatggtggctcacacctgtaatctcagcactttgggaggctgaggcaggaggatcagttgaggtcaagagttcgagaccagtctggccaacgtggcgaaaccccatctctactaaaaatacaaaaactaactgggcgtggtggtggtaatcccagctactcgggaggctgaggcaggagaactgcttgaacctgggaggcgcaggttgcagtgagctgagattgtgccattggactccagcctgggcaaaagagcaagactctgtcttgaaaaaataaaactaaaaataaaaaataaaaacaaaattagccgggtgtgctggtgggtgcctgtaatcccagctactcaggaggctaaggcaggagaatcacctgaacctgggtggtgaaggttgcagtgagccaagatcgtgccactgctctccagctgggcgacagagtgagagcttgtctcaaaaaaaaaaaaaaaaaaaaaagattgttacacagaatctgagtagaaggtgaagaaatggtgccatccatggcctgtgggttgggcttggcatgtgcaggacctgctgggctggtagaaaaagaaccttggaggtgatgatgatgatgatgatgatgatgatgatgatggccgggcgcggtagctcacgcctgtaatcccagcacattgggaggccaaggcaggggaatcacctgaggtcaggagttcgagaccagcctgaccaacatggagaaactctgtctctactaaaaatataaaaaaaatgagccgggcgtggtggcgcatgcctgtaatcccagctactgggaggctgaggcgggagaattgctggaacccgggaggcggaggttgtggtgagccgagatcacgccattgcactccagcctggccaacaagagtgaaactccgtctcaataaaataaaataatgataataataataataataataataataataataataataatacctactttttgttgagcacttactgatgtgccaggctatctcggagtgtgtgctgtatcttctgcctcagaatatttcttccgtggatacctacatggttacccactcatttcttgctggtttctgctcaaatatcaacttagcagagcccaccacctccttgtctaagagagcaccctcttcactctctctccgctttaccctatttttatttttctacgcacacctcactactcaagatattccatacttaacatctgtgatctctgtctgtctccttccctgtgatataagcggggtgagggggccgggtctttttttgttcacagcagtgtccccagggcctggagcacagaaggtcctcaataactatttgttggtggatgaaagattggaggctggcagggaataagtgccttctgtgccttatttttttttacccctgccctagaaggtagacggtattattacctcccttttgtagaaagggagactgaggcacaggatagtgccaagccaaggctagtcagtgagtggacagcgagagcaggcttgactcctaggtcagcgtgactccatcacagggaatttgttctttctgccactcaggtgctctcaggatttccccaatagacaatacttggaaaccctgactgccgaaggaggcgttggtgatggaaggaaagattggagtgggcaggttggtgggtggggctggggctgagcctctggcctatttaggggtgggtgggccagaggctgatgccaccctggctgtgccccatagtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagagggtgaggcccgccgcccagaccctggggctcccagaagccagggctgtcccaagcggtcacagcgtccccagggcgccctctgcccccacctaccccgaggaccccattttccatgtggggaaggctatctgaatctcagacccattccccatccctggaggaaaaggaggaagggaggatgcatccagagacttttcagttgtggagttgctgtgcaggtcatccagccactcattcattcattatcccaggaagtattcactgggctctgccctgtcctgggtgctggggagcagtgttagaaaaattgtagcccttccctgtgggtttctcataatctggtgcaggcatcttcagcttggggcgattgtgtcctctatatggacatgctacagacatttttggttgtcacaaccaggagggggctgttagtcagcatctagtgggtaggggccagggatgccctaagcattgtacaatgcacaggatggtccctcaacccccagcacagaatccctacaagatgccagtagtgctgaggttatgggagacacggggagaggtaaacatacagctgatgatggtgatggaatgtggtcagttaggagaacaccaaagagccagggctcctcccacagcctcaggactcagagaaagcttctggtgaacttgaacgttaagaatgtgtggccatcaacttggtgacatggaaggcagggtggggcctaggataagcagggggcctaggataagcagagggcccaggctaagcaagagtgtggaggtgagaagtgaaggaactaggtaagaaaatgctagatagtgtccaggcgtgttgctcacgcctgtaatcccagctactcaggaggctgagaaacaaaaatctgttgaacccaggaggcggaggttgcagtgagctgagattgcaccacagcattccagcctgggcagcagagcgagactccatcttaaaaaaaaaaaaaaaaaaggaaagaaaatgctaaataggtcatttcatgttgcaaatgtgtgatggcatgaggtaggaatcagatggtgtgaggtaggattgaggctgaatgggtaggcaggggctagatcgtggtgctccttgtgttctttctggagcttggccttctctctctaggcatgccattgggggtgttaaagcagggctatatcatggtcagatttacattttaggaagtgaatgagggggctgggcatatgctagctcatgcctataatcccaacactttgggaggttgaggtgggaggatcacttgagaccaggtgttcaaggctagcctgggcaacatagcaagaccctatatctacaaaaacatttttaaaaattttccaggcatggtagcacatacctgtggtcccaaatacttgggaggctgatttgggaggatcacttgagcccaggagtttgaggctgcagtgagccatgatcgcaccactggactccagcctggctgacagaatgggaccctatctcaaaaaataaaaaggacaaagggattgaggggagaggcaagaccagagagagagaccaggtgggtggtttctgtggttgtccaggcaggagaagatagtggagacaatggtggtgaagagaagtgggggggttgggagatatttgggagctagaagcaatcaaactgctgatggacaggaagtgagggagacgaggtgatgaggaggaagccccaggttccagccaggcgatgctagtgtcaccaagaaccagagagatcatgaggcagccattgccgaagcaaagagatgaaaacccagaggggggcactgctttgcccctcggccctcagctaagccctccttgggtgcttctgttggtaccctcatggcctggccaggtgggtcatccaggtaggaggtttggggctttgctgcgccatggtttctggccccagggatccactgccctctttgacctttgcagtccggcaagctggatgcgttcctggtgctggagcagctgcggtgcaatggggtgctggaaggcattcgcatctgccggcagggcttccccaaccggatcgtcttccaggagttccgccaacggtaagtcccaaggtctggcccaggtagggcagggggtgagcgggactgggtggaggaatggatgctggaggtacccggggtgacttctgctctgtgtttcaagctacgagatcctggcggcgaatgccatccccaaaggcttcatggacgggaagcaggcctgcattctcatggtgagcccagaagtccaccagagacctcccaacctctggccgcaagccacctgctgctcttggtgggaccgttcttacccatgtcatcactggccaaatggcacagtggaaatcaggagctcttcctttccttccttttgcagatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaagtaaagatgctttcctgcatcctaatacctcaaacgcgaatcacaaacaggggcctttctgttctgattccctgattctaagaggccacctgtttaagatgcatcattgactgaatgacagccttttcttgaaggggaagaaatgcttctactttaaataaatgtaccaagttacgagtgcaggaagggaacgagttttagacctgggttctcatcgtggatgccccagtttttgctgatgaaccttgggcaagttactctacctctctgagcttccagttttttagctggaaactgagcataatcattttgacctcagagagctgttcatgaggtgtcactaagataacgcatgacgagagcttagaacagtgcgtggttctcaggtcagaaatgattgttgttgtttttacctccctccctcactccttccttccctccctcccttccttccttcctttcttcttcctttttgagacagagtctctctctctctctctgtcgcccaggctggagtgcagtggcgcagtctcaactcactgcaacctctgcctcttggactcaagcaattctcgtgtctgagcctcccgagtggctggaattagaggcgcccaccaccacactggcctaatttttgtatttttagtagagacaaagtttcaccatgttggccaggctggtctcaaattcctggtctcaagtgatccacctgccttggcctcccaaagtgctgggattataggcatgacccactgcgcccagcctagacatgttagaattggataaaccattgaggaaagaggacttgacggtgtctagatccccgtgtcccagtgggatttataaggcagggttttggagggtgtgatgtcccagctgttctgtgaagactgggagccggggaagggttcgggttccttaatgaaagtcataccccagggactgcagggacaggtggggtcgctctctgtctggggtgtgtgttgtcattgggcagagaccacaccctcaccagtaggaccctgatgtgtcaggttcattcattgacacatggacccaagatggtcaaggccagctttgggagctcttggccctcccgcaacagacctaacttgtcaagtttcgttactaagttccctgttgctgtccttcctggataactggggcaattttattcttaaagttttcctgtgtccaagatggcagccaagcagggaagacagaattacgttcactgttctatcgtttctcaatctatcgatagcccttaaacgggaagagtgctggttcagggtcacagtgtgaaattcctaaaacaacccaggagagaataggtttgacagggctgggtgtggtagctgacacctgtaatcccaggcactttgggaggccgaggcaggaggattgcttgagcccaggagtttgagaccagcctgggcaacatggcgagacccctatctctaccaaaaaaaaaaaaactttaaaaattagctgggcatggtagcatgtgcccgtagtcccaactacttgggaggctgaggcaggaggatcatttaagcccaggaatttgaggctgcagtgagccatcatcacaccactgcactccagcctgggccgcagagccagaccctgtctctgaaaataaacaaataaataaataagttagtcagaaacagctggtgtaggctgggcatggtggctcctacctgtaatcccagcactttgggaggccaaggtgggtggatcacctgaggtcaggagtttgagacccacctggccaacatgggaaaccccatctctactaaaaatacaaaaattagccaggcatggttgtgggcacctgtaatccaagctactcaggaggctgaagcaggagaatcacttgaaccccggaggtggagtttgcagtgagctgagatcgtgccaccgcactccagcctgggcaacaagagcgaaactctatctcaaaaaaaaaaaaaaaaaaaaaagaaagaaagaaaaaagaaacagctagtgcagctggggagtacgggagcccccttaggaatgatgcacatagttgtgttttctgagtggtgtttggatctcagctaagtccagggcatgttgtgagccctgggtcttccttgtccactgaaaaaggctctgtcctgtagatgatttaagttgtttgcagccagacaacacatgtgtcacacagggtttctggaagaacctgagttggggagattggggcatgtccctgtgcaggttcaggatgctgcagggcagggctctgttgacagcagggtgtggcttcatgacccccgcaccttctcttcccccctccctagggcttttgccaagaggcagcagcagctgaccgccatgaaggtgattcagaggaactgcgccgcctacctcaagctgcggaactggcagtggtggaggcttttcaccaaagtgagtgctctgccccagcccccttcccaggggcccccagccctggttcttcactctggagccttcacatttgggacaggaggtggtcgcaagtgggtgtggaatggagggctcgaactcagaccttgagcattggcggttctctggcccgaggaggccctgtcctttggcacataggctatagccaggaccttaacacaaagtattaatatttccatccgcactggaatccctcgtgtggcccatttatagccacacccacttcctccgtagccatggaaaccactctgttctccagttctgtaattttgatggttcaagaatgctgccgggggcggcggctcacgcctgtaatcccagcactttgggaggccgaggcaggcggatcacttgcggtcaggagttcaaaaccagcctggccaacatggcaaaaccctgtctctacttaaaatacaaaaattagctgggtatggtggcaggcacctgtaatcccagatactcaggaggctaaggcaggagaatctcttgaactcaggagacagaggttgcagtgagccaagatcatgcctgcactccagcctgggtgaaagattgagactctgtctcttctttctttttttttttatttaaaaaaaaggccaggcacggtggctcacggctgtaatcccagcactttgggaggccgaggcgggtggatcacaaagtcaagaaatcaagaccatcctggccaagatggtgaaaccctgtctctactaaatgtacaaaaattagctgggcgtggtggcaaacgcctgtagtcacagctactcaggaggctgaggcaagagaatcacttgaacctgggaggcagaggttgcagagagctgagatcgcgccactgtactgcactccagcctggtgacagagcgagactccgtctcaaaaaaaaataaaacaaatattctatacatggaattagagagcatccagactgttgcatgtatcaatactgcaggtttttttttttttactttttgcattttttgaaatggagtctcactctgttacccaggctggtcttgaactcctgacctcaagcaaccctcctgcttcaggctcccaaagtgctgggattacaggcatgagccacctcatctggccatagcatattattttttatttctggcagagtcagggcctccagaggactcaactggttcctgtagtggcactggttgcattgtccccatggcacaaagacatgctctgttgcaatagactaggcttctccttatatgcccttgagtgtatccactggtgcaaggctttttcaccaagcaaacagacattgagtgcctgctgtatcccaggcacatgctaggtgctgggggtgcagctgtgaacacacaccatggtccctgacctccatgaatattctagccgaattggtggggagtaaacaataaacagataatcacagagacagatacataatggcaaactgtgataagtgcatgaagcaagctgctggagtacatagcaggggcttccttgtgccaggcaggggcttgaaaacaaagagttaggaggcagcccagggaaggacagcagatgctgctttttggaaatgttcgtccccactgaaccaacttctgaaaaactatcctaagaaaatcgtcttagccaggtgtggtggctcatgcctgtaatcccagcactttgggtggccaaggcaggaggatcacctgggttcacgagttcgaaaccagcctggccaacatggcgaaaccctatctctactgaaaatacaaaaattagccaggtgtggtggtgggcacctgtaatcccagctactcaggagattgaggcaggagaatcacttgaaccgaggaggcagaggtttcagtgagctgagatcgtgccactgcactccagcctgggtgacagggcgagactccacctgaaaaagagaaaagaaaatcaagagttaagggcattcattatggccttatttacaatagcagaatttcagtgtccagtcctagctgaatgatgagttcaataatggttcatctatcaatggaatgttttcagctattaaaatgatggctttggctactgaataggtctgctaaaaaaaaaaaaaaaaaagacttctacctagctgtctagttggacactgtggcatgtgcctgtagtcccagctactctggagctggggtgggaggatcgcttgaggccaggagttcaaggctgcagtgagctatgattgtgtcactgcactccagcctgggtgacaaaacaagaccatcgctaaataaataaattaacttaaaagatggctatgtaaagttgtaagaatgatgtaacagcatggggtaatacatatcttataatttttaaaaaaattttatttgtggagacagggtctcactgtgtcacccaggctggagtgcagtggcacaatcgtggctcactgcagcctcagcctgcagggttcaagcgatcttcctgcctcagacccctcactagctgggactacaggcacacaccaccatgcctggttacttgtttttgtagagatggggtctcatgatgttgcccaggctggtcccaaactcctgggctcaagcgcttgcctcggcctcccaaaatgctgggattacaggcatgcatcactgttcctgtctgtatcatataattttaaataataaaagcagcctctacaactaggcagcatggtcttaagtctattttttaaacatagaaaaagagccaggaaggaaatgtaaacaatgttaataatgactttgatagggaggtgggtgggatatgaaagattttttttctcccttttgtccttggaaggaaatatcacttttcagcagtagttctctgttgggatggttctaaagtggggaagatgagactttttcctttcactttgtaccttttctggtgctctgatttagagctcctcagtcttgccactgttgatattttggggtgactaattctgttgtgggggctgtcctgtgcactgtagggtgtttagcagtatccctggcctctacccactggatgccagaggcaccccccaccccagctgtgacaatcagcagtgtctccagacaatatcccctagtggggatcggtgggggcaacattgtccctggctcggaaccactgatcgaatttattatgacaacatatccctttgccacaaaaacaaatgatgggctaaccgtgtgtgtgcaggtgaagccactgctgcaggtgacacggcaggaggaggagatgcaggccaaggaggatgaactgcagaagaccaaggagcggcagcagaaggcagagaatgagcttaaggagctggaacagaagcactcgcaggtacctgtatggatgcatggctggggttgctggggaacaggacttggccccgtggggctcacccgcctcctccccaccacctgcgtgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggtaaggtgtcacaggggcagcccgtggtgggtagcaaatcacttgaccctcaccacaggcctgtggaggtgcatccagggatatgtgtccctgctgggacagatgatgagacgggggcttggagagggttggtcatctgatcaaggccacacagctgggattgggactggaacacagtgagcccactctgttctattgccctgccttgcatgtgctaaccccttttctcctaacagcaagcctgaatggaggataattgtatttgttagctattgctacataacaaaacatgccaaactcagcagctaaaaataaaaagtattgcatagtcaggaatttgagagtggcttaggtgagtggttctggctgagggtccggcctgaggttgcagtcaaggtgttggctgaggctgcagtcatctgaaggctcatctggggctggaggacccacttctacttggcttattcacacagctgttggaggaggcctcagttccttatcatgaaggcctctcccctcagggctgcttgagtgtccttccaatatggcagcagagttcccccagaaggagtgatctgagagaggagaaaggaagccgcaatgccttttatagcctaatctctgaagttacattccatcacttcttcctgatttttgttgttgttgttagaagcaaatctaacccccactcaaggggaggagaattaggctccacctttttggagtcgcaaagaacttgtggatagattttaaaaccaccatggtacctactgtgctcattttatagatgaggaggttgaggttccatgaagcagagcagcttacccaggtctttattttttttttttttttgagacagagtctcactctcttgcctaggctggggtgcgatggtgcgatctcagctcactgcaacctctgcctctcgggttcaagcgattctcctgcctcagcctcccgagtagctgggattacaggagcccaccaccatgcctggctaattttttttgtatttttagtagagacggggtttcaccatgttggccaggctggtcttgaattcctgacctcaagtgatccacccacctcggcctccaaaagtgctgggattacaggtgtgagccaccacgctcaggcctttatttcttccttttaggaggctacagagttctgggcatcttcaggcctagcccctgtattcattagtccccagatcaccacgagagtaaatctgttataaccaaagctgttactcttttccctccacaacaaaggaccttgaagaacagctggaggaggaggaagctgccaggcagaagctgcaacttgagaaggtcacggctgaggccaagatcaagaaactggaggatgagatcctggtcatggatgatcagaacaataaactatcaaaagtgagtaggggccgggtgcagtggctcacgcctataatccgagcactttgggaggccaaggtatgtggatcacttgaggccaggagtttgagactagcctggccaacagggtaaaactccatctctactaaaaatacaaagattagccaggtgtggtggccagtgtctgtaatcccagccacttgggaggctgaggcaggagaatcacttgaacctgggaggtagaggttgcagtgagctgagatcgtgccactgcactgcagcctgggtgacagagtgactctgtttcaaaaaaaaaaaaaagtggaatcaagtttctgcattaaaaacaacaggcttaccaggatcagggagattttggggatttgggactttcagttctcaaagcagaaaagcccttagaaaaccaggacaagctggtcaccgtagtcagtagtcactaaccagccccacctgcttttagttctttgagctggatgtcagcttggcccctactgtgagccaggctctgtgttagatgcaggtatgcatggtgaaggaggacccttcccttgtggggtttatactgtagtgagatggcaaataatcgtcatttaccatggtgatcagggctctgaaggaaacgttcaccatattttaagagtgcggcaggccgggtgcggtggctcatgcctgcaatcccagcactttgggaggctgaggcaagtggattacctgaggtcaggagttggagaccagcctggccaacacggtaaaaccccatctctactaaaaatacaaaaaattagttgggtgtgttggcgggcgcctgtagtcccagctactcgggaggctgaggcaggagaatcacttgaacgtgggaggcagaggttgcagtgagctgagatagcaacactgcactccaccctgggcgacagagtgagactctgtctcaaaaaaaaaaaaagaatacagcagtgggggatagaggaagggtattcatagaagacttcctggaggaggtgacatttaagcagaaacttaaagatgaaggagcagttagaggggagtagaagagcatctcagctggttggcccactgtgcaaaggccctggggcagggaagagctggccagtggcaggaatggaaggagggtacctttagctgaccatacaatatgagggacaaactggcacgagatgagaaatggccagtttttggaaattgttatgggacttctctttaccatttaaaactctagttgtattttgttataatgtgggtttttctttcaactgtttacatggaaatcactaaaagtgaaacatagattctagagaaaagaaaaatcctaaagctatctctttctctttccccaaaaaggaacgaaaactccttgaggagaggattagtgacttaacgacaaatcttgcagaagaggaagaaaaggccaagaatcttaccaagctgaaaaacaagcatgaatctatgatttcagaactggaaggtaaaccagctaccaagagatttatttttattttattttattattttttttagagatgaggtcttgctctgttgcccaggctgcagtgcagtggtgcgatcatggctcactgcagcccgaaactcctaagctccagtgatcctcctgcctcagcctcctgagcagctgagactacaggcgtgcatcaccacacccagctaatttttttttattttttattttgtagagatggggtttcactatgatgctcagtctagtctcaaactcctgggcccaagcagtcctcccaccttggcctcccaaagtgctgggattataggcatgagccactattcctgggcttgaatgggtatttttaaaagcaggaaaatcagaaaggaaatttgaggatggcagatcatcccatgagtgacaactaactctatgccacctctcgaaatcacccttagtcatcacatgcactaataatatgataaaagggctgggtgcggtggctctcgcctgtaatcccagcactttgggaggccgaggtgggcggatcacgaggtcaagagttggagaccagcctggccaacatggtgaaaccctgtctcaaaatacaaaaattagccaggcgtggtggcgggcgcctgtaatcccagctactcgggaggctgaggcaggagaattgcttgaacccgggaggcggaggttgcagtgagctgagattgcgccactgcactccagcctgggcaacaagagcaaaactccatctcaactaataataatattatgacaatataaggtgctgttcatcgggagataatggtccagaccgtgactatgatggttactgattgggggatgtgttcatctcctccgggtaaaatgcctgggcaggaaggctcatttccgggcatctctctggggcctccccttcctgaagagcaccttggtttttgcagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggtagcggggctggcaaggggcatttgctgtgtgtccatgtatcccctgggcccctgctcattcgctcattcgcagtggctgtcttggtcaaggcggccccaggcccttggcatgaacttcgtttcccaggccaggcctcccacaagccttctcgaccctgttcactcccccagatcctcaccttcgactttcttctcttccctgcaaacacatcatgtctttgcagttgatctcacctactcccatggtgttgctgctgcctcttcgacatccaggcttttctcatctagacccccttctgaatttccgattgcccaatgagtcaatttccaccgtcatctcaaacacccctgtctaaggcgggaatgaccttcctttccccagcccctccctctaagggccctcttttttgtgaacaccaatctcctcctttgtttctgccgacccacagcaagcagcaaccttcagattctgccagtccttctaaatgtcccccacccatttcctctggtttttccctcttcctggctcttagctggatttacactaatgctaatactgcagcagccactatgaatgattatttacctgctcactcggtgctaagttcttttcaagcaatacctttgcagacacctggccaggtgtactgccggtgtctttgaggaggaagctgagcctcctaggggtaacgcaacaggagcaatgtcattgcttctaagaggcagagctgggatttaagcctcaaagctttctgattgatcccctggcctggctcttttgtcggccaatttgtgctatgttgacagtgctacggtgatgaagggaaagcatctctctggggcaggaacctgctcacaaaactttgctggctggatgcagtggctcacgcctgtaatctcagcactttgggaagccgaggtggggggattgcttgaggccagcagtttgagaccaacatgggcaacatagcaagaccctgtccctacaaaaagttaaaaaatgagccaggcatggtggtgtgtgcctgtagtcccagctactcaggaggctgagatgggaggatcacttgagcccaggaggttgaggctaaagtgagctatgatcatgccactgcactccagcctgggcaacagagcaagaccctgtctcaaaacaataataacaacaaaacaaaaacctaacttcactggcttactagggaaaatccagtttccttagcctcaccctcagagcccatccaccctctgcagtctcaccccaacccaactatttcactttctctcttgttgctgccctttcacaagtacagtaaaatcaaagtgcttgcctctcctgcagcattctgccatttaacagggcttcttgcagcccaccttgatctctggtcaccacctccaccagatgcagagccccagtctgaatatcccccgcaagcagtggctggccaaatgctgtgcatggggcgggtactcagtcactgagcaaatgcagaaagaacagacagttgccagggaagaagaactgtccaacattcagaaagcatctacacagtccctactgtgaccaggtaccttgccagtctggggtcaatgctttgcattcttgcacacacatgcacacacgtgcatacacacgtacacacacccatgcacatgtacaacctgttttgatgtcagaccttggcactcacatcctatgttaatctcatatagtctggcatgtcaagaagcagacctggggacatggatagaaggtgtttgatgtctctgcaacataactgtctggtcccagaaaagtttttggccacattgtaagagaggaaaccaagggacctgggggttcattctgctgggtctctccctggaaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcaggtgaggggcccatcaatcccaccatcctgctatcccactgcaccaatgggatgggggcagaagaggggacaaacccaaagcaaatcgtgcatcagcccctgtgcatttaccttcctggccgcggtttgctttaacttatagaagcatggttggctgtttcttttttttctttcttttttttttttttttgaggcagtctggctttgttgcctaggctggagtgcagttgtgccatcttggctcactgcaacctccacctctgagatttaagcgattctcatgcctcagcctcctgagtagctgggattacaggtatgtgccaccacacccggctaattttttgtttttagtagagatggagttttgccatgttgcccaggctggacttgaactcctggcctcaagtgatccacccacttccgcctcccaaactgctggtattacatgtgtgagccactgcacccgaccctcatcatcttatttctcatcagaagagtagtatataccagggatgtacaatcttttggcttcccttggccacattggaagaaaaagatttgtcttgggccacacataagatacactaacactaataatagctgatcaactaaaaaaattttacaaattggaaaaaacatctcatactgttttaagaaagtttatgactctgtgtcaggctgcattcaaaaccatcctcattggtaagcttggatatactcagagaacaatttgaaaactatagaaaagcagacataaaaaaaaatcacctttagggtcgggctcacgcctataatctcagcactttgggaggccaaagacaggtggatcacttgaggtcaggagttcaagaccagcctggccaacatggtgaaaccctgtctctactataaatccaaaaattacctgggcgtggtggcgcatgcctgtaaatcccagctactcaggaggctgaggcagtagagtcacttgaatctgggaggcagaggttgcagtgagctgagatcgcaccatcgcactccagcctgggtgacacagtgagtgagactccatctcaaaaaaaaacaaaaaacaaaaaaatcacccttagtcacaccagttaacattcttgagaaattccttcctgtctgtgtgtgtatcagtcagtccccaagctccaattcccaagtatgtgtgtgtatcacttttgtgttaaattttaaaaataaaattgatcagattggttttcaattgaagattcacttcaaatgaacaaacaataacaaactgcctgccagatcacgaatcctgactctagtgaaactaggtcattgattcattcagtaaacacataaatgtattttgatgcaatctgtggtgttggcatagcatgtatcatagcatatagctatgctagctgtgccaacaccatataccctggggtttacttcccccactttgggttttgtgcagtgtcacatgcacatagagcacagcgttctgctcccttgccgcttggcctttgatacagaagagcccagtgcatgggccaggtatggtggctcatgcctgtaatcccagcactttgggaggctgaagcagacagatcacctgaggtcaggagttcgagaccagcctggccaacatcatgaaaacctgtctctactaaaaagacaaaaattagccgggcgtggtggtgggcgtcggtaatcccagctacttgggagactgaggcaggagaatcccttgaacctgggaggcagaggttgcagtgagctgacatcattccactgtactccagtctggacgacggagcaagactcgataagaaaaacaaacaaacaaaacaaaaaaccaggctgagtgcggtggctcacacctgtaatcccagcactttgggaggctgaggcgggtggatcacctgaggtcaggagttcgaaaccagcctgaccaacatgttgaaaccccatctctactaaaaatataaaattagccgggcgtggtggtgggcacctgtaatcccagctacttaggaggccgaggcaggagaatcgcttgaacccgggaggtggaggttgcagggggccaagattgcgctgtcgcactccagcctgggcaacaggagtgaaactccatctcaaaaacaaacaaacaaaaccatggactcaaggtcaaggtttagcttctaattctggctccatcacacaatggctgtgacaccatgggtaaaactgcttaccctctcttagccttagtttcctcatttgtaaaatggaaataataacacacctgcctctttgggttgctctgaggattagatgatgtatataaaaaacttagctcagggcctggcatatagtaactgctcattaaataagagccaacattaatatttaagcaaaattttgcagttcacagacatcctttcaattctattactttgtgtatttgtttgccagtcattacagatgtcctaggcaggtgatatgctccacattttgcagctgaggaaattttaggtccagagatgttaggtgaatgacccaaggtcacacagctagagaggggtggtgatgaggactgcagctctgggtcctggaagagctctcattcttttgcacggcactgagatgaccctctgtctccacccaactgccattcactgtgttcctcccaccaagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggtaatgctttttggtgatgctttttggtgatgacacataagagtgacatcagcagcctcaaattactacaggtcagggtctgcataaagacaaaaaacaagttacataagattctaatgatgatgatagcagcttatatttatttacaaaatgcttcccatacaggctgggtgaggtggctcacgcctgtaatcccagtacttggggaggctgaggcgggaggatcgcttgagctcaggagttggagaccagcctgggcaacatagtgagaccttgtttctactaaaattttaaaaaagtaggccaggcgtggtggctcaagcctgtaatcccagcactttgggaggccaaactgggtggatcacctgaggtcaggagttcgagaccagcctggccaacatggcgaaaccctatctctactacaaatacaaaaaattagccgggcgcggtggtgcatgcctgtaatcccagctactcgggaggctgaggcaggagaatcacttgaacccaggaggcagaggttgcagtgagcagagatcatgccattgcactccagcctgagcaacagagcaggattccatctcaaaaaaataaaataaaataaaatattggccaggcctggtagtgcattcctgtggtcccagctatttgggaggctgaggtgggaggatcgtttgagcctgggaggttgaggctgcagtgagccctgtcatgccactgcactctagcctggacgacacagtgagaccttaatcaaacaataaaaataggctgggcacggtggctcaccatgtctgtaatcccagcaatttgggaggcaaggcgggcaaatcacttgagctcaggagttcgagaccagcctggccaacatggtgaaaccccatctctaccaaaaatataaagaattagctgggtgtggtggcatgtgcctgtaatcttagctactcgggaggctgaggcaggacaatcacttggacccaggaggaagaggttgcagtgagctcagatcgtgctactgcactccagtctgggcgacagagtgagccgccatctcaaaaaaagaaaaaaaaaaaagaatgaatagaaatgcttctcatacagtatgtcaattaatcttcacaaccaccctgtgagacgtgtactattaaactcattttacaagcaaagaaactgaggtcctaggtgcctagaggtgaagagacttacccaaggtcacactgctggtaagtgacagagccatgatttgcacccaaacagtctggtcctagaccccactttctggcctctacaggactgaaggcctataggatgggtggggcctatcaatatactgcccttcagggataagcaaaggtgtaacaacactttcggggagatttaaatgaaacttaaaactgggatcattctatccactttaatttctctgcagactggaggaaggccaggcatggcggctcatgcctcccgtaatcctaacactttgggaggccaaggagggaggattgcttgagcccaggactttcagatcgcctgggcaacatagcgatttttcttttgtaaaaaaaaaaaagactggaggaaacttgtcattatttgatttcaatggcagaacagctctctccggcataatttgagaatgactaggtcaaatcactctcccgttgttggaactctttgcggtgtatgggagtgggagctggtaaatagcagtaccgaatgctgaatcttgggtgctcttctctcctttggggtagtgcctgtgcttcattccccagggtaagttttttagcttgcgaccttcggccagattgttttcctgaaagcctgagttacattaccctcagcgttgcagctcctccacatccccttcagtggaagcttttggttctgctagattaagtgggtgcagcattgcctaaaaattttggggaatttgcatttggttctatcactagtgtattggtccgttgttgcactgctctacagaaatacccaagattggattatttgtttattttttgagcagtggagtcttactctgtcactcaggctggagttcagtggcgtgatcttggctcactgcaacctccacctcctgggttcaaatgattctcctgcctcagcctcccaagtagctgggactacaggcacacaccaccatgcccggctaatttttttttttttttttttttttagtagagatggggttttgccatgttggccaggctgatctcgaactcctgacctcaggtgatccacctgccttggcctcccaaagtgctgagatgacaggtgtgagccactgcaccaccctgagattgggtaatttctaaagaagagaggtttaattggctcacggttctgcaggctgtacagaaagcatagcagcttctgcttctggggaggcctcaggaaacttaccatcatggtggaaggcaacggggaggcaggcatgttttacatgaccagagcaggcagaagagagagaatggggagctgccagacacttttaaacaaccagatctcatgagggcagcaccaaagggatagtgctaaaccattagaaactgcccccaaaggccgggcgcggtggctcatgcttataatcccagcactttgggaggctgagataggcggatcaccaagtcaggagttcaagactagcctgaccaacatagtgaaaccccatctctactaaaaatacataaaattaggctgggtgcagtggctcacgcctgtaatcccagcactttgggagcccgaggcaggcagatcacctgaggtcaggagtttgagaccagtctggccaacatggcaaaaccccgtctctactaaaaatacaaaaattagctggacgtggtggcggtcgcctgtaatcccagctacttgggaggctgagacatgaaaatcacttgaacccaggaggtaaaggttgcagtgagccaagattgtgccactgcaccccagcctgggcaacagagtgagactcagtttcaaaaaaaaaaaaaaaaaattatggttggaagagtgaggccccagacagaatcactgaccctccccatgcttggggttcattagacgtgaacaggagctagaagccaagcccattcccagccaggcctctttgggaagacgcagttattaagaccaccagcagacggcatgtccattactgacccgcacaaagcaggtagaggtgcaaacctctgcccatctcaggtgcagggaaacagaggcctttgcctctaacaacttgaattctgatgtagagacctggttccatctgcttgtgggggaaacgtttaacatcagctcctacctgggctccccaggccctcgtgcggtttggccccagttctggggtcttaggctgggctaaggtttctgggagcccatgtcccctagggtccccgcttcactgctttgttaccaccaagagactccctgtccccatctgaggtctggcagctcttagtcatgtcttggagggaggacgggcatccagggctgaccggtcaacgtccagcacctcccagggactatgggaagactgagtggtgggtctcgtcctctcgggatacttgcgcttctctttccccttctctacaacctggaaagaagcccctcaccgcgtcctacttttgcccaacacgcttttttttttgagacaaagtctcactctgtcgcccaggctggagtgcactggcgggatctcggctcactgcaacccccgcctcctgggttcaggcaattctcctgcttcagcctcctcagcagctgggattacaggtgactgccaccatgcccggctaatttttatatttttagtagagacggggtttcaccatgttggccaggctggtctcaaactcctgacctcaagtgacctgcctgcataggcctcccaaagtgctgggattctaggcctgagccaccgcgcctggccccaacacactttttttttcctgtagggcaactcacatgcctacaggagctggttccataaaataagtttcccttaactaggacagaagtagcagtgtcaatcacacgacacctgtgaaggacgggggcggtgaaaggtgactgccccacctgcagagccagccgctacttagatgtggcagattgttgccttgaaggaaagcaagaccctctgtttccagatctttcgttgttgttggttttttgtttttgtttttaagtttaggattactgaggcatatgtagtaaaatttatccattttactgctccattaattttaacaaatgtgtattgtgtaactaccaccaccacagtcaccacatagaatgttagttattgattgattgattgagatggagtctcactctgttacccaggctggaatgcagtggcatgatcttggttcactgcaacctccacctcccaggttcaagcaatacttgtgccttagccaccccagtagctgggactacaggcgtgcgccaccatgcccggctaatttttccatttttagtagagatgcagtttcgccatgttggccaggctggtctcgaactcctcacctcaagtgatccacctgccttggcctcccaaagctacttatttctgaaacagggtctcactttgttgcccaggctggagtgcagtggtgtgatcatagctcactgcagcctccaattcctgggctcaagcaagcctgccatccgcctcctgagtagctgggattgctggtgtgtgccccccacacccagctaatgttttattttagtagagatgggggtctcactacattgcccaggctggtcttgtactcctggccttaagcgatccttctgcctgcttcccaaagtgctggggatgacaagtatgagctgccatggcatgccttcaaacattaaagttttttgaaaaagaagctgggaatccagatttttatgtgacatttattaaaatgtcggcaactcatttttttaaaagtagtgaaagggtcaaaggggacatgtcagcaggttggataccgcttgtgggattccagattgcaacccatgagctttaggaaaatagaatccaaaatatcagctgggtgcggcagctcacgcctgtaatcccagcacttagggaggccaagatgggtggatcacttgaggtcaggagttcgagagcagcctggctaacatggtgaaacctcgtctctactaaaaatacaaaaattagtcgggcatggtggcgggcgcctgtaatcccagctacttgggcagctgaggcaggagaatagtttgaacctgggaggcggaggttgcagtgagccaagattgtgccacggcactccagcctgggtaacagagttaagactccatctcaaaaaaaaaataacaacaaaaaaaccccaaatctcttactggtgattgtgtgccccctgttgtgtgccttcctggacctctctgagggaggaaagggcagggcctgaaacgttctcccggccacagcctccctgttatccctcccctctgcttccttcgccaggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcaggtgaggaggtggcgcggtggtgtggtgggcagtgctgggtggtgcccagttctgtggggaggagcctcttcccggctcgctgaggtctctcttgctgcaaggcaagtcctttcctctagttgcgttcctggaggagaggcgatgatctccctgttcaattaaatattaaaaaaaccttctggccaggcacggtggctcatgcctgtaatcccagcactttgggagacagaggtgggtggatcacctgaggtcaggggtttgagaccagtctggccaacatggtgaaaagtctctactaaaaatacaaaaattagccaggcgtggtcgtgggcacctgtagtcccatctactcgggaggctgaggcaggagaatagcttgaacccaggaggcagaggttgcagtgtgcagagaccgcaccattgtactccagcctgggctaaaagggcaaaactctgtctcaggaaaaaaaaaaaaaaagaaaaaaaacccttccttttccaatttgataagtatttattgagcacctgctgtatgccaggcactgtgcttaatcctgagatccaacagcaaggaagaagagacactgtcgctgccccagtaggactccagccgagtaaggggaagggaagggaagggaaagacatgaataatcacacaaatgaatgtcaaatgatgcagcaaagggaaggcacatgatgcccaagtgtaaataaccagggggcctaacctgggggaggaggagccacgaaaggcttccctaaggagcatggataagtctaccaggcagagggaacagcgtgtgcaaaggccctgtggtaagtagaaaaattaggagagagacatacagccagtagagctggagtgcccagctggggttgggggtagggggagatagtacagagtggggttggagggggagcttgtacccagatgatgtagggcttttgagaacctattacatgtatgttgatccttactctgggcaatgtgaagctgttgaggggttttaagctgctgaatgacatggtctttttgtctttggtcttctttcacttggcatagccatttaccctgccttgccactcatggggacgtggccaaagttttcacaaatgtttaacatgtccacagccagggaccaaggggcgagggaagaattaagtgagatgtttttttctcacatgcagttgagagcagggcttttgccgccctcatataagcagtgtcaagatcattcatatcctccttgtcaatggaagagatggaggggtaggctaacagcctcaaagggacttatgcagagacactagggagtaaaagccagagaatacagagaggacgtttttacctttagggcctgcgtctctggctttggccatcagggtcaaagagtaggagtgaggaaggaagggatgggacagcatccctgggacgttcaagtaccatcctggtctcccttctccagccttagagagtggaccagccagagcacctcgtctggactctcagacctgctgctttgtctctaccaaccttggcagggatctaggatccatttagtgggatcaggtcccagtcaataccattggggctcaaataagttcttagaaccacagagtctagggccagggtcccaactcataggtgacggagttcccttcaagccacagattctgttttttttgtgtgtgtgtgtgtttttttttttttttatcagagtcccatacctcaccggtattttctcaatcagtgaacacctcaagtactagcccatgtgttttgagtaaaaagggctcctttcaacgaggatccccttctagaggctttgactaaccagtctcttggcacccttagaatgaagttgagagcgtcacagggatgcttaacgaggccgaggggaaggccattaagctggccaaggacgtggcgtccctcagttcccagctccaggacacccaggtgagtgtcctgccacatcatccaggggacctggggggtggccttcctcggggcaggtccctgggacctctttgcatcccttttgcaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccaggtgcctgccccgtgtccttgcttccttcatgggtcctctcaacttctctgcgctgagatcccccgcaggcagatcgcggtggagtgttggtgcgatggtgcttgaccccccagcttcccctgctattgggtttctccaacgaggagacatggtcttcgcttctcagagtctgtggggccagggacaggggccattcatggtccccctctcaccctaccctggacgctgtccttgtagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcaggtagagggcgtggggtgtcccccactctggccatggacgctgggttggggaatcagctctgcagagtatgacgcgtggctctggcctgtgcctgcatcccctctccactctgtggggagccatgggaggctgtcttatcttgtcttgggcgaccatggagcattaacgctaccaggtcacagtaaggatggcaaagaagccttgatgactgtgacttttctgggtaccagcaccatgagggtcacctgcacacatggtgatgccttagtttctagcctgaagaaggaatgaggtgcttatttattcactaaatgtatttactgaatacctattgagtagtattccaagtaattcagtttctatacttttaataccactcttccctaagatttcattctgtaaaattccaagtacacagcaaagttgacagaattgtacggtgaacacctttaaggccaccacctggattcagtcattgacactgtattatatgaactttatcagatacttattttgagacaggatctagctctgtcacccaggctggagtgcagtggtgtgatctcagctccccgcaacctccaccactgggttcaagcgattctcctgcttcagcctttcatgtagccgggattataggagcacaccactatgtctggctaatttttgtatttttagtagagatggggttttgccatgttgtccaggctggtctccaactcctggcctcacatgatctgcctgccttggcctcccaaagtgctgggattataggtatgagccactatgcccggcccacatatttatttataaagactaattctatctatcatgccttatctcttgggtacatttcagagcaaattacagatgtcagtacatttccccttccacacctcaacattgcatattaattagagtttatttttaaacacaattttgcttcttttggggtaaaacttacatgtgatgagattcacaaatcttaattgtacgataaatggagacccctgtatgacccaaacccctaaataccaacttttaagatacattattatttagtaaatatgatttagtttacaagtgactcagggttattctaaaaatcagtttgagaggccaggcacggtggctcacgcctgtaatcctagcactttgggaggctgaggcaggtggatcacttgaggtcaggggtttgagaccagcctggccaacatcgtgcaactttgtctctactaaaaataccaaaattagccgggcgtggtggcgcacgcctgtaatccctgctactctggaagctgaggcaggagaatcgcttgaacccagggtggggtggaggttgcagtgagccaagattgcgccactacaccccagcctgagtgatggagtgaaaaccctgtctcaaaaataaataaaatgaggattgtacagtgaggctaaatgccagatgcctgcaggttccctacccctccctgactgacctcctagtgtcaggattctagataacatcccagtttctcctcttcccatcagctacctctcctctgggctgtcagctcatcttcaatgcttcgttatctggttgaaggcctgaggttgcttttattttcctgtcacatagagtgtagtgcagtggcacacatagtgtgggatttttgtgttgactgtgccatttagaggtccctgtctttgctgaatactggaagtttggcttttggatgttacaatttataatctgctctgttctctctgaagatgagattaacgtgagcatggaatgttctctgagttgcttctccaagcagagagatatgtgtgcagggccacccatgcttaccatttccctactgaggctcttaggatacttttgtaagatattaatagctacttgtggccatgaaacaaactaataactagcttctggcagctttaaatctcactttgacctcagtgtgctctaagcaacgtgggcaggtctagtggtttcgaagcacaaggatttggccaggtgtggtggctcacacctgtaatctccgtgctttgggaggccgaggcaggaggctcacttgagggtcaggagttcgagaccagcctggtcaacatggcaaaaccacatctctacttaaaatacaaaaattagccaggtgtggtggtgggcacctgtaatcccaactactctggaggctgaggcaggagaatcgcttgaacccacgaggcggaggttgcagtgaaccaagactgcaccattgcactccagcctgggtgacaaagtgagactccatctaaaacaaacaaacacacaaaccaacaaaaaaaaacaagtcagctgatttctggctctgcataaggttgatgtagaagtcagaacgccagatgattatataaattactcccatagctaacctacactgcttacacctgcacctcaatacattcagcaggacacagggcttcccccggtatttacaattcagtgacgctgaccccggatatgcctagaagtcacctctgggtcttgtgttgtagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtaagtggctctgggtggtttttctcgtccatgtttcgcctgcccaccctctgtgctattcaccagtccatgcgaggctagctcctggcctttttcatagcgaactatcatcggaaatggaaggaggtttttggactggtgcaggggctgggaggggctgagaatggcagtcgaggatgggtctgagttggggggtccgaggataaggctggggtctgaactctcaggggtcatcttgagtcccggccatgcatcctgtgggaggccaaagccacctccctgatctcctgaggtgccgctcacggtgggtttctcaatcgtcttcatgaagttgagcctcatagaatggggctgcccgctctgccggcaggtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacaggtgcgtgctgccggggaggccagcagagggaggtcgggtggcctttttcattcctatcaccactctcatggttggtgtggaaacttcgttttctttatttttttttgaaacagagtctcgctctgtcgcccaggctggagtgcagtggcgtaatctcagctcactgcaacctccacctcctgcctcagcctcccgagtagcttggattacaggcgcatgccaccatacctagctaatttttttttttttttcagtggagacaaggtttcaccatgttggccaggctggtcttgaactcctggcctcaagtgatccattctcctgttggcctcccaaagtgctgggattacagacatgagccacccacgcccggcgtgattccgttttctcatctgcaactggggatgagatgcccacctcacaagggggctgtgctggggaaggggtgcagtgatgtgctgcctaggtgagccaaaggacctcccaggggcaagtggggcagcacacatctctattcctcgcccagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggtgggtgacactaggagcttggggcatgggtggagggagggcacagttcccctcaggccaccgaagtcagcagagcgggctccaggaagcaagcctgcacctgccattggtgtgggttcagctggggtttttctggaaccattcaggatttggtggctgtctcctgccctgggtagggcagcattattaggtatttggccactgccctcagatcacatcaggggctcagcttctcaggcaggtctgtggagcccacccagaatggtgctcccagcgcaccaccagccacctggaactgagagccatgctcgtgcaatgggaacttctttgtggtcaactgcagaaaatccaaggggtgggtgtgcaaagctgaactgggcagcagaacttgggggagtaaggacatctgagcttgtcctccctgttgactcatgcaggctcagatgaaggactttcaaagagagctggaagatgcccgtgcctccagagatgagatctttgccacagccaaagagaatgagaagaaagccaagagcttggaagcagacctcatgcagctacaagaggtaaagcctcgccttgctaggagagcctcagatgcgggtgtcacggtagcaccccttggcagctccagtctgtgcattcccagatttcatttcgtcctcctctggggtccacctgtctagaaagacacacgcttccctcctctatgtattcacggggcctcccctgagctcagaggaagaacatgtactttcaagggtggctgagttgtcagggtggactcttggtggggcttggcctttccctggcagacaacagccttcctccctcccacctaggacctcgccgccgctgagagggctcgcaaacaagcggacctcgagaaggaggaactggcagaggagctggccagtagcctgtcgggaaggtaggaaactgaatggaggaagagggctctgaagcagaggatggggggacaggcagcatcctcgacccccattttattttttaaattttttcgagacagagtttcattctgtcacccaggctggagggcagtggcacaatcttggctcactgcaacctccacctcccaggttcaagcaattctcctgcctcagccttctgagtagctgagactacaggtgtgtaccaccatgcctggctaatttttatatttttagtagaggtggggtttcaccatgttggccaggctagtcttgaactcctgaccttaggtgatcctcctaccttggcctcccaaagtgctgtgattacaggtgtgagccaccgtgcctggccctggacccccatttcaatgctgctgctgacgaagcgtcctctgagattggggacagacccatggtggttaggttttccgtcagcgctttcatgcctgtttgggggtgtggctgctttcattcattcccaataagtagctgtgtggggagaaggggaggccaggaagagtcagggaggagtgtgctggtccccatcccaatcccagctttgctgacacggacccggcctgagtcccggctgtccacttcctggctgtgtaactacagatgagtcttctaatcttctccaagcctcagtttcacccattagatgatgagggcaatacccctgaggcatgactccaaggagggggcatcttttaaggcgggggagggtagaggcccccaccatggccgcccttcccccaggaacgcactccaggacgagaagcgccgcctggaggcccggatcgcccagctggaggaggagctggaggaggagcagggcaacatggaggccatgagcgaccgggtccgcaaagccacacagcaggtgagggccgcctggacaccacagtcacgctgcctactgtctctcctgcagcaggatcctgcaccagtcaacacacgcgtggcggcttcctgtgtgcaggccctggattgagggacaagagggtggtggggcctgagagtagagatccagggcccttacaccagtgcccaggctgctgtcttcagaatactcctctccacgctgcagtgtctcattttccagccacggcgtggctggctccccgtacctcacggccatccctggagtccgggccttgggatgctctttcattgcgttttcccctagctgaagctctgaccttatccagtgagcccttggtgatgtcactgagcactagttccatggtgggcactagggaccatccagtaacctgcagccccttgtggtgtagggtgaacaggcatcattctccaggcgactccaggacagagaaagcaagggacaagtcactcgctcagcctgggtggcactgacacttgtggaagcacctcttttttttggagacagggtctctctgtggcccaggctggagtgcagtggcgcaatcttggctcactgcaacctctgcctcccaagttcaagggattctcctgcttcaacctcccaagtagctgggactacaggcacgtgccaccactgcccggctaatttttgtatttttaatagagacggggtttcaccatgttggccaggcaggtctcgaactcctgagctcaagtgatttacctgcctctgcttccaaaagtgctgggattacaggcgtgcgccaccacgcccggcctggaagaagctcttgagtggagttttacaggatgaaggagaggacagggtgcccgggatcaagggactcgtgcagaggccaaacaaggcaggaagaggcatggtctcagtgcgctctcttgggcttccctgagtccgcctcatggccttcactctcctccccaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccaggtatgcgggtgtggagttccgaacccagtttgcaggggggtgatggacagcaggagtcatagtgaagtcagggaacctcttccagcatcagttctggcttgtaagaagcaagctctgtgatgcctacagtgcaggtatgttgtgagaactgaacgtaaacacagcaaagtgccctgctggttcctggcctagggcaagcacctaaagtgtgagctgctcttagcatctccatggtcctcctgacattaacctgccttcccagcagtacatatgacttttcccagcctctgcagggatagcatgctgacagatcaaaaatccaaccaggctggacgtggtggctcacgcctgtaatcccagcaatttgggaggctgaggcaggtggatcacttgaggtcaggagtttgagaccggcctggccaacatggtgaaaccctgtctgtaccaaaaattagccgagtgtggtggcacatgcctattatctcagctactcaggagactgaggcaggagaatcactccaacgtgacacgtggaggttgcagtgagccgagattgtgccactgcactgcagcctgggtgacacagtgggacccttccacacacatacacacacacaaaaaaaaccccaaaaaacaaaagtccaaccggcagcccatttggtacacacactggaagccttcttaattatgggtcgaatgaggcatatgatcacagcacatttcttaccattggattctaaggattctcacccattctcttctagtagctttttcagtaattcgcacgccctgcaatgcacccatttaaagtgtataattcaagggctattcatatattcacaaacatgtaaaaacgatcaccacagtcattttgagaacattttcatcggctcaaacagaaaccccaggccatatgtggtatttcatgcccataatcccggcactttgggaggctgaggtaggtgggagcagcacttgagtccaggagttcgagaccagtctgggcagcatagcaagacttttttatttttatttttttgagacatagtctcactctgtttcccaggctggtgtgcagtggtgcgatctcagctcactgcaacctccgcctcaccctcccaagtagctgggactacaggtgcacaccactgtacccagcttgtaattgtattttttagtagggatggggtttcaccatgttggccaggctggtctcgaactcctgaccacaggtgatctgcccacctcggcctcccagagtactgggattacaggcatgagccaccacgcctggccagagactccgtttctatgaaaaacttttaaaagtctgagcatgctggtgtacgcctgtagtcccagctacttgggaggctgaggtgggaggattgcttgagccaggagttcaaggctgcagtgaactatgaactagggtgaagagcaggcattggagcaccactgcactccaacctgggtcacacagcaagaccttgcctcctccccgcaaaaaaaatagaaaccccatgccctgtaaccactcccttcagtccctggcaaccataatctactttctgtctctatgaatttatctattctggacacttgatatcaacggaatcacacactatgttgtctgctatgtgtcttctttcacttggcaagaattccaggctcatccatgctgtggcatgcattgatactttattccttttcatggctgaatactattccaccatctgactgattcttgagaggagtccagatacggggctcaggaaagcactcaagatgccacctccaggtgacacaccagctacaaggggtgccaccctccgctgaaaccacctgttttccttgctgtttgcagagagaaacaggcggccaccaagtcgctgaagcagaaagacaagaagctgaaggaaatcttgctgcaggtggaggacgagcgcaagatggccgagcagtacaaggagcaggtagcccctgccacccagcctccctcgagcccccagcccccagccggcctcccctaaccacccctccaactctccgcgacaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcaggtgaggagcccgtggcccgggaggaccccgtctctcaggccagagaaaagcactgggggctcgggctcctttcggcctgcaaatgccccttgtgcccacagccgccactcccttctgtggtttattcctgcttctccttaatcactaagcttagtgtgggccaggcactgagatcagacccgggccctgccttgcctggtagcagctaaccttctagatcctttaacgatcgaccgtctcccatccggtcctccggctgaggaggaggaagaggctatccccactgtctcctccagcccctccttcattgcatcactgagtcttcacgacatccattgaagctgcaacaccaccccccgccacttcacctccttcctgacatgctctgctcctcctttctccccctcagcactgctgccatctgggctgcattattctcgggtatgggggctgtccgacattccccatcagaaggaaaaagatccctgaaaagtagcaggtgcttacatttctggcctctacccaccggctgcagtagtcccccaccaccctgcaatgtgacaaccaaaaatgtctctagatgttgccagaagtcctctagagatgggagggtacgactgccaccccgctgagaattcctgctgtcactggagtgggggctgttttctctcccatgcctctggtaccttgggggtcccccctgctcccaagggctgcttccaccaccctgtccatccatcccgattggctcccaggaggttttagctccgggcttcctgtctcccacaccactcctcacagttctccatgatttcaacatccaggtgggcgacgcagcctctcggttccttgaccctctgggtgatcctgctgcttctaccgggccaaccagtactcctaggagccctcacaatttgaccctcaggcatcccattgtctgcctggtgccacctttctttggctctgtccccaacggggtcttcactccattaatgccatcagcctctgacccagctccaaaccagctgtctagtaacccccgtcgcgcatcctcaacatccggttccccctcttgcattgctgcaatcatttggtgaaagcacaacccaaatgaaactcaagcttggctgggcacgggactcacacctataatcccagcactttgggaggccaaggcaggtgaatcgctttgagctcaggagttcaagagcagcaagaccccatctctacaacaaacaaacaaaaatcagccaggtgggatggcgcaaacctaaaatcccagctactcaggaggctgaggtgggacgatcagtggagccccagaggtcaaggctgcagtgagccatgatctagccaatgcacttaccctggatggacagagtgagaccctgtctcaaaaaacccaaaacccactctccaccttttcccacagagcaggccttgctcaggggtcctcccacacccctccctcatcttctcactctctgctgcttttcactttttctttgaacttatgatcgctcctccccattctctctcagctggggaccttacttcctacttaactcaaaagcagaaatgatcatgaaacgtgcacaagctcccactgcctcatcatcctacctccgtgcacctctgtacacttctattttttttccatttctatgctgaaccctctggcaccaaccgaggccaacacctccattggacccgaccctcttgttcactcaagcacatagctccaaaaatccttattttgcaaggttttctctttcatttgctccatcagcaaatggaataacctcttagccccatgtctaccttgctacccttactacaaaactggatgtgaatgccgaaaccctgtctctaccaaaaaatataaaaattagccaggtgtggtggtgcatgcctatagtcccagctactcaggaggctgaggcacaagaatggcttaaaaccgggagagagaggttgcagtccagcctgggtgacagagtgagactcggtctcaaaaaaaaaaaaaaaaaaaaaactgtatgtgaagagttgctggttcccctcgcccccacccatcactctcccagaagcctcccatgggtgacactaatggccagaggtcccctgacagggcagcagcacgtgacgcagtccatcatgcctctggcctaattcacttgcttccctggacttccccgacaccatccacacctgcttgtcccccgacctgtggggttgtccctcttcctctcctctgctgatccctcacctcgaaacctgcttgccactagaccgccccagggtatcaacttagttctcttttgagcagagtcttgctctgttgcccaggctggagtgcagtagcactatctcagctcactgcaacctctgcctcccagttcaagctatttttggcctatttttatatttttagtagagacggggttgcaccatgttgcccaggctggtcttgaactcctgatcttgtgatccacccgcctcagcctccccacgtgctgggattacaggcatggaccactgcacggccttagttgttttcatctctccccagcgctaggtgagaggtctcaactaatcttggcgctttagaattccatgtatatctaatgactcctcagttcatctctgagaagccctagcttcttcctagaacctcagaccaccctcccgttcccacatggatgtctaataggcagctcacaccaaacatgctgcaccccaagtcctgactgaaactcttcacccccaaactggctcctctctccagctcagcagctaaaatgatgaagttgccaacaattcacatcacaaacctcgtggtccttcttaacgttttggtctcctttataccccacatcccatctatgggagaatctggtcaactttccctaaagaatcctgcccaggctgggtgcagtggctcaccccttaatcccagcactttgggaggccaacgcaggctgatcacctgaggtcaggagttcaaggccagcctgaccaacatggtgaaaccccgtctctactaaaaacacaaaaattagccgggtatggtggggcgtgcctgtaatcccagctactagggaggctgaggcaggagaatcgcttgaacctgggagacacaggttacagtgagctgagatcgcaccactgcacttcagcctgggtgacagaccaaaactcggtctcaaaaaaaaaatctccagtgtctaggacagcaccaggcagagtgaacctttatccctcgggtcctagatattttccccgcttcattctcataccaccacagccatgtgctgagcctcttactacctttaataccaatgacttgatcttttaacagttttaatcatacatgaatataacggcaaataaacatacctcctctatatttttaaaccagcatcacctctatcaactggttacgatgaaagtaatatgataaaaatagtatcaagttcaatatctagctattgtggccacaacttgatcaccaagacctgaagcctacttctccactaaaaagggagtgacaacagccattagcaccaaatagactctctctgacatcataattagacttgtttaaaaagagttggaaaggaaatgactttctcagggcccagttcagttagcggatggcatgcccggaagccatctgaaatcacctctagagtttggggaccactgcgtgagacagggaaaagtccaaacccctctgagaaggggaagagagcagctggcgcagggcaccaagccttcagggaaaagccccactcgctgcatggtgagcgcttgttggtcccccatggataggagagaaaccaggcctaggctcccaaagtacagcaggggcctggaagcatctcccagggttgaggggtcagtggaggagagctgttctcactgtgaagactcctggggcaaagcgcggtggctcacgcctgtaatcccagcactttgggaggctgaggtgggctgatcacctgaggtcaggagttcgagaccagcctggccaacatggtgaaacttcatctctactaaaaacacaaaaatcagctaggcgtggtggcagatgcctgtaatcccagctactcgtgaggctgagacaggacactcctttgcaacccaggaggaggagcctgcagtgagccaagatcaagcctctatactccagccttcagagcaagactctgtctccaaaaaaaaaacaaaaaacaaaaaccctcagatgtgctctgctggcaaccagtccccctgcctctcctgagtggctgggctgagcgatggggatacagccactctgactccctaccccactgctgtctctgcttccctttctcaggcccagtgatttcttttctttttattatttatttttagacggagtctagctctgttgccaggctggagtgcagtggcgcgatctcggctcactgcaacctttgcctcccaggttcaagcgattctcctgcctcagcctcccaagtagctgagattacaggtgcgtgccaccacacctggctaatttttgtatttttagtagtggcaaggtttcaccatactggctgggatggtctcgatctcctgacctcgtgatccacctgcctcggtctcccaaagtgctggggttacaggcgtgagccaccatgcccggccggcccagtgattctttagcacacactggacacctcctgtgggttctgccccagacacttgagccttcttgggcagccaagggcaaagtggaacaaaaagaccatttttgccagttccgacacgaatacacacataatgcaggtggaaggtctgtcctgccttctgcatcttttgggtgcacaaaaacataaaatcaggcactagagccctgagggaggttggtaagcatgcctggctcctcagccaagaaggaactgtagtgcgagtttcaccaagttctatcagccagacgcatctcgacacaagccctctctaaagccagacccacttacctaccactggctacactgccagttacctccggcaagagctgtacaaggcctccacctctcctctcttgctagaggcccgaaagctaatgaagagcaagtaatcataaaccaagggacaggcggctgcaggttccttgcctgggacttcttggcttctgttccaacactgatttctcaaactagcttgctcaaatgcttttacttccctgaaccagtatgcaatcatgggatttataggaggttcttaaaagtagctctaaaggacagacattttcctttccatttaaaaaactgagccgggtgcagtggctcacacctgtaatcccagctctttgggaggccgaggtgggtggatcacttgaggtcaggagttcgagaccagcatggccaacatggtgaaactccgtctctactaaaaatatgaaaattagccagccacggtggtgcatgcctgtaatcccagctactcgggaggctgaggcaggagaatcgcttgaacccgggaggtggaggttgcagtgagcagagatagatcatgccagtgcactccatcctgggtgacagagtatcaaaaaactgcttatcctttcatctaccagcctcaccaaatgctcttggcgtcaggtgattcactgcaacgttgacttaagggtgcttttaatgccaggtgcggtggttcatgcctgtaatcccaaatcccagcaccttgggaggccaaggcaggaagatcattgacatcaggagttggagacaagcctgaccaacatagtgcaacaccatctgtactaaaaatacaaaaattagccaagcacgtggggcctgcctgtaatcccagctactcgggaggctgagacaaggggatcacttgaatccaggacgtagaggttgcagtgagccaagatcgcacccctgcactccagcctgggtgacagagactatctcaaaataaaaaagagtgcctttaattattaaatcgaagcaaatgtctttaacaattaagaatatacttaaccgggctccttcttgtttgctgatggtaacctccggggattctctctctgtttcagagggccccccccacaggaaacttcgcagtgatgcaccaggtatcatgccttcagcttcgcagctgtgtgttgtctcagtatccatttcttttctgcccaatgcgcccctctgcccaccccaatttttaaacccttgcacatttccacgagattcttgcaaaatctggaggcttggatatctttgtgcaaagctttcattgaaaccaagatcaggatgacaaatagacctcatctcttgacccactgtccttcctgcctctgggcagcacatgtgacatgacacccaacagtgtgcgcccttatcactgcatcttgacgagatggcagaggctgtgtgtgtagcttggatttttcttcctttcataccaaaagccactcttacgtggttagggcactcagcagtgctgtcctcccttgtccagtgaagacactgcactgaatgaatatgacagttccactatctgggcacattcctggagaacgtacttggcttctagttggctggtctgggtcacaagtcagagatcacaaagttcacggtaactgcggcgcggcaaccagtcctcccatgattcagctttcacaggcttgtctgcgaaggaaatgagctcactgcgatgtctgacaaatgccgggggctgcacgtggcttgagtgatgtctagctacaaactgcattttcagcacacggggtggaagctgaccaccgcaaagccaagcacagtcctggcagagccttttctggaggcttcacgggcatgtacatgttcagggactggggagtggatacccaagactcaaggatgcacacagggcccttcccaagaaagcatgaagaggtctctgctgctctgggattttgcttttttttttttttttttttgagacggagtctcgctctggagtgcaatggcgcaatcttggctcaccgcaacctttgcctcctgggttcaagcgattctcctacctcagccttctgagtagctgggattacaggctcccgccacctcgcccagctaatttttgtatttttattagagacaggatatcaccatgttggccaggctggtctcaaactcctgacttcaggtgatccgcgcgccttggcctccccaaatgctgggattacaagcatgaccaacttttcacaggtgaagttaggccatgtggatctgacttcacctcatggagaggccaaaccaaccctcatttgtgtccatcttcatttttggagaatctcagctttgctgtcactaccaaaatacttaaagcgcagggtgaggtcttgttaagagccagttttgtgggggagcagatgagtttctaggacacttcaagcagctctcctaccagctgattgggatcataggataagccaaattccagggtgggctgaagtgcagaacccactggtcagtgggaaactgagtccttgcaaactagcaggtgcttacactcaagatgattcccgaggccttggataagctgagtccacgaatagaatccaaatgctaggccaggcacagtgggtcatgcctataatcccagcactttgggaggccgaggcgggcagataacttgaggtcaggaccagcctggccaacatggtaaaaccccgtctctcctaaaaatacaaaaattagccaggagtggtggcatgtctgtagtcccagttacttggaaggctgaggcaggagaatcgcttgaacctgggaggcagaggctgcagtgagccaagatcacgccactgcactccagcctgggcaacacagcgagactctatttcaaaaaaaaattccagattctccaggatcagaccctttaagaaaacctttaggggggtcccttagttcctgtaacaggtatagttggtgtcaaccttggtctaggatttgaaaccagttccaagaaaagcacttcagccaaaacagagtatcttgcaggctgacagccaagcaaggagcttcaacggcccagggcacaatgtatttcttaggtcaagggagcaaatttatccattaagcttttccagttagcaaatagactcttccaagagccaaaaagagagtgcctagagcactgatgtggaggttagggactacttcccagctcatcagatttttttttgtttttttttttggagacagtcttgctgtttcccaggctggagtgcagtggcacaacgttggctcactgcagccttcacctcctgggttcaagcaattctcctgcctcagcctcctgagtgactgggattccaggcgcctgccaccacgcacggctaatttagtatatttagtagagacggggtttcaccatattggccaggatggcctcgaacaactgacctcacgagtgatctgcccacctcggcctccccaagtgctgggattacaggcatgagtcgcagcaactggccaacccatcagggtttgaacctggagttaaaactgtgacgaagagagctgtgtggggagcgtacagggaacagtcaaactgctgctcctctgcgctgaatttgagcatccttctgagtcaagcgcttggaaaacagtgctaaaaaagaaaaagacttaagggtcacatctagagagagaaggatggagagttctctagtagggctgcaagtccagaagcttctctgtgaagctgggctaggagtgtttactttgaagtggctgcagctttaagtatttattcctgatcgctgcactgcgggaagtcccatcctttatagccaggtgggctttcccagccggggtctctcccatcctctgtcaacaaaagggtcatttgcgaattcctcttctcagtgatcatgaatctctgggccttgatttttttttttttttttttttgagacggagtctcaccctgtcgcctaggctggagtgcagtggccacatctcggctcactgcaagctccgcctcctgggttcatgtcattctcctgcctcagcctccctcccgagtagctgggactacaggcacccgccagcacgcccggctaattttttgtatttttagtagagacacggtttcaccatgttagccaggatggtctcgatctcctgacctcatgatccgcccgcctcagcctcccaaagtgctgagattacaggtgtgagccaccatgcccagccgagttgttccttttgactaaagaattggtcactgagttgtgttcatccttatggcttcttatccaacccttgcgtggggagcaaaagtctgctctcttctttgatgtcctaaaataagacctgtcttccgattcaggtcaaacagggccagatggccagagcccaacataattatttgttgcggttgctgaaaagagttaagtgtttcttctgaacggtgaaggctggcagcaggcagatctgatttttccttcttctgcccactctcttcctcctacccaaagtctcccctcacgtgaccagcccttcctgtgaagtcgaggtgataaactcaagagagaaccagcgcagagaggagatggcagcattaaggagagacaggggtgtcctactggctggagctaaaatccacctcagaggccaggtgcactggcacacacctgtaatcccaacactttgagaggctaagacaggtggatcgtttgaggccaggagttcaagaccagcctgggtcacatggcaaaatcccatctctgctaaaaatacaaaaattagccaggcgtggcagtgtgcacgtgcatgtagtcccagctactcaatactgaggctcaaggactgctggaactcaggaggcagaggttgcagtgagccaagatcatgccactgcactccagcctgggtgagagagactcttaaatttcttttttaaatccaccttgaaggccaggtgtggtggcccacgcctgtaatgccagcgctttgggaggccaaggtaggagaactgcttgagctcaggagttccagaccagcctgggcaacaatatcaagacctcatctcaatttaataaaataatccaccttggattaacacgtataatttccttttctaatattcactgggcacctgttttacgccatgtgcggtatgttccacgatcagcaaaacagatgcagcagtccctgcagtggggaaaactcagtccatgaacattcacaccagcagggggtgctgtctcgccttttaaccagggagcccctctgtgtccttctcaaggctgcccttgtccatttcaccttcttccaattcaaatcttgaaaactcacctctaaggcgaatgggggtgaggagatacagaagaaaaacagtatgttctctcttcaactctgccccatgggctatgaataaagtcagaagacaaaatcccctgcttggtttttggcgtttttttcctattctaaatcaaagaccacagcagaccagaatcctgtggcttctcaaatgaccaagcctgacatattgaaaagcagatcgtcttgctttgaaaaaccttctccacccacccccgcaaccaatttcagctgattaaattcaatcactcatgccttaagactggcaatgatttgttgacttcaacttgaatatctgcatcttatttgtgccgtgtgtgttttctgccataaaaaaaatttatattgcaataggactatagctacaagtttaaaatagatttataaaaaatctatcccaaccatgaagatttctttgctaaataatgtgttttcttacaacccacaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgcttaaaaacactttcactaataaatggttataaatcacaatgtcgttggcttttctgttgagctgttttctatagaggaaaaggagttggggaaggctgggttttgcttcatcgtcccaaagattctctgaagtcagggttaacgtcatgaatgcagaaactgaggcctagagaggtgaaatcaattgcctacaaccccacagccagccagagagcagagcagagatgcaaagtgagactgtctaagggggttactgggccgctcagcagggagggcaggggagagaaataaggtgatgtgtggtctaagggccactgccccctgccctcgaacatgactgggaagaacatcttgactcatcaaaaccagtatcttaagaaaaatacaggatttccttgattttttgagttaaaacacaaggtcttgtccaatgagtcagcaaacactttccacaaaacgtcagatggtggctgggtacagtggctcacacctggaatcccagcactttgggaggctgagatgggaaaatcacttgaggccaggagttggaggccagcctagccgagagagacccccgtctctataaaaaaaaggtgttttttttttgttgttgttagtaagccaggcaggatagtgcacacctgtactcccaacctcttggaaggctaaggcaggaggatcatgtgagccaggagttccaggctgcagtgagctatgatcacgccactgcactgcagcctaggtaacagtaacaccttgtctctcacaccaccaccaccacccacccagccagatagtattttagcctttacaggctacatatggtcttgccgaatattcatcttctttaaaacaacccttaaaaacataataaatcattcttagagtaagggccataaaaacaagctgtaggccctgtccttctttcagcttgagtgttttagacagacatgcctgcaaaggctctgttcaacacaaacgatgccgtataccaccaactccatgggatcagacagatttgggagacaggaaacatggaaacaaaggactccatcttgtgaccagatgctaatatgccttgaatgacgcacaaacacatcccggatacatttctaaaaacctggcttgaatagaaattttcaaaaagattttttcatattttttaacttggttaaaaaaagtttttcaccactctgtgggaaaacattaaagtataaacatacaaagcctctttgaccagaagcccaacaagttcaacattcgtttctcttgattttattgatcttttaaaaaaataaaaggacatcttctgtggatacaggttaggatgtttctagggtaagaaacccaccatcgcagcgtaattctctgcggaatttcagtagcacttggaaagttctgttttcaacctgaaatttttgctgttcttccagaaaataacttagtaacaaaatgaaggccgtgaagctgcaggcacactccagaaattagtgtgttcttttaactcgtgtcccaaagagacagcagttcctaacatgcagtgatgagtggacacaccatggtgcgttggaaatcccacgttcacgtctttgacaaggaagcctcctacaatgatcttgtgctttaattttacttgatggtcaccctggttacttcattatgcctttgaatgaagtcctgttcttagtggctgcattaccaaggccatcttgccccaaagacccctcagggtcctgaggcagaattccccccaccccaccaggggactcaggaaaatgaatgatcgcagtttgccaaaagaggtcagatttcccactgacgctggttggtctggaaaattactctgaaaactcgaacgcacctctaggaatctcaatgagaagctaagaagcaggctacagtctcagaggtttatgacacctttttttttttttttggagacggagtctcactctgttgcccaggctggagtacagtagcgcaatcttggctcactgcaccctccacctcccgggtccaagcaactctcctgcctca

SEQ ID NO: 12983 - DNA, 157866 bp, Human; identical to SEQ ID NO: 12982

SEQ ID NO: 12984 - DNA, 157866 bp, Human; identical to SEQ ID NO: 12982

SEQ ID NO: 12985 - DNA, 49164 bp, Human
cctcggcctcccaaagtgctgagattacaggagtgagccactacaccaggtcatttcttagtatttttactcttttgatctatagtaagtaaaattgtttttatctttgaatttttaaatttttaacacagttcaaatcagtgtgtctgatttcatctccttctctaacaaaccagggtgccagaactgcttcagtttctctgccttctctttgtctatgatgactaatgtatgaaggtatctgctgcatcaaactttaaacttcacattatccttatttctcttgaccttgacagatctggcatcttttcacctggctgtaagcagaaagtccttgatctccttaactttttgaggcatggcagcatgtgaggcagggagaggacacagacccacacagcaagtggtgagaagccaacagtggaattgttttcttaattccatttgttgattgtttattgctagtgtatagaaatacaactgatttttgtatattgatcttgtattctaaaaacttgctcaacttgtttcttagttctaatagttaattaattgattccttagggctttttaatacaagatcatgtcatctacaaatagaaattgttttactttctttctaatctggatgccatttatctttttttcttgtccaattgccctcactagaacctttagtacaaagttaaatagaaatgggaagactagacattttgtcttgttcctgatcttagacataaaaacgttgtcttccgttattatgtgtgatattagttaagtttttcataaataaacttcacagtttgaggaagttcctattcctagtttgttgagtgttagcatgaaaaagtgttgaattttgtccaatagtttttaaaaatttttttagacaatcatgtaggctttgtccattttttacttctttaaatttatttttattgatacacaatagatgtacactttttaggtacatgcaataatttaatgcccctcactataaattcggagctgcctcctcgccgatgattccagcgcctgacagccaggaccccaggcagcagcgagtgacaggactttttaggtacatgcaataatttaatgcattcatataaagatcaaatcagtgcaattggcatatccatcaccttaaatatttgtcttttcttcatgctagaaacattcaagttattttctcctagctactctgaaatatacaatagattactgtaaactacagtcaccctactcacctatctaacattaattgatttttggtaaactaatctaatcttgctttctggcatcaacctcacttgaccatggtgtatagtccctttcatatgttattggatgcaatttgcctacattttgttgagaatttttatctatactcttaagaaatattgatctgtagtctcgtgatgtctttatctggttttgttatcagggtgatactggcctcatagcatgagttgggagatcatccttactcttctattttttggaagagtttgtgaagaattgatattatttcttctttaaatatttattgggtttttaaaatacatttttaaaatgcaacttgggtagcatgtccaataggaacaaatgagtgtccacccttgaatttcataaccctggaattaatccatgtaatctatgatccacaactgtattaccaaagttcgagttactcataggaaagagaaagaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggagctggccacactttcccaaatcaggtgaggggcttctggaatgggagggaacaaggtaggtttgtttgccacgtgcctcgaaattctcaatccattttaaccaaactcttccgagtgcaaggaagaaatctacagaaataagatgcaattcaataaactttcttcctgaggcttttagttaactcttgtattttagccatcatctgagcgggaagccggtatgactctgcaaggcgttcgtttaaaagttgtgctacttttgaggtgaagttaagagtgtctccatccacgccctctgcttcccagtcaatgtccctgcactgctcacgtccctttagctctctccctgcaaaccatagcggtgggtcctagacacgggacatcgctccaaccttggccaaactctcccaccctcagggttcccagatgtcctttgaataatcaaactgaagaaggagaagcaagatgtctccacaccccaatccctacagccttagccaatgcatgtgtgtaactgagacagaattttagcaaaaggtctcctgcttccaggactaaacagagcctctggcaggccactgcccgacacccaactccatcctccaattttcttaaatgtccaggtaaacatctccatagtgccagcctgctatagtctcccgaagacctcagcaattcttccccaaagcgtctccttctgcaccgtttttttctttgggcaaccatttgtgacctggctattgagcccacctgggcctcttctctttgtttgctgatagcctcgttaagtattaaaaacctactcccccccttcaggagccctcttttaatgaaagtttgggtactgggatcagatttgggacttggctacatttatttcctgtgtcattctgagaagagaaagtaatagaggcaagaaatttggcaccctattgatctattttattactttgttgagcaacttgtgcttcccgctgaagatgctgcatcccaacatgattctcttattattagttaccacctgagggttttggatctccaggtgtttatttcacatagcatatgctttaacccccttataagtcttctctaaggaagaaactgccatacttcccttgtcttctccggtgtttccctagctataaaggccccacctgcataacctgtcctcaggctgtgatgtattcccgggtgccctggtaccttctccttcctctccaccacccttcctgacagtgcaggggcaggaaagcatggggagaagggaaatggagactcccacttaacttgctgtgtgatagtaagagcattatttcacaactctgaacctcaagtctctgcccataaggttccctccagtgatataattccttaatttcttttgttttggttattgctttaaaataaaagtctaagcttaaggctaggttatagaaactgcccatcataattgctaggtctcaacatttgcttaagttttgtgattcttagtttcaagtctgttacccactctctctccccgccaccttttttccccctgacttcattgttctttgttcccatcctgaggccttgatttctggttctgctcttctttgaccttaaactgaatcaactcttccatcatccaactcagaataaaattggttttcttccaccggttccactgatgccaatggaagacttgtcttccttgcgatttgcaaaatgtctttcagtcacaggtgctgcggcaatgctgctgtcccacagcattctaagcttcagtctttctctctcttatcgtgggtcagtattcagaaaagggcagatttgtgggttgttcaggtttctcacttttctttttcttctttctagtttgggatcagagttgtgtgagtatttgtgtatataattttgttttggttttttgttcctgctgctacttacgactgctgttattatttcaattatgactaattaatactaatgactaattttcccctatgctagagggaaaataaggaagaaaagtttactctgctacttacccaaagcccaggtaaaatgcttagctgagaaggaatttaaaactcatagtttaaatgcatgatgcatgtctgctgtcattttatctgtgctgccacagtgtcctttcaagcagataactgagagttgctgtattttgctttcgaatttgttacagggacaaaaatagtgacccctcacatttaggtgttttggctgcttaatgcgagctcctgccctctagccgcatgcttattagtttacctagccctttttctggtcagtcatgactggagaatgccaaagagtctcccaagtaggctaccaaattaagaattgtgtttagaagtttgaagtcagtccaagtgttgtaaagattaaaacgttgttttgaagatatgctgtgtcaataaacaaatatggagccagagcaacacaatgtgaccaagtgtccaagcccagcttaggaacacttttctcccatgttatctagcaaactgacaaatcagctttccaacacgtgatgattggaaaatgctattagtttccttcaaaattctcctaatgtttctttttcaaaattgcctaagatcattggattatgtggtttgtgtttcttttcactgtagctgcttgttaaagcagtatactcaatctctgataagcaacagtaaatttgatcgatttgtatcctaaatttagctatcactttacattttgttttattcataatatgaactttagcttctaaaaatcaactttttaatagcttaatatataaagccatcttaaatcaaggaatatctatagggacttaaggtaatattcaactaaattggcaagtgactaccattatcctattaaagctctaaaatgcaatatttcaatcacagaaaaaaaatcttataatttaaagaactataaattgccagatgtttccctagttattacgttagtgacaaattagacaactggaaatagaaaacagagtatatgtttggaacagtcataaaaggactagtgactattgctgctagctgtggttgtattaacattaaaatatttgctatgggatttttcttcttatcaaagcagatgctcagatgaggaaaaactctcttgcatatgaaaatcaaaattgtcttccaaaatatttaagtaacaaaaaattcattatgtagtataaatgctgtatgattacattattcttatagttaatttagaagggtttgaatttgtttttgttttgtttgtgtttgtttcttcgataggtgcattctctaactgtcttaagtagaaacaaatgtctagaatctctcagtgattatcagtctccttcctattaccaagaatgtttttattgtgttgttaatctcacatgtaatttttttaacatttaaaagtttggaaaatgggtaaaaaatgagtgtgccttgtttcctattattacaatgtgccttcctatttcaagtcccaattctagatttccttaaaacttaaaatcatagaattaataatctttcagtttaagtcaacttttgtgtgatttcttgtccacttatacacacatagatgccttcatcttcaccaaataatgtagaaattttatttagttcaatggatttaagtactctgtatgcttaagtacaaaataagaatattgagaaatacacatatgattgtgtaccttttttttttttttttttgagacagagtcttgctctgttgcccaggctggcgtgcagtggcatgatctcggctcactgcaacctctgcctcccaggttcaaatgattttcctgcctcagcctccttagtagctgggattacaggtgcatgccgccacgcccagctaatttttgtatttttagtagagaagaggttcgccatgttggccaggctggtctcaaacttctgacctcaagtgatctccctgcctcggcctcccaaagtgctgggattacagacatgagccacctcacctggcctgattttgtacttttaaagagaatttgttgttgctaatttgctaagtttatttagatattttctgattctatattagtcaaagctcctcttatctactttggaaaatgaagaattatgtctataaaatatatcaacaacagctgcaggtacttacagaggaaatactgtggatctgagtgatattaggccctgaggatacaagccaaagtataaaaatggtctttgccgtagagagatagtagtcaagctaagcacatattttggcatgggtctctaatagcctaatgctagtagggtgggaagccatttaaaaatggcccctccttctgtcctgcctttcagaccagatggtgtgtctaaagtggtcacactgtttggttctggccacttctgtaataaccactgctcctttcccctcctcgtgagattataactcctttgacagtatggatggcacctaacgcatccttgttttcttttactaaatgttccacggagtcacttgcttgcctgtttgttgcttatttgtttgtttttggctaaaactacagaaaatgttaaatacattttcagacctttatattttaaaaaagaaatgttaagaaataaataatttttctaatctcatttagatacactgtcctattacacacaatgacaaatttgatgcttttgtcttgctaattgaagagctaagcatgaatacagtttttcagtctacagcagcaatgacaagggtaaagtggagaaaagagtaaggaaagaaaaaattaaaaagaataaaaggttgaaatatcaaatcggtggttcttaagatgacagaggcaggtgagacaagaatactggaatcacccagggggcatatgaaatctgtacatttcatccacaccttcttttctccccctgtcctcattccccctgttgagacacattgtattacaaattaggaggaaaccatctaaaattatctcacgtatcccagttcccatattagcatcatgagtatcacctgagagtttgttggaactgcagaatctcagaccctgtccagacccattgattgcataagaatctgcattttagcaaaatcctcaggtgattcaaatgcacattaagggaaaagaaacacagtgtaccgtacctgtggcttgtttagaataattatgaagaggtgttttcttggctcttaactaacgtttttaataaagctaatatttattgagtacataaatgtgccaaacacaacgttcagtctttctttaaattttttttatttaatcctcacaacaaccctgtgagatagtttctgttttatccttattttatagattgggataccaagtaataatgagataagtagtttacccaaaagctgtaactgatacagtcgagatgtaaacataagaattctaatttcattgcctgttctcttagctgttacctacagtgtctgctctatactgggctacctactttttaaggccaactaattatttgaaaatttatttaaagttttaatttgagatcaaaatctgtttccctcataaattttttttaaaaaaagcaaacaagatctattccattttgatctaatgttttcctgtcaccttacctttaagtgcaataatgggaaattctagaaattccttctttaactgtttgaaaaaataccaaaactatgacagcctgtccaaatccactaaaatatatttttatatgcatgctttttgtatatcaattatacttcaataaagctttttaaaaaaatagtagatgacatacttttaaaaattaactttggagcccaggtatggtggctcagacctgtaatcccagcactttgggaggatcacttgaggccaggagtttgagaccagctgaggcaacaaactgagacccccatctctacaaaaaataaaaaattgccagagcatggtggcgcacaccatgtagtagttgggacctgtagtcccaactactcaggagactgagttgggaggattgcttgagtctgggaggtgaaggctgcagtgagccatgatcacaccactgcactccagcctgagcaacagagaaagaccctgtctcgaataataataataataataacaacttttgatatctctattttttcccataaaaatccaaaattttctgtttactttttggtgctctcatgctataaagtaaattctcccttggattggacaagttattttctgttttctacatacacatagactgttcagcattccaactcaaattacatattactttttcagcttttaatataaatgcttatttactacaagcatggtttacaaaaatgtagtaaaatatagttactaaccagtcaatgctcaagccagtgactccccaaatgattcagtccctgagctgtttcacccagtgcaggtagattctctgacagccatcagttggatctgtccgaatatctcctgttttgacaggggcttattgatgttggtcaaaagacaggtgtgtatgggttccctgggatcatgtttgaggggaaacctgtgccaacaggactgagcagccactttttcaatggtattgagaaaatttgtaggagataaaatttcaccagctccttgaatctagaactgtagatattcaggtagcactgacattacaacatctaatttgtaagttatgggttagggcaaaatcaatccagggctgccatcatgacaagtagtggaagtttgaaagaaggagaaatacccaaaagatatcttacacatagcaggcagagtttcttagtactaataaaaaataaagtaccagtgatcaccctctatagcccctaagagtcccctggtttcactaagccccaatatttgtggctgtggctgaatgcaatctgcacaaggttttctttttaacagttggaaaaaatctcatagcatagcatttttttctttttaacagttggaaaaattctcgtagcatagcatttttttctagtaaatttcatatacttaacaactttatcagcacatatattttccttcacacttacaatttcatcaacacatatactttactttttgactcaaattcttcttgccatcaattcaaatgctcctgcccttagaatgagaattttccattaacccagctttaataatctaactctcccattcaaatgatgtcacttcatataaaacacattttatcatgatgtctcccagccctcagttacacagttaattgctgccactttatcatgaatgaaaaagatgtgattcttgggtaatgatttcttgagtatgtcctggtctattatctactgagttaccagagtggatttttgagagaacacacagttattcctattccttttaatttccattaacttaagccatatgatagaacattacagttgttatatattttgtataaatataaaatgtaatatataatttatatattttaaaatatttagtggcaagtaaagatagtagtaagtgaaaaaatcactgtataacatatgaatcgtaagtgtgatcccatgtatgtgtatacctggtagatgcttgtcaaggtgccattaaggtcttgggttattggcatcttaatgaaattcatttaattatgttaggattgatttgttagtaaaatcacttacatgttttttaaatgcatgcatatctgtggagccaataagaaaaattaggaacaatatacaacaaatcttaagagcttttgaggatgattttttttctttctttcttttgtatgtacctacaaaattttctataatggatctctattgattttatattttttactttctatttgtcttggaatttctattactttatttataattcactctagattttaggtactagacaactactattaactctctggagaatggtactataaatctgaccctttctgtcatttttttttcctgtggtacactagtgtctcacaaagagtccacagaattcacacggtcatgatattttatagaagaaatcattttatgggaactttcttttgttaatagatccttccaatgctaacattattctgtataacagtgctaaagttggtatgcctaaatgctaaacttggtatgctaaagttggtttaaaaattaacctatatacaatcttcttgaataactcttcaactttaaataaatttcttatttaaaaaatcctcctatatataattaaaaatactgatgaatttgactacataaaaataaatgcttatacagtaaaaagtaccataaacaaagttatcatctaaacaagaaacctgggaaagctatttgccagccattacatgtaaaatttaagtttccttaacataacatgagctctttaatgtgagaaacaataaacaacctaattgaaacatgagcaaaagccatggctgagaaaactcgtagaagaattactatggaaacaataagaaaatgaaaagaagttcaacctcattcataattaacgaaatgcaagtcaaaacaaagatataccttttacttatcagataaagaaaaaatgatttgataaaacccagattcttggtattataaattggtataaccttaacggaggacattttatgaatatctatcaaaaacttagcatatacaaacaatttggttcaacagtctgttagaatttattatatagatacattcatataagtacaaaagtgcatatatgtaaatattattattgggacatttttgtagcagccaaaaggaaaactgaaaaaaaagattaaggctcattaatagcagactggttaaataaactatgtgtgagtacaatgaatgaaatattgtacagccatcaaaatgaatgaggtagatttatatatgctgatgtaggaaatctgctagccatcataagtaaaataaatgaaacaaagaagaaaatactatgatgtacaaaaagaaaaaactatagatatacatatttatatgcatgtgtatgcattttttatgaatatacatatttatatgcatgtgtatacaagtcctagaaggagacataggtaactattagtagtacctctgggaagtaaatgcagagaaaagtaatagagggtaaggatatgtttacttttattttacatccttctgtaacttgacatttatacgacgcgttagcattacttctgggaaaaagaaaaacagaaaaggtaatcttttaaaaaggtattttttaaattatggtacaataaaatgtgcataagctttatactaagtaatagaatcatttaagtttagctgtagattcacaagtaaaaatccaatctattttcatattcttacatttatagacatttcttacatgtctatagaaagaaatggctaggaatgagactgcactattttaccctaaaacgttctttttctctttgcctaatgtatatctacaagggcattggggaagatgttgaccacaggcaggaagatgatgagatcctgtgcccaccacttaatgcagtctagctctatataaggaaaaatatgttcttgatgtgaaccagatggtttcactcccttcaaaaacactcttaagatgcagtgtggaagcttactctgtaaattaaaaaataaaaacctgactatattcagtggaatgcgttaatcatttttttctttttaggtttgatatttgacaaattgatctaaaatggctgggtttttatctgaataactcactgatgccatcccagaaagtcggcaccaggtaaatgccttacatctacagcagtgggtctgtcagcagttttctttaatgtgtcagcagtggggagagcgcaaaaacccacacacaccattatcttgtgaaagaagtagaggaagcagaaaataatgaaatcccagtgttaccacatcccctccaatatacagattaagagcgtttgtatttatatggttttaaacataaataacatcagaattactaagctatttccattcatgtactgataatgaatcatgtgagaaagtcctttggcaaggactccacatggccacaggtgattcctttgagcagtgttcttcctgtatagggcttaagaggaccagaagggaaatgattgtactctcttgtcagctacttcctgggcgatttgggttctttgataccccagtgctcactttcggaagtgttaagaccataaaccttaacagttgaccttctcaccttcagaaaacccaaatgtctcggagtttcattctcacaaacttccaccttcctccaatgatgagatataggaaaaaagacaatgtgaaattggagatggaggtgccctcttagcctctttacaggcatgagtcacatggcagggcattaaactctctcacaacctgttgtggagctcagcagggttagccaggactgttttgtctatctaactcttcttacatgggcctatgtgatatttttcataacaagagtccgggatttacctaactaataagatttccccacgcccctccttacaaaaactcagttcaaagaacaagccctcagcttctcctagtcccctccagggaaaatgaagagtagcttgtcctattctgaatatgttgtgctcccattttatcaaagtagaggatagatacgtaggtgctgggtgggtagataaatattagagggatgcttcttctttgctgtaacagattggcaagtaggaatcattttctggaaggtactccacagtggtggtgttagaaaactatttagaatgcctttaatcttggagataaaaatagtaacactttacagagttctgtcaatggatatctttagggatgttttgttttgggaggttttttttctgattttgtttttttcaggtatagcgaagcttgggaatctggactgtgcagattttctgcaaaaatccagctctggaaagagtgtattaagatgcatatcctaggatgacacaaagacagtatgctttattttacatcttaaaagtattgaacagaaggagttttgtccatgatatcccatcagcccactagcaggaaaagcaggacacttacccagggggttcctgctggaaatgattcttggaatcagccttccttctactctatttgggaagtctttggtttctaacattcacacatttgtagcaaagcttccaaaataactatgatgttttgcttaggaataacaaaacatggaagaaaacattctgtgaaattttaaactttttcaaacctttaagtttcagatgaataagcaaaacatacttaagtctaagaagctattttttgtttgtcaaagaactgatgttataccagttctaatattaattagcaactttgccctggttttcctgtaaaataatctccaaggccctatctcaatctgtgggcagtatactgaaatacaaaaagtgttcacaaaaggaccttctgaactttgcaatctccctttaaaacttttaccaacttaaaactacagaactctgatctcttattgatttaaactagtgatatgtaaacagcacttcagagcttgtttcacaggaccaaaaaatttatgctgaaatctactcatgacaaatgggaaaaacctgattagcacatttaaatgaataaataaagaaccgtattcaatggcttaaaatttatagacctgcatcatccattatggtagccatttactatatgtggctatttacatttaaatataaacgtattaaaattaaactaaaaattcagcccctctgttgcattacccccatctcaagtgctcagtagacacatgtggttagtggacaacacagatttagaacatttctatcataggaagtactactggacagtactgctgtaaacacacttattaataatgcagcagactttcttggccacttggtaagaaagttttctgctcttttaaacttatttgggaagtttttaatacttttgaaattatgatttcctcagtgttagattatctgatatacagctctcacagaccattttttgtttttcctgtttgtttgcatattaaaatatataggattcaatgtttcacgtgcttttctaaagttgcagttcttgatttcttaaaattgtgaaaagaagtacccacagttatattaagaactaaaatatatggctgttggcttggttaccaacattgctgacagctccaagtaagcaaaagtaaaaaagatgtaggatcatttttaaaggccaatattttcttccttactcattaccttctgtaaaattctgtaagattttctttagttttccagtaatgataaacatttcaccattgcatagacataattaattgattttttaagcagttggagagccaaacaaaataaggggtagaatacttcttattttattttttaataaaaatgtacatattagaagcctttatttttatttaaattgtatgtcactgataaggtttggatatttgcccctccaaatctcatgttgaaatgtgatcccctgtgttggaggtggggcctggtgggaggtgtttggatcctgcaggcggatctctcatgaatggcttggtgccctccccatgttaatgaaagagttcttgctctgaaactgtgacacctcccccctctctctcttgctcctgctctcgccatgtgacatgctggttccctatcaccttctgccatgattgtaagcatcctgtggcctcaccagaagcagaagctaacaccatgcttccttgtaagcctgcagaaccaggagtcagttaaagctcttttctttataaattacccagtttcaggtattcctttatagcaacacaagaatagaccaacacagtcacggataacagtagtttttcatttttcatcaatataatgatcctgctgtattcttaaagttcttaatcactatttgtcactaatacgataacattaataaaatttgagtctcagttactttccagtcacttatacctagcagttcaataacatttagttcctggactaatgatcatgtgttatataaggcaaaaaattaaaaacaaatttgtctttgagtcatcaaagcatcaagggtttgaaatagctatataactagctgtgaaaaagggatataaatatccagctgatatttcctttacacatttaatagtatcatttttcaatgaaagcataaataaaataagtttggaaccagtttggaatttttaaatattaatcgcagaatcttactaacagaaaacaaaagcaagataaatgctagtcatttgtgcctgagtttttttttcaataaacagaaatgaagcttgctttaggaaacatgtgtactccaaataacctactattcacacaattctcagtaacattctttctttgcttaaataatacagccagatgtgcttagcacataactctatagaaaataataatttaaattagatttaaatagagatagatagacagacagacagatagacagatatttttgagacaaagtctcactttgtcctctaggctagagtgtagtggcatgatcatagctcactgcagccttaaactcctgggctcaagccatcctcctatctcatcctcccaagtatctaggactacaggcacatgcactatgcccagctaattatttttttaattttttgtagagatgtcgtcttgctacattgcctaggttgctcatgaacccccagcctcaagtgatcctcctgcctcagcctcccaaaatgctaagattacaggcatgaaccactgcacccaaccaatattaatatttttaacaattgaaagagctcaaagaaataggttttaaatttagaggccctgttttgctgacaggaaaggcttttagctggaatcaagagtgctgttgtcttttcccttcaattagtcattccttttaagacttttaagatttaaatgtatgagtcattttttaaatcccagaaagatctagtatatctcataaatgtaataatacagtgcagacctggtggaaaataattatttatctgaaactgggcctcagtgcctttcctgaatctaaacaaatgttcatctcacccagagaactgggacaacaggaacaaggtattgcaagtccaaaatccaatccaaagcagcgttcttcctccccacctctaggcaaggccaaaatacttctgcacacagtatagacaccagaaaaaaacagagccactgtagatgaaaccagtcagggggtaagagctgtcttttgatctagagcttgcacctttgctcctcagtaatactcccaggtcaaaaaggaaaaataagatgggcagttggctgcctcctggtccctccagcctggtcagtgaacagagtgggaagataaaacagctaagtatcttccttaacaatgcaaagcaagaaatccagtctgctttgggaaagtgaaagcaatgcaaattcagattattaatcataagagcatctcatgtgatatacaaaattattgtatagcagtaatgggtcagccgtattttattcaacactgaaccattaatgaatgctagctagtcttcctttcacttacagaatgtttatctatacatgactaaacaaagaaggagcgctggaaatgatcctgtgaaaaatactggctcacaatgtatcagctgagtttggggcaactgaggtagtaggaggcgccccctggacttctgctggaatttagatttaaatagatggatgaattagacaaaacatactctctgaaagagtgagaaatacaatattcaccaattaagtgaaggaaaaatctacactatgaataaaacaataaatgtggatacatttgaaaatttgaatttcaaaccccttaagataatgtgacaaatacaacaggcctaatttaacatcttaaagagatctgtgtgacctattttgcagttttattttcttaggacaatgcttcagtatctttaactttcatatttaatcattttttttcttttttggtttctatggtatcaccatccatcaatccatattggttggagggggggaatatatatatatatatatgtatgtctcccaagagaaagtaattctgcaatcttcctcagcaattcagtctaacaattaagaacccttaagctaaatagaaaaattcatttcacaggcaagttttactcaatatgtataattagttttagttaactttattaatgaaatgtcgcaaatcaattaggtttgcaataatcagatgccgaggacccaagaggaaccattcctctcacaagaggggaaggtgatacacaatttagttgggaagcaaatgtaattagatttgatcaattgagtattcctgtcctgatgtggagtcagtcacatacccaagcctgagaatatatttgaaaagaggtagaaaaaaacccagtatgacttagaaaatgtccttgtggtcctattggccacaactggcagccaaaaagggctttgaagccacaggtagacaggttttgttcagacagggctatgttttagatttctctttcaaatctgaatggttttacgtagggcaatatataaactttcctatttgtcacagattctagcactctttaatgccttatactgggtgtttcacacagttatttaactgcccaaatcccaatggcacttcagtttgcaactatcatgacctagaagttagttattgaacagttatgaggtaacttaaagtttcttccctttgcctctagaataagaatatcaaagaaatgtcatgatgataggaatactactgaaagaggatattaaacactaggtattcctacttagggctacagtttgcagcagattctattgtgtttcagtcaataagtgtttttggacacctacatgccagacactattctcagcattgagcacaaagtcgtgagcaaggtagacaaaaatgcttggcctcataaaacttacattccagtgcataaagatgagaacaatcacgtaaaatttataatatgttggatggcatggaaaatggaaataaagtggaagggaggcttcaggttaaaaagagtgtttagggaaggtcttcttaggaagaaggaggaagctatgtggacatctgggagaagatcgctccaggcagagggtagagcaaatgcaaattccttgaggcagcaatgtgctggcatggtcaaggcacagcgagtatgccagggtcttcagaaaccacagagaagagtggataacaaaagtgaaatcaagtattgaagagtatgaactgacaggaactagagacatatttagaatggatgccagaacaggagaaatgggtgggattttaaaagctaaatgatttaaagacttaaaatgctctgaagtgtagtgaaatgttccccaaactgcagattttcccaggaaaccaggtgcataatttagtcatcgatgactggttctgtggcaatgactctagtaattagacccctgcattttatgtcagttccttctggatactcagctacattatttggtgcttttggtatacttcaaatatgcattgcctatcactgacctgtaatcctgtgtctctgggcctgaaaatataacttttcatgtagtagagaattagggctgtgcaacattgccactagattatttttaatgaaagctttgcccttttagataaatacagcaatgtattcaaacaagtcctagggataccactgagtgcaaaatgtcatgtactagttattccatttaaattattttatcttcaagtctaataagaaaattctaaataaaattatatatttgggattgtgtgtgtatcatccatccacatgtaagtaggaataaaattatttaatggaaaatttcaaataggctaactctaaaaatgtacagataatctggatgagagaaaactatcctcactttgtgttatttttcaatggtagcattttctcataatccccatgcttttttcatgtcctgctattctttaagatttcctaatgaggattagggaataggcatatttaacaatctgtgttcgcaggttgaaaacaagaaaatgaagactaatagtttctctcctgttaatttgattttctacagctcctctcctaccagcttaggcagaggacttagttactatttccaatagatgggagccaaggaaaagacaagcatctgtgatgtcatgtctcccccaaacgggtagctgcctcaccagcctccattagagacatcccccagagtaagaaataagaaataatcatgagtagaatgagaaaaaaatgcagcttcctttatctgagaaaaacaatagtagctcaatgctgtggcctaaagggctttgaaaataatgcaatttctgataaaaataaatgccattattcttgcttattgtcactgttttagtcaaataagattttagcaagcatatttcaaattgttctaaatctaagtaaattggtaattaaatgctatcattagaaagtattttaatatcagaaaaattggaccataagaaagttagtttacccttgtattcatatatacatgtgctttgtgctaaaaattgttatcatttagtgagaacctgtgactatattaattaatttaatttaatcttcatatttctctgaccgttagagagtttgtgacttggataactttcaaacaactagtaccctgatggaaatccagaattttgttaacccagatcacagctgcatacttaaatgctatgcaacagtggcacttacccccaaaccgtatcctatggaaatgcctttttagcaaattaaactgaattgtgttcagagatccacaggtctaagcaacattagggaaggggtaaagtagtcctcagcaaggcccttttcagagcactccaccagtgcccttgtcctcctgggcagagctcctcagctatactccctttcctagtctaccctatcccacaacggaaccatacttctctcatggaagccctggtctcacagaactaaaaaggaggctcctagaaatggggttgtgttgagttgacagagatgtgtggctctttaaactgaaatataatccaaagagaacaagatctagtagaatttcaggtcctaagcctggttaaatttcaggtcctaaggctggttaatagtacaaatacagttatttatttataactagtgcaaatacagttatttatttataactatacaggaatttatttcccagtaccttctatattactaacatcccataaaaccagccatgtaaggaactagaacattttgagaatatgcaatacataaccttaaacaagaagttttcattcctaattaaaaaaaataagctagttcatcacaacttccttcaaatccttctgccactgatttctctcctgaaaagagatattatacggcattttagagaaaacaaacatctctaagtcacaaggagtggaataatcaaagttgcattttaagcaagattatggttttttctttgagttctctgaatttgaatagtttcttaaccttagttttttaactgctctgaaaatggtttctgtccctggtggactcttgtttcaatgcagttattttgtctggtagagtcacagagttaagctgtcattcagatcagaaaaaataaaagagagagatgaattaatctcaatggcacagtctccttattcaaaaaataaaaataaaaataaatctcaagtccaacaatgaatcatctttgagactctcccaagtgatctagttttaagggcaaaaactttggggaaactgttgggggagcaactggtgcccagtactgtttcacacacgtggtttttcttatctattgctcacacacttagacataactggaattattgcctttgtattgttgttgccattttataaaggaagacaaaaaagatcagacaaaataatagtgaacatctattaattggacacttactggtgtcaggcactgtgtcatgcactgtgtcaggcactgtattttcttatttaatccaacaaaaaaaaataggctaaattatcttattggctcaattttctttacagaaactgagcctaaatttcccaaatggctaaccaatgccagggccagcaactcaaatttgggagtaattccgacacctaggttccaaccatttttctcccagaaataacccaccaaattcaccagagtctaagatcttactgttactgtttaattaactgctacaattgcagcattttaaaaaaatataaatgagcactgtgctagtatttaattatagctttatactgatactgggtacaagtataagctaacaccattttgaattatagtagaagagtcaggagctctgagaggaatgttcaggatagaataaagcagatattttaatgtctcatttcagtgaggaaaattgttaattcatatgccaccagccatcggcagaaatgtaacaggaaatgaagaaaaacttaattactttaaatacagtggtctgtagtacaaattattgtgccgtgaattagtttccttctgctgtagaattgatcattttgattatgtagccaagcagtgtaagacattactaaaattattcttgaatcctacctttgagatctatataaaacactaggcaatttgcctgcaaatacatagaaaacaatttttaaaaggattgggatgagttattttcccctctgttaaatattagcctttgaaatgaacccagctgatctgccaaataacacttggaaattgttgtgttttaataaagtgacagactgagagggaagccacactagacgtccttatgcttttagaggccttacagggcaggaacattatgcaataatgccttttaaaagaagtgagcttcctagtattacaccttgcctggcaacaaatgtagccacttactgaaatgcaggcgtaattagaatctatgaaaatctagcatcagaatcccaaacctctatgcaatactcagtaaattacagcttttatgtctgtaatattttcaaccattctacttaaatatgtgaatacatgagtgtggagttctttaggaggcctgctgcatatgctagggaaaggtttcatcatttctaatcaggatggctctgtaaatgggatgcctcatgttcaggtttctggaaggctcagagcctgggcttctactggcagagggtagacccaaatggactactctagtgaaaatctccaggtgaacatggaacgcagtgaaaacctggggtatccaacttgcagtataggccaccagcaagtgtcacctctattataactttaaccaggcaagctcagtctcatgcattagtttataaaattgcaacagagccttctaagactgaaaggacattagtttttaaacctatatattatgacctaattaaatgaaattttattttaaagccctcataaaagtagtaaaattggtgttttaaataaaccaaatgggaattcaaccactttaatttttcttttgttccaataggaaaataaatgctttaaaatttgaagttgaaacatgggttttaaatatattgagataaaaactattttgcataggcattttgaagaaaataaattttgttctcgtgatttgtgattggccattgatttccgtgtttaagattatgaaggtgtgctcagctgtctactagaaataacaggggagactcagtcttgtttcaaatggaagggctcctattcggttttctccttcatttcttaaagtgttgtgatttttttattccctggtgttatgtcttgagattttaaatcttaaaacatgcaattaggtattgaagttgaaagctggaagtctcagccagctagtaatggttttttaaaataggtaatacagacctctagtggttgaacagtttgaaagcctctgcaagaaaaggaaattgcgcagaaagtgcctgcattttaaggggaaaagttagttaaaattattcagatgataaaattcacatatttcataggaaaaaaaaagccagaatgggcttcaagggaaggtggcacacttcccatccttttagatgttcctcaattcctctaaataagcaaaaactctctggccaaagtcacagtaagaagtctggatctgtattatttttctctaaaagatcttgtgaacagagctgctagatctctgtattatatgaaacatatatttttgtacacagttttgcctcactggggctttgcttcctttgtactccagaggctccccatgaaaacaatctgcagccacctcaacttgcctgtgctgttctcaggttctgtccatggggagccacacttcagtgagctcagcgattggatggctttttagtctacatgagagggaaactccatgtgcctctagactagtgcttctcaaactctaatgaacacccaagtcatctggggaatctgcttgaaatgcagattctatctcggtctggggtggggcctgaggctgtcttgttcgtaaactcccagttgatgctaacgctgcccatccagggccacccagagcagcaagccggttctatgacagctctctttattttttagttacatattttgtttttactcatttcttctttgtttgctcttttactttaataacttctgttaaatttttaatatttggatctgtaaaacatttaaagttctctttcacttcactatgtacaagtatctctgggaatctgttattgaagttttgagaagttgatctcacattttaaaaatagattcagtgtcatctctttatcttgaaaagttcatggtagttgtgagcatctctctaaccacttgaagctattgggttagaggtagctacaattaaatatctgattagccatattgggagagtgggtgaaaacaggttttgtgcatgtggtagatgtgtaggaagctaaggacccaaaaaacaaccacatcataaaatcaagcagaaacacacacacaccacacacacacacagaggctcaaagcataagtgtcaacagatcagaagaaaacatgggagaatgtattttttcataccaaattattaaaattccatcatctaaataacttcctatcatagcatgttgtcgacctcatttttcaaatccataattttagaacttatgtcgtggggtagtctaaaagcctcttgcaaacttttaacatctagtttcaaatcaaaaataatatattaacaagctgtagcatagagggagtacataaattatcatcattgccctgcatgaatagtaattcacaggtttggctcacacacaacttagatgaaataattaactatgtacagtacttaacagtataaaagtaattaatctagctgcctcgtaccggtttggcctaaataaacatgcaataaaaaagccataggattttattatttttttactcacgttactactttagtgtgttggaattttaatatgtcagaagaaagatatctttgcattaaaaaatcattttcttttcaaatgttaatgtactgattataactaagtgaattccatatatttataattgtgggcagatgttctcaattaatagttttattcattctacttcacagtttagtgaaaaggattattttaaattaaggtgtaaataagaacaaatgagatttttattactacaaatcacacagaatttgttggtggtgctataatcctgtgtaggtatagctttggcaaaacatttcagataagcttgttttttgccccatgggttctgggacgaggtgagttgtctgtttgtcctataaggttcagaaaggtaaaagggcaaggtcattaattggctagagggcaacaaagaaggtagttatccctgtgtggtcaagaaaaagtggctcaggttatcttgctcgggagagaaaatgttcattcagctccagtccttttggtaaaagcccactctcagtgtatgagtgttcctttgcctaatcatgtagactataacatgttttcccctatatgactccatcgattaatcattgcagtattatccccacttcataaatgggcaaagaggaggatgaagccgagtagttcttccaaaatcaagtagcatgtaagatgtaggagcaaaactcaaatccagagacttctgcttccagccaagatggaataacagggactagatttacctccccacctaaaacaattttaaaaactggacatacatatgaaacaatggttttcaagagagtggacatcagataacaaagggcagtgatccctggaggataggaaacaaatgacctgggattgtcccagcccactgcctggagggagtttgcaggcatgatacagggatggtacacccaggcagaactcgaggtcctctctgagttaaggacacagagctgggagtccagagaggccaaggaggctagagttcagagtaccagagagttgagagctgcacagagaacccagagatctgcaaatggtaccccttgtgcttcagtgcatgtgggcaaataatcacccaaacgtattagagagaacaagccccagaggtcatcaagagctagaaaatagttgctatttccaccagccacagtggaaagtctcataattcatggagcatcaggtagcatactcagtaggttcttgcctcaggaatgggaaaaatttagccctagactaattgctgctctggtaccacctaagaaaccgtaaaagtcagactcaaaagaattaaattatttgcaagtaactcaactgcttttcagaaaacaactggagaaattttgtaggaatacaaaagcatccaatatccaacaaagtaaaattcacaatgtttagcatccattataaaatcaccaggcatgcgaagaagctggaaagtacaacccataaaaagaaaaaaatgaatagaaacagacccagtcagtaatgacacagatgataggattattacactattacattaaatggttattatgactatttcatatgttcaaaatgcttgatggaagtttgaacatattaaatgaagacatgggagatataaaaaagactgaaattgaacttctagagatgaaaactacaatgtctgagatgaaaacttaaactgagacttcagatgctaagactacatttgtttcacatccccacaacattcttccctggacgctgagtttcctcccagcagctgaatacttcatgcttcatcctttcttaatgctgaactctcagaaaaagtccttcattctaagaagaggcgggagggtgccactctgtagcccctttctcatctcactctggtccctgctggcctggaacagattccactcccttcatgcactgatactccactctagactgagcctcttcatgaggtagccatcaagccatccgcagtcatcaacatggcaccttctgagtcagttacaagagtttgcatcatcagaccaccattttccgtctctgttttctgacttaccccaaaactctagttaaaactcatgaaatattatctcttcacatgaaatacaattaatatggaagtcagcatttttgcatctcccaacgcttcacatccaaggagctgtgtatgaaatcatgaactatgttcttccagccaaccaagcaattaaccaaagtatacatgtccatgttgtccttgtacagagtttgaaatatgctcatgagaattaaactatttttcagtaaatctgaaaaatcaacttgcttgtccaggaagttttattagggatagaatcccaaacaatgaatgtgctagccaagtgttactattaatcagaaatactccatattcatccaggattaatcctgtgtaactccctcagtcagtgtagcaatgtgttctcttcctgcactttttttatgtgtgtgtattcccaaatctgcagtgaatgtatttaggaaatacattagtatcaaaaggacaaatgtagccttaaaacataaatgtacagataatttcctatttgtagcaaagttcacttcagaaacacttgataagaactattcaaaaataaatattttcagtatttatttaaaatattttaaaatgtaaactcctcaccagtcatctagccagggccactgagtgtggctctatgaaatagcttcagtccctttcactactgatgaccttttgaacacaagataatatttgtcgagtaaatgtcaaaatagtataagaatacccaaatcatggattctatgctgtattcactcacatagagacttcactttggagcacttcagagcagcaacagctctaagagatgtaacagtatgctttccaggatagaagaacgaaaagggaaaaataagttgctagcaagaacaatgaggggtaggggtgaagttcaggctgccattctgaaagcttcctcagactgagtcaggcacatctcacgaagtgcagactatgcaagctggctgtgtgagatcaagggtagacagttgactcatcctgtcacatctctgtgttttaccgtaacctccaactattcagccatgaatcgctgcatgtggaatggaagggggaatgtctaacaaacagagacatacttcaagtcttcagtctagttaaaacattggaatgagggtctgcaacatctttctggggcttggagtctcgtctcagttctaaaatgagatggttggcctggatcctaagtttcaaattggcagcctttttaactaaatctaatctagaagagttctgttaggttccacagtgttgggttttaaaatatatatatatattagttgaaaacattttaaaataggatctttcacatgaaatttgaaattttaagtttatattttaaagttagctgttttcccccacctcattacaattggcacagttgactatagctgagaagtgaccccgtggcccccctccaagaaagggggagggccctccattcaccaccatgtccacttcacctatttctcccagcctatatatgtatttgaatatgtgaaccctggaatgcataatgtctagggaccataacaacaatagaatgctatgaatctctgacttacaaggactctcttatgaatctctgacttacaaggactctcttatgaatctctgacttacaaggaaaacaaaagactgtagagaatagtagttcaaccacattttaggttaaaatagactttacttggataacctgacaaccaaaacatctttgataatatagtaattgtgtatgtttaccagacaaagggtatacatgtatattcttgtatttctcttaagaagaaaatcaataaatttgacccatgaatttctttctatagcagacatttttgtgacttcctgactcacaggagatacagctaccctccaaacctaaatcaaaagtccgtaagttgcagaatgactttttatgtaaagagaacatactagtttctgataagatataaagaaaccatgtaatttatctagggaatgactctaagctgatcattgacttatttacacaactatagctactggaatagactgattccaaaaatatattttctctgaattagaatctttttcatatcaaaatatccaaaattattagcatattatgttattctcacaaagtcctaatgaacttcacaaatctgcctgctctattctgagtacaaaaaatatttagcctaatttgtttttccattattttatatagtaataaagtaataccaaaaatgttattgccagaaacaatacagtgttgtataattattagaaagtgaactcatgaaattctattaaaaaacaacaattaccacatgttaagtcagataattcacagaagagacttatatgaatactaggggagctgtaggcaacaaaatttttctctgaatcctgcattttgaaggaagtttctgtcatttaattagttgaggtttgattcaccaaccaaaggtctatagtgtgatatattttcttcctccaacataaagttaacttaaagtcatttgtactttatgtgtttattctttcacttcttccccaaaagtaattctttaaattgctttatgggattaataacaaattatatcattatatatttttgtattattagggcttctaacttcattataatcaatttattggccatatataataatgcaacaaattacatctgtaaagtaaaattttatgacgcaatttacttagtatatgtataagtctcattctgctgcccaggctggagtgcagtggcgcgatcttggctcactgcaaccttcgcctcctcctgggttcaagcgattctcctgcctcagactcccaagtagctgggattacaggcatccgccaccatgcccagctaatttttgtatttttattagagacggggtttcaccatgttggccaggctggtctcaaactcttgacctcaaatgatccacccgcctcagcctcccaaagtgctgggattacatgcatgagccaccacacccggccggagacaggttctccctgacctgtgagactgcaaaggtggtgtttcctatgagtccagccagataatagactctgctaacattaattaaattaatattcctttttaagattctaggtgctgaatatatatctcttggtctataaattagcttcgcacttcagctatttagcaaacttgttttttattgtatctagtgtattcatactgaatgggtataatatactgtcttttgaaaaagttattttgtacacataatcttaaaacactcttccaagggcaaggtagaggcttcataatattatttccatttgtcagatcaatgaaggtttaatgatttgtccaagatctcaatttctagagaagcgaagaagaatcccccaattctagttctaagtttcttttttcccttgctaaatcctgcagtctactgatttttttttttttagacggagtctcgctctgttgcccaggctggagtgcaatggcatgatctcagctcactgcaacttccacctcctgggttcaagtgattctcctacatcagcctcccgagtagatgggattacaggtgcatgccaccatgcctggctaatttttgtatttttagtagagacggggtttcaccatgctggccaggctggtctcgagctcctgaccttgtgatccgcccaccttggcctcccaaagtgctgggattacaggcgtgagccaacatgcctggcctgcagtcaactgatttatgttcatcaccttcttaagttaaattgctcttttactcattgcctttggttttgtgtgttaagattcagcatcagcattcatgatatcttttcactcttaattctgagtgtttccgtccgtttttttaatttttgtactttatgggctttttcttcatttacccccaattatgcgggaaaggctgtgtgcctcttttgaaagctctgatgttctcaatgaagagaccttttaaatgaccttgtttgtcccccaccgagttgcatatcacaacttcaaatgtctcactaaaatgttacccatttggcatcagtatacagaaaaggctgcactctgagataagaaagaacagtggtgttttcatagtaagagaatagagttcttaatgggaaaggggagagtataatttccactgatttagctggtctttcaaactttatgatgcttttctccttgaactagcctataagaaatttgtagggaaaataccacaggaatcaaattttgggcatagatgtctattaatattgctccttacaaagctttttcccagaattgtttctccttgcctacaaaaactactccatgcctttattagtcagaaaagcagttttgtagagaaggcaagtaacagagaatcaagctaagtaagtgaaactctgtaattgtcaaacttccagaaagtaacatttgtaactaagtatggtatctttgtcctctctctttctctcttctctccacttggtttctaatgaaagccttgattacatgttatatttaatgtactgttccacaaagaagaaaaggcctaatgtgaatgcaagctgaatttacacttaaatattgcagtcagttcagaccggaaggatacagatcgatgccctctgatcctgtcagattccccgaagtgtctatggcagtgataccacaagagggcagggtttgacttccggactaggtggcttcctcccttcagtgcagaccttggggccacgacaacagccatcaatctcttgaaaccctaatgatgaatctgagctcaaattccctcttcagccttatctgtgcagaatcctgaagttatgaaaaatgcttacagaaggtaatttctagaatgatctaacacagcagatatttagtaaactccctgtttgagagctcctactaagcacccaacacagctttagactttggtcacccaataggattttatcttttgtgagggatctgtagttttccccggaagatataatgcatgaaataaaagcctccaataaaattcagtatacagttaatttatttcataaaaggtgagagatataaattatcaaaggttaaaacaaaaagtaggaaccagagcagggtttttcagtagcaactctattgacattttggattagataattttttggtgtgggagactgtcccacgcattgtaaaatggttagcagtatcacttgtctgcctgctagatgctagtaataccccccacacctccctctcccacattgggaaaatcaaaaatgtctcgagacattgccaaatatccctggagtacaaaatcagtctaattgagaggcactagactggagtataaagagatgaccatgccaaaaagtaaaaataataataatagagccttgaaacattacttacagaatgtcaaaaacgtaaggacctgctctctattcctgtttcttaacctgagcaatgggaataatgatgccttccctcataggtctcttgtagaaatgaaagcaattaatgcaacacttggcacatagtaagcatccaatgaataataagtgatcagtgttactattgctaatattaagccactattataagtcctttctgttaatcagcagaaacaaaaagaagtataaaataatggtacattaaatgaacttaaacacttgtatgtcattttgtgctaaagttatgaagctgaaaagattgaattgacattttccccattgatagaaatcatctcaaaaatgctccatcttccttgtgaaagccaaaggccagcagtttccacatacccagcatctgataagtagttaatgatccagaaataaactgttaggtgcttcagggaatttctgtgtatagagaagttccatgtaaatatttctccgagaggtggatggagaatgataattcacttttaccctctgaatttgatttataagcttcacctatctggcaggagataagaaccaaagttaactgaggagaaaaaaaataaatgatttcaagtgaccatgatcttcagctggaaccagttgaaactgcaaagcaactgggctgaagaagttcagccaaaattatttgtttataaaaactagagagtgttagatatttctatcacattggcttatttgaaatttctgctggctcaaatgaaattgtattcttctatttcctactgcggggttccttccctaaccacaattgcttttggattggagacttgtaactttgagaacaagaagagcctcagcttagctagctggaagaaccagaggagagttttaatatctcctgaagaaagaaaagcactaacacggttattatagttcaggacaagtggagtcaaagttgacagtttctgacttgaacagttttgttgctggtaataaaagcagaagtcacgtgctgaacgtgaaggtgagcagaggagaacttgcgatggcaaagttaaaaacaagaggagatgatggtcttggtgtggcacaggatgttaaaaaaattctcctgtccttaaggagttactgctatttgagtaatgtgccacttccctacatagccttctatgcagaaatgctatatttccacttcacaacccagaacgtgcattttattttacatttagaggaggaacaaacaaccagaaggcaaaaactggtgcattattttttgcaattctcttggaaagagttcgtttttaacttctgctcagacagcacacaactactgggaatatattttaatttcaaatctgatgtgtgacatctggtaactcatttattgctaatgaagttttcacaggaagcagcagtcaccagtagctcatcttatttttcagttggcaaagtgttgtttaccttttattggcctggcatcggtgtctcttatcacaggatatttaattagaaaacgcaagtagcctaacatagaaaagaaatggagtggtagataatagtagatagaatggtctaaatatttttattacagtgatgtaatatcactgtaatttatgtttaaaaattatgtaatactcaaaaggaattctcagagctggcgaaacagtctggtccaagcagcctctcagcagtgcctttcagcctcccctctctgagtctttccaccccttgctggtactttagtttcttccacttctagcaccacgtgtagtttcccaatttctcttacccaaatttgctcgcagggaaaaaaataaattaaattagccatttacaccacagtgtgaacttaataacaccaacaaaagttccaaagctctagggtctcatagcacctccagatccatgatctcattcggtgtttccaacaatgttttgcaccaaactggacacatgcttgctacttcatcatcctcatcgtgaacattattattattatcatcattttccagatgaagaaaatgaatcacaagtcaactgacagtccaaaggctccacagctcagaggaggtaaatcatgtgcttaattcagaacttttggctcccatcactatgctcttcccactgtcttaactctggttgtcacctgagccattgtgtttcttctcaggtagatcttagttcttcctgagaaggtatgaaggtgggtattccaccctacctgaattataggaatttcagatatctgtgagcagctgcaaaggggattttactagatgacatcctgctgggcacactttacgccagtcctgaatgtgtaatagaaatctgcagtttaatgagtaagtttctcatattcagtttttgatgcttcataaatgttaaatgaaaacattttagctgagggtacttttgttgtttgttggattggttttgcctgttcatcaggattatcagcatttaagccagagttgcaaattaagttgcctacagggcagtgcttttcaaatattagtgtgtatcagaattacctggagggctcattaaaaacagcttgccgaaccccacccacagagtttctgattcagtaggtctgtggtggggccagagatttacatctctaacaaatttctgggtgatgctgatgctgttgtttcagggaccacactttcagaaccattgctagaggggccaactaggggacgtctgtgagtaaaagcacctacactgtgcttccagtacagcagccagccccagtgtgatgagcacttgaaatgtcgctagtgtaactgaggtgtcctggaagcatacattataccctgggttttgaagacatggtacaaaaaatgtaaaatatcttaataattttatatggattacatgttgaaatgacaatagtttggatatattggattaaatattttatcaaaattaattttacctgttcctttttacatgtcaaatgtttttaatagaaaaattacaattatatatgtgtctcactttctatttcttttggacagcactgaactaaagaaccagaaaatagaggggtgtattagtgaactacagaaaattcaagtcccaaaagctgtaaatactctgaggaccaaagaaaatacatacgttgttcagatttgccctgaggggtcagtttgtacccaaacatttgctgccacaagtagtaaatgtagaagcaatgcaatatctactattttacttttctttcagggttaatcaagtgccttgttataattcttcaaactaaaaacattattataataatgaaaaatatttctgctgaacttccgaataaaaaaatttagtaatattttgaaagtctgagctttatttaattcattttacttacccttgtattatagaacaattatatttttaaaaatgcttttatgtcttccaaagaactttttatttttagcagtccatgaaatagaggtgagaacaggtgttggtattctcattctaaatatcttgtaatatttaaaggaaaccaaagtgaaagattaaattgccatgtaagattgtgttgccggttactggcagagcagactctttgccaggacagcagtccagtgctttctcttccaggctgttctgctcttcctcaatttttacagcatttttatgttaatcaatcaataaataaaaagtaaagaactataatgcatacaaaactgtgatggaagaaaaggaaactatgtgataaaatcaaataaatatgacccttatagctttagttttcttagaacagaggccctttaacttcagaatgttgaaaccttctcttgaagttctcttataatactctgccctcacctctgtgtttttatctgggcaattagaccacattaactaattgctaaactttaaaaagttgtattttcttacaaagaatctgagaatagggttgattttctatgttattttaacagtatcacattgcgcccccctcttcacaggaccatgtaatcttgactctctaacttcatggcaagcttttaattttgattttcaaccatgttccaaactgtactctttgacttggtagtgtcaataaataacgtaagggatgtctgacaggcttacagcctttggccataaatggaatgaaacaaagtagtccagatagggctcaaactcataacattgacctcgttagtctagaaccacaaccagctatccaaatgtgcctgggaaatatttctttgagtaatagttaattttttaaaagaaagaaaaaaacctgtgactatgataatcttatgttgagtttctttattcatcttgagtaaacagtaaatttttttcactttgttgtttcaatacaaagagttcttgtgtttaatatagaatattattaaattagtgtgggattaaaaatatttagatagctgatttaacaatatgtgatagcattaatcaactgccttgttataattcttgaaattgttattactctacttgtcaagcaattttgcccttctcgtcaaatgatgcatacctgttcaatggaaggattataaaagttcatgcttcggaaaattttttttttttttttttttttttttttgagacggagtctcgctctgtcgcccaggctggagtgcagtggcgggatcttggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccggaaaatttttttaagagtataaccaactccccgaggatacaggggtccagggaagctaaatgactgcttcaaggtcacccagccagtgagtgggaaagctaaaattagaacctcagtccgctcccacattttccaccaatttgcaggctatcgttaaagaatatttcttctgcaatcagaacattgagcaatttggaaaaacgtgtacagtatatcgaatattctagcttcatttaaaatttatggttatgtggcttgtataatgttaaaagctttaatctaaaatgaattgccatgtggccaataaccccaacataatactcataatgcatataaattctctaatattatcataatttcttaagggtacaaattaattagtacctcttttcctgcccaataactttcctcacaccccttaaaatggaatttgaaatgagataaacagttgctgctgctgaattaaagtttcaaagaaataaaagtgaggtggcttcatatacaaaatctgtagtttttttcacaaattggatgaagcaattgttattgactaagcccatattggtgctgcccttttctctgttgaaaagaaaagcttgtgagtagtctccaagagccatattattaaaaatgatgtttcctccccatgatggctgagatactaatccattgaaatgtggcgataattcttgtgagaaaattctatgagtctataagtttgaagaatttagaagtgtaagaggacaggggttcatttacttacaggccttcttccaagttaggttttattttccttttctcctagtctctggagtctcctctctccagacaccctggaaagccattcatggcctttcatatttaacataagagtatttaatactaacactaacatgtcgaaggaagatgtttaaagcatgtgaattagacttgatcatatatgtttcattggcacctgtttctctactttttggaataaaataaaaacgacaaaaacagctaagaattttggatagtgatgtgggtgggagggattggggcattcatcacaactgagttgtttaatttatagtaagtgggaacttttagagttgagagaagtttaattgtagtttagagtttcattattagacagtagtcttaaacaattcccaagaagctaaaatgtgggattaacattttactttcattgtaattcatatcctaaatataaatgttaatataaattataaagtttctgaatttcctttcataaaactgggttctttgggttcttagttattttggatgaaacaaggggagggctagttggaaatgatggaacatttaaccactgtcaccacagttagtcacaattggtacatgcagaattaataaagcagcttgccttgtttttatttcttgtgaggtcagatgacagtggatgatattgacttgggaagatggccagaagccactatttaccatgtacatatatcagagagccatttattaagtttgaggagattggatcttaagtacttaattagaatgacattaataattttaataaaatgttttgcattgagagaactattcactcagaaatagcaggggtgaacaaaatcatctccaaagaaatcatttaacatgaagttagtctaggattaccaaccaagagcatggcattctcccatgtatctgacttaaaagcaatacttgtctcttgccccatggtgccaggtggtctgccatgcttccctcttcgtggctgccaggattcccggtatagaggcaaatacaacctgtaaaggctcaaacgcttcatcaaaagccatgactataatccaaagctattaggtttaagcaacttatttggaaattatcaccttcaaataacatgtagggcaacctcagtagagatgaaatggacgaagcaggcatggaaactgcccttcctgccttaaatacagaatgccagatcacagctctgaataaaagttaagaccacattgggccagatcaggactaacactagatacacagctgagataaagttccagtgactttggcagtgtgaaagtcaggaccagtaggcacatatactgaaggcaatttaagctgtgtttcctgattaaagccagggactgaaaaatcactacctattcatgatgaaagactagaaaacttctgaagaccagacagagtttcagagtggtatagttactaatctactaaatactgcaaatatatagtatctgcaaatatatatataaggttgaaaactaagctcagaaatgagcattaaaaacttttccagatcaagggagtgctgtacccccaagctgaggtttcataggctaccatcatccaggcactcagtcttcccaagcaagttaattcccaccaaaaatgaacacagtcaaagattacaaaacctaagcagaagtccattatcaagaaacagtgtccacaagtgcaataaatataatttatacctgaggaactataaatagtaaagcaattgggtaggggctcttaacagacagatattcaaaatgttaaggaaaataaaagaagaagtagacttcgtaaaataggaacagagggctaagaaataagaacaagtagatctgaaaaagaaacgagtaaaaagcctagaaatattagtgccaatttctatgggtcaatgatttcacaagtgaatagctaacagttatttcctgtggccttacttggcagagagaggtgggggaagcaacataggagcagaaacagttcctttctaagtctgacttataaaataggaacaataaagacaacagtttattgaacaggatggtttattgagctgtccagcactataagcaaatggcttacaaacattttcctactctttttgatgcttgagagagatactttgatagaagattattccaaaatataattacttggtcatttagttctctctttattatcataggaaactatggggaatttttttttctttagattgcaaactagttttaaaaagagcttgtaatgaacaatttaattagattggttttggcttgcctaaaagcttaagaaggtattaatattctaatcaaaagtcttgggaaagcattcttagaataaaaaaaggaaagaaaatcttcattcttatgctttaagaaccaggaaagctgtcaaaggatataaggtaactcttacaaaagcaattgtaaaataaacgtggtttggccacaatgagccaacacctatgtttgccacagacttagattcccacctcactcatggcaaatttattcagctgcttaagattattttttactcatacttcgaaagaacaacagcctggaatttttagacttttaatggcaatggaaggaacttacctatgataaacatttttctttactctcacgctttcttaacccatggctgttctgagtcaatgtttgccttgcattcaaaaaataatagtaaagattcaagtaaaacatattcattaagcactatttgaaagatataccaagtgctttaacattatctcactttattcctacaaagatcatgtgcaataaatatcactgttcatgtttcctacagatgaaaaaaaactgagggtcatgttcagagaaattggatgacttacccagagccacacagatttgtacgtggcaaaggaggattccatttcaagtctttcaaccccaaattcatcttcctttctctaaggggaaatggtgctatggaattcatgtaagccacagagcttggataaaaggaatagtaagaccaaaaataggaaaagtaggaagaggtggatcctcctatgtttttaatcagggttctatctacctgtaactcttctgggaaaagaagcaggatgtgactgaaacatagctgctttctagatctcacaaatctggcttttctagtcaatcacatctctctctccttcggcttctcaccaaaccagcatccgttcagcttcaaagaaaaaagagccctactgtttcccactcatttatcatcaatctaaagtaactgccaatcacaaaagtcccatctttatttctttccttagaaacaaatttctctagggaagcttatcagtagcagaagtgcagactgggaaatggcctatgtcaccctcccatctagaaatgcccagtgcacatccagatcccacacccccaagagcgttgtgcaatatctgttaatttatgagagctgtttcccatagatgatgctgcaggcattagtaaggagggcaaagttcaagtgatgacaccatctctactccacctggctggtttccaggtgccatctcctgatccctctccccacccccactgccctctcaccatccttcccccaaaccccacactccccaccaatctgggtcagtgataaacacagagtattccacatgcctctgatatgatgtaacattcgacacactaaagataatactgcctttaaggctcctgtccccctggctagacttaaactgtgtagaggaggagaactgtgactttattccccttgcatcctggacacccacacatggtaggtgttcagtgaatatgtgatgagttggtgaatacccactgaatgtgctatttgcattgctacttccttgtgcttccttccactgtttctatcgcctaaaattcttctccctttttcctccaccctcgagtaggaaaaaatttgtttctttattgggcagggagttctggtcattatacatttatgtaaaatgttcttctaattggcatattccatgctatgtccagattctttcaagcgaattctcattaaggtaataatacctcaccgaagtttccagggatgatcccctagctgttcaaagctaccttttatatattaaataccagtcaatatgaatcaatggtaactgaaaaaaaggctgatagcttgtgaaggagttggagtacaaaactatgcctataaattgatcctcacaaaggcagactttttcccacagaaattgtattatgaatgctagttatagtttgagactagttaataaaattctactcactccaaacataggattaatggaacccacatgagttgtgtgctgtcaaagtcgagtcaagaggagagagaaggagaagaaaatttcctccctgttctcatagctcagggcacccaagggattctagagcgtaaagtgtactcccttctattttttactgcccttattcccaagctgaaccaaatatttacctctgccctcattttcagttatggagttcactcaggcccttttcaaccttcgaggttccttaacctttacattattaattctttttctaagcaaaatccagctgatctctactagatggttaaaaggatagtaaataggtaaattaatccacattaagccacaaatgactgctagccctaaccctttaatgactaattaatttttaataaagaatatgtgtctatataaatgaatttatacttctaagttggcataagttcagaaaaaatagtaagatgaactggaaaatctacaaggtatagggaaatcctctgggtgaggaagaactagtcatacctccctaaaagcctagccctagtttctgttacattatttcttcttttcatcttctgttttctaaaccacaagtttctaaaagcaccaaggaattttctacctgtttatttcgttttgtttttgtttctgtttttttgtccaaggtgaggcccaagttgacactgagtattctctgtgaaactctgcaaggagcaacatgtgatttcacagaaattagtctcgatacactatattcatggctgtaagttctatgctgctcacccattcatttgtccattcagtcactcattcatgagacatttatcatctgcctcctggaacataccagggcctacaccagaaaacaaggaaacaagtaaacactagtaaactttaaacaggctctccccacaagcaactgacagaccagtggagaagacagatatgtcaacagatgattacaataaagtttcaaggccgggtgcggtggctcacgcctgtaattccaacattttgggaggccaaggcgggtggatcacccgaagtcaggagttcaagagcagcctggccaacatggcaaaaccccgtctctactaaaaataaaaaaattagctgggcatgatggtacacactggtagtcccagctactagggaagctgaggcatgagaatcacttgaacctgggaggtagagatcgcagtgagccaagatcgcaccactgcactccagcctgggcaatacagtgacactctgtctcagaaaaaaaaaaaaaaagtgtcaaacctacatccaaaatgtcaaagtgctcaaaaaagttgggaaggcttcaccaaagatgtgacatttagggtagataacacctgtttgtggatactaatgtcctggtgagtcaaagaagaaaaggatgtacattatataagctggatgcaaaaaggaacaataatgaggacatgcaaccaaaaacttacatagggagaacaactttacttactcagggaaggcaaagagaccacttaagaactccttcacatgtgttatgtcttaaaagctgactactggagttgtatcccttgcacagcatccctttgcaccaaagtgaacactactctaagaacatgtgttcagctctcctgaatgccaagcacaaccatgcttggcatggcagtggtgtcttatttctgctcctctttttccccagggcatgccattgcaagagaatgctcagccatgttcatctggggacctgctcctggtagagcaataggatctgtgtgcccagcaccactgcccacctagctgtcctggcctgtgcccaatgctgaccttcacctcagagtgtggctgtaccacattcggtgatgtcactctcactgaaccttcagcctccttcctgggacttcctgatggactgttatccagggcagaatgtgttgattttctaaatcacataaatgaatagcttgactgttgattatgtagaaaatcagagcaaatatttgcatggctttgtgcagcccattcttgagcatctgattctccccagaattctaaaaaacctgctgctttctcaagccctcagtaaagacatgctttcttgataatcctagccaaacctattcatttgacatctttgttacacaaatggttaaccacagagttaacttcagaaatggctggcaggtatgaaggttagaagattcatgcacttttgctagactgaattggaagttaaagagtaagtagttactgactgcagaggcctggaaaaccatggaaaaaatcctattcctcaaagtcgagccctacctcctacgcctcttaaatcaattgccacagtgaccaatttgtcagtcacctaaaggcagctatcctgaccacttaagggagaatacttataatctttatacctaagtaaagattgtgagaggaaagaaatggtttaaagaatatgaatgtgtcacacttctgaggttaatgataaatgaattggtcctgcttacctcaggaaaaactttcaagtctttctgaaaaactaatttaattcagtagtattttctaagatttaggttatgtttttaatcaatttggaaaccaagatttacttatagaaaaaaaggaaaaggacctagataggtttattcacatagaatcccaatttcacttctctggatgataccattttctacaaaagcaattatgttctaaaatttaagtgtgctttcttaggctttatcagttcacagtgtttccttaagaaatatgatccagtattttttcctaagactaaagttgagttactacgtttatgactgagaaatgaatgtttgttagtttgtttgtttacaataagaattttttctttaccattttatttttattttccccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaaccctcccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttccactgccaaaacaatgcccgtaagatggcttatttgtataatggtgttactaaagtcacatataaaagttaaactacttgtaaaggtgctgcactggtcccaagtagtagtgtcttcctagtatattagtttgatttaatatctgagaagtgtatatagtttgtggtaaaaagattatatatcataaagtatgccttcctgtttaaaaaaagtatatattctacacatatatgtatatgtatatctatatctctaaactgctgttaattgattaaaatctggcaaagttatatttactttaaaataaaataattttattgcaatgtatttatcttcattacttaaaatagatgctaatttattttaaaataagactaccttgaatgagtatgaatatatttttatttaaattttgatacaactgatagtttaatactattggttatagattttttatcctgacattgaaaagttaaagaaaaaacattttgttctactgcatgtcatggaataaacacatcgttttgaatttttcagtttttcacataacaaagaaaaaaattaactcttgctataatgctagaataatacattattttacaagtaatttaataacagaatttttctaattgtatacattatcattgtaggaaagttagaagatatagaataacataaaaataaaagtcatgtttagcttccccggtcaaaaatcattattttaacatttgggaactttattttctacttttttcattcattatacacacatatatgtgtcaatcctgatactgaagtcatgatgtgtatagtactttgtatacagatctttcacttaatgtcatagcatagtagtttcctacccaattaaatatttttctaaaacattttaatatttgtataatactacaaaatatggacatacgctgatatagttaactagtcaccaaattggaaaattgagctttttctgatttttttagtatcataaattacactgagatgagcattcaagtatgtgaatctgagaaatttcccatactcctagaagtggtgcaactgaaatacacgtatgaacattttttaatagtctaactacctgttatcaaatatttcccagaaaacataacaatttacaataccaccaactaggtatgaatatatatcaccataacctcagaatggggtatttactaaattttttttttttcagacagggtctcactctgtcccccaggctggagtgcagtggtgtgatctcggctcactgcaacctcccactgctagattcaggcaatcctcccacctcagcctcctgaatagctgggactacaggcctgctccaccactcttggctaatattttttacttttttacagagatggaggtctcactatactccctaagctggtctcaaaactcctggcctcaagtgttcttcccaccttggcctcctaaaatgctggaattacaggcatgagccaccacacccagcctaaatttaagcagaaaagaaagatttaccgtaaggatccagctgccacatgcaagggccaggatgcaactgtgcctgaaaattgtacttttaacatttctgctcccatcggacagttgcttcattcttctatttaaaggatttcagtgcttctgaagttcatacagggcagaccgaagtgctcattctggtcaaataaactgtggccaaagggttggagttatgcgtaaaataattgatggttgctgtgggcaagggggtgtcatctcagagagaggccttggccactgggcagaatttccacaaagcagactatattaccttcacattcccaaatataaagtttttgtgaacaaatatggttccatatgccttatattatttatattatttttatattatttttaatttcattaatgtaatgccagccactcaccccaaaggtcttctactattttcacaaaggatcacctcaaaaaaataaattttaccttatcccaagtgatagcataaatatcctatataaaatccctccaggcctccaggtcagctttataactgttttttttttttttcagtagttgaggattttttgtgtgtgtttgtttttgttgttgttttgttctgttctgttctgttctgttttgttttgttttgttttttgagacagagtctcgttctgttgcccagtctggagtgcagtagtgtgatctcagtccactgcaacctccgcctcccaggttcaagcgattttcctgcctcagcctcccaagtaactgggattacaggcacgcatcaccacacctggctaatttttgtatttttagtag

SEQ ID NO: 12986 - DNA, 49164 bp, Human; identical to SEQ ID NO: 12985

SEQ ID NO: 12987 - DNA, 9231 bp, Human
tactaaaagcaggtgcttggaaacctgagggcagtggtgttcatgcgtttcccggcactttgactttcagcctcctgcaagcctctccttctttgccttcctgaccgttagatacgattaatttggggtttgttttttctgcttcctctttcccctcccaccctatgtttcagttctaaagttagaaggtcctctcatccttttaagaagaacagagacagaaaatggttagtcaccatctaggacagactacaattccagatcattgcaggacgtgcccactcaaatggatgattattgagagctggccacctgaagtgttttacacaggcagtgatctaagggttgaagctatctggcctttttgcttgcttgttatgtatttatggcttttttccttttcaaaataattttactaaatatttaattcaccaactatatatatttatggggtacaatgtgttataaatgtatacactgtggaatgatggaatcaagacagttaacatgtccatcactccgcatactaacatctgtgaaaacatttaaaatctatgcttggctgggcgtggtggctcatgcctgtaaccccagcaactttgagaggctgagatgggcggatcaccagaggtcaggagttcgagaccggcctggccaacatggtgaaaccccatctctattaaaaatacaaaaattagctgtgagtggtggcgggtgcctgtaatcccagctacacaggaggctaaagcaggagagtctcctgaacccaggaggcggaggttgcagtgagctgagatcacaccacagcactctagcctgggcgacagagtgagactgcatctcagaaaagaaaaaatatatatatatattttggagctacatcgtgctagcgctgcagagaatgagttttgttttgcgacacagtttttagatgtctaccgggctctggtggagatggaatgtttggcctcaagtgggcaggtcccatgggacatgagtagccgaccatgacctggctgcgtactggcccaccaggcattcgactggcgtgcccagccgctctccgtcatcgcagagaagtgctctatgtgagatttggttaaaggagtccctgaaggcctgtgggaggcagaatagtgacctcccagagatgtccacctcctgaggcccagaccctgtgagttggggaagcttatgtggcaaaagggactttgcagatgtgattaagtcaaggatcttgggttggggagattacccaggtgggcctgatgtaatcacaaggggctgagtaagtgaaagaggaaggcaggagggtcagagtgagagaaggaggtgagtgcatggaagcagggggcagataacgggactggtggctttgaggttggagggaatggagaggcaggaatgcgggagcctgcagaggcttgaacaggcgagggaacagattctccttggagcctccaggaggacacggctctgatagcagcttcattttagcccagggagacccattttggacttgtgacctccgggacggtaagtcaataaacctacattatgtgaagccactaagcttgtggtgatttgttatggcagcaaaaggaagctttatggttcatctgtaccctgaaaatgcaggtttttggtttttttttttttttcacttgttcaatgatgtacccccagtgtcaggcgctttgcaaacacacgatacatacgggttgatgtttggtcaagagaggaattaagatcaggcagacagcaggctgggatcagagagaccccatttctgtctgaaatgtctgcagagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcggtgagatttaaagagggggaggggagacccgagtcttggaggaaatttgcctcacagccaggccctggttctttaggagactcaaaaatctcagggtagccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggggtggttgcaggcgcctgtggtcccagccactcgggaggctgaggcaggagaatggcgtgaacccgggaggcggagcttgcagtgagccaagatcgcaccaccgcactccagcctgggtgacagcgagactccgtctcaaaaaaaaaaaaaaaaaaaaaaaaaaaaaaaatctcagggtaaagagaggacctgctcaggcttccggggcaaatccctcacagggaactctcttccagggctgagtctgggccccaggacccacatgcaggcaggtgagtctgtccccagctgtcccaggtccctcctcctcactgggacaaggggccacccatgggcagctgggggaggagacagcagttctgggtgactgatgaggatgacgggggggtcctggggctgagagctgggatctgagggctgaggaaggtcttgggatccagcctctgattttcttccagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggtgagaggacactcaggggtcccagccccaggctctgccctcaggaagggggtcagctctcaggggcatctccctctcacagcccagccctggggatgatgtgggaggtgggagccccatttaacacggtgcctccttctctcctaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggtgaggctcctgaccctgtcctctctgagctcagtggctccgttcatgccctgctgccaggagagctctgggcagggatggagggagaggggctcagccagtgggggactcagccctcagaggggaggaggacaacaggggccctcccaggcatgcccatgctcttctccctcacctagggtccagaaggtgccaggtggacagagaaatggtccttgggaagctgcagggcagatatagggagaggttcaatttgatgtggagacccaagggcaaccccagactctcaccctcctcttgtccttctacccaggatccttggagggtcccaggccctcacccacaaggtccgtctcaacagctggtgagtctcagaggcctctgtccagagagtttccaaagcccgaggcctgtctcaagacatgctcagtggatctaagtcctcgttccaattctcagctgggcttgcttccacgggtgtgggagtcgggcagcgacttgggaggcaccacaggctcccaaggccctgaggctgggctggtgaggggtgagggggtcaaggctgaaggagatgttgcggggagaagccgagctgatgcggggagcagggcagccccagccctcacatccctgttctaacccagcaggccctgaggaccagcccctcatgcctacagggtcagtcccccacagtggtgagtgaggggctctgagtgggaggtgggcagggtctaggggagccaagggtgggttctgtcctaggttcaggctcctctggaggtggtgatgtggacaggcccctcccctgcatgggcctcagtttctccaagtgtaaaggagagaggcctgtgggtgggaaagttcctttcagctctgactcccagctgtgccctcctgggagaggaggcctcccagggaacctcccagacccgattccgcaggggcctgtccggtcccacctgcagcagagacggtgacctggggcaggggaggggagcagggcggtggttcaagacagtcaggctctttccctgcaactctggggcttggctctggtgcaggaacaagggctgcagctcagactcccgggtttccttcccagctctgccgcttcctggctggaggggtctggggcaggcgattcccctctctgagcctcagtttgtgcatctgtgaaatgggtggagagagggtggcaatctcaggttgcacaactgctgtgagggttggaggtaatgaaagaaagacccagcacacacagtaggtgcacacacagtaggtgtgcacatcaatgacatcatccccattcctgatgtcatcacgcccaaggtctgagaaggcactgggaggtactgatcggggtcttggtggtctccatcctgcttctctccctcctcctcttcctcctcctccaacactggcgtcagggaaaacacaggacattgggtaagtaggaaattgggggacccgtgggctgatggagggtgggctcagggcaccagccaaagggactccagataggagaggtcatcttagaaactctgctccagaaattcccagtgagaaaatctagaaagaagaaaatgaatgagggagtaatggaagtgctttattctttcggtttttctaaacttagaaagtatttaaaacatccttgcaagtgtattttcaggtttcctttcctcttgacttgcatgtgcaaggcaggtggttctaacgttcccagagctgagactctgtccatcttcccccagcccagagacaggctgatttccaacgtcctccaggggctgccgagccagagcccaaggacgggggcctacagaggaggtaattctgcccaaagacctcagactcccacccatcccaacagccacctcactgtccccttacactcccgtatcctcccccaggtccagcccagctgctgacgtccagggagaaaacttctgtgagtgagaggcagagaaggtgcacctggggtggagctgggggtcccaaaatttcaatagcaatgggggcaggagcacaggctaggattggtcagggactcagggagaagtggtctgaacccacattgtgggacctcggggacatcacagcccctccctgcgttgcagtggcactaatgggaacagggcagggaccagcaggaatgagaggtcccagggaaccttcccaggagatgaaccccttgctctaccccagcaggtgctgccgtgaagaacacacagcctgaggacggggtggaaatggacactcgggtgagaacccgcccctgtccccggcaccaaaggcctcctggtgccagatctaatcctgcaggacttctctgtcctccttcccccggctctcagcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcaggaggatgacgaataaatgaaccactccagtcccctgggctccccttcattcattcatctagtgagtgttcccagggagctcactgtggatggggctccccatgggagctgcagacacagcagggagcaaagccgcccccgcctcctgagctcacctcgtggtgggagacaaaatgcaaataaatgcatcgtgtccaggagtgcaacgtgctgtaaggaacataaaccagggaaagggcagagagtgtggggcagtggggccagtctgaatggaaggggagggctgtctgctcagctgtcatctgagaagcctggacagagtggggcacacgatcctctaatggacgagcccctgcaggcagaggaaacagccgtgcaaaggccccgaggcagcagcgagctcttgcaggaaggcccgtgaggctgcagccaaatgggcaaggtcagagtgaggagcagagaccagaaccacagggagggagcggccagaccctccacggccttagggcgtccctgagattccatcaggaaagggatgtaatcggatcaccctgggaacagtggggaaaattgactccagggagtcaggaggattcaaggacaccccccaccactgtctctctccagcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggtgagtcctttcctctccaggcccccaggcctcccccacccccaccacgttccttccctctcactctcccccgctgcaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaaaacattaatgatacatgaatcttggccacaatgagaaaaataaaaatgaaaaaagagcaggcatccatttccatacaggaacaaaataggaggcagcactacagaccctacacacagctttacagaggtgaaagaaaactgtcagcaattctatgctgacataacagaaaatgtagatgagatagatgaaatacgaaaaattacagtttacttaatgaacataaggataaatagaaaaactgaatcatcatacataaacatatataaaatgcattgatcctgtaatcaaaaatgttcccacaaagtaaatgccacttcagcaaggtttgttggtggttttttcaaactcttatgcactcatgaaacacacagacacacacacacacaaacttgcataaattttccctgagaatattttgtatatatttacacaaatacatttgatcagactaggaacaagttgataccaaaacctgaaaaggaaactacagaatgggaaagtcatagaagatctctcacagaaatataaatcccttaacaaatattaacaagtaagattcatgtctctataaaatagacagtatatcatgaccacactggttttttgttatcctttgattttgtttatgaaaagcaaggatagcttaattttcaaaaactcaatcaatgtaattcagtattttaacaaaaggaatgaaaaattatcatctcaatagacaaagcttttgtctgagcaccttttcatatagctgctgaccatttgtatgtcttcttttgagaaatgcctgttcagctactttgcccatgtttcaagtagtttttggtttcttgctgttgctttgttttagttccttacatatttttgcatattaaccctttatcaggtatacagcttgcaactattttctcccatttctgagttgtctcttcattctgtttgcagaagctgtttagaagccacaccttttgtctatttttgcttttgttgcttgtgttttcagggccatatccaaaaaaaccttgcccggaccaacgtcttgaagcttttctcccacccatttttgtatatgggataagggttcaatttcattcttcttcatatgaatatccccaggatgtgtcctatgcccagctgcacagcttaccctcaaacagaaaataatgaagccttcttcctcccaggaaaggggacgttcagctgagccgagtgtgtatactgctctggccatccactagcccagggaggacccagacctccacactccatggagactcagttctcctaggaccatttattcaaaaggactgccctctcttgttcttggaaactttgttgaggatcaattcaccataaatatgtgtgtttccttctttgctttcatccctgttgcactgatcactgtacctgtttctattccagttccatgatgtcttcctggctgtagctttgtaggatatttggggattccatagtgtgatatccccttcttccctttgctcaagattgttttggctatttggggtccttttgtagtcccattcaaattttaggattgtttttctatttctgtggaaaacgaccttggaattttgttaggaattgcattgagtctgcaggtatgaacttttttttaaagttccagggcacatgtacaggacctgcagctttgttacataggtaggcttgtgccatggtggtttgctgcacctatcaacccattacctagttattaagcccagcatgcattagctctttttcctgatgctctccctcccttcatcatccgccctcccactacaagccccagtgtgtgttgttcccctccctgtgtccat

SEQ ID NO: 12988 - DNA, 16013 bp, Human
cttgttcctcagtatggggctgtttctgtctttacagtaagtgactactccagggttccctgccctgcacacgtagagtgggagcggcccgtggatcccagggaactgtgcttttcattgtaggccccctccctggaggggaagagggcaatctccgctggtatctcagaagtcttcttctgaggcataagcctctcttcccagggctcccctggtctcgctgtcaggccctaaggtatgtcttcccttggactaaagctccttggaactcccttttgacctcagtcttctctgggttccaggtaacttcctttaaaataaagacgctcctctcttgaagttttgggttcctgccctgatggtctatgtctccctgactctaaattaccaatccacttgctatgggattcctccatgagtgcagatcggctccctcacagctgcggtacctttgcaccctcttatcttagtaagatttctgtcttctcccaggtctctcttgggtactgccttctgcccccaaatctctaagccttcttggtattagcttctttgggttaggagtgttatttccttttggtttaaggatcctgctctggaataaatgtcttggtggtttgagtcccttctacttggcattcagccctgtctgcatgagcgggttcagctcttcacagctttcggcatctctgctcgccgtcgttttcccccacccccaatctttcttctcctacctacagcttacacacacacacacacacacacacacacacacacacacgcccttctctgtgagctgccagtttcatttgtctcctgacttgtctgagggatgacctctcctagccacctctgcccagcccctctgagtaggaagtgtgatctccagggctaatgcctccatcccagtcatcagctgtgtgcagcatgactgtcctgctctgaaaaacctttttgagtgtattctggggagaaggtactccatgctctaggaattttccacttcctgagtcagaggcacacaaaaaagtatgtaacttttcttgtttcaacaaacttatggggtcccctgttggccagacactatgctgggcagtcaagcgagcatcaggagaactggggctggtctcttgtcagatagcaaatgcttcttctctttaccagtcccacctacctcactatgctgactaggtccatgtctctgggtttttaccagccagggaatacgtgttaattcctctccaatctctcctagcagcgtccgtctccaagagagtatgaagagagtgcgtctgtagggcagggaagatggcggacaagcgcaaactccaaggtactagactgacttcctgctgcacctgtagccacatgctccctcttctgaggactgctctttagatacctgccacctgggcaggattctcacagccttgttcctccctggccaggtgagattgatcgctgcctcaagaaggtgtccgagggcgtggagcagtttgaagatatttggcagaaggtacaggggctgagaccctaataatctgggtcttcagagaggagggcacaggaaggcggctcaggacctctgggtgttgaccagcgggaggggctacatatgcagatgctgaggacctaagagaatcagctctaagatggattgggggtaggggttggggggggggtcctcgagtccctagcataaggaagaatcactggagtgggtactgggacatcccctcccacactgacttctcaattctctccatccctcagctccacaatgcagccaacgcgaaccagaaagaaaagtatgaggctgacctaaagaaggagattaagaagctacaagtgagggggctgggggcctggacgcctttgtcctgagggtagagggaactgggagagtggactgctgggtcccagggagaaggagctgtgggccccagttcctgggtcctgaggtctgactttcttgcttttcccatctgcagcggctgagggaccaaatcaagacatgggtagcgtccaacgagatcaaggacaagaggcagcttatagacaaccgcaagctcattgagacggtaggagcccagagcctgagtcccagagaggtgggaaggtcaccagattcttgagatcccaaggggcggaggcagagcggccagaccccagaggtcctcaagagaagtaaggtttctgcacctaagggaagtgaagaggcagcggactcagagctcagaaagtagggtcacgaggctcaggtcggagtgtctgctggcccttagtcagctcctttcccacctttgagagcccccctgccaactgcactctctacagcaaatggaacggttcaaagttgtggaacgagagaccaaaaccaaagcttacagcaaagagggcctgggcctggcccagaaggtagatcctgcccagaaggagaaggaagaggttggccagtggctcacggtgagttggggtagagaagaggaggtgaactctgaggatcctgagccctgggtgtaggcggaaccctagctgatgggcttcctcttcctctccctcccctagaataccatcgacacgctcaacatgcaggtggaccagtttgagagtgaagtggagtcactgtcagtgcagacacgcaagaagaagggcgacaaggatgtgagtgagggagacccgacacctttgggatggggatgggcatgggaatgggctggccagcaggaggccagtcatttatgctcctgggagttggggcctggattcctcaggcggacagggccaacagccgggattagggatttgagagacaggattgggagggcttagcagctgcacgcgtggggcaggaaggaggtcagacagaatctcagggtcccctgggtgtctgggtagaccgtggggcctttgtgaagaggagcgacttgggggaaggtgagtgcaggttgagcttgggccacagagtaaaagtgagacctgaaggacacccatggcaagaggcctcctggcacccagagggccctggtcctagggagagcacagtgggtagagacaaggcagaacatggagaaggcagagaaccaggcctgaaggaagacaggagtctgggacaaagctggatgttggggtcccaggttctaaaatccgggattgtggggtatgagttcaaagggatacaaactgtacagacttgctgaaaccagaaagacagggaggggagagccgggtcctcagggaagctgtgggtgggagagggtcaggaagtggaagatgacagggttgggtgtcagactctgaggggtttgggaaccaggggctttcggggagatgatgggtccttgaacagagcagagatttggaaccaaggctaagatgttaaatcctaaaggggccttgaggggagggcaggagcgaggcttaggaatctgggctctctcagggataaatgggtagggttgggggcctagtgatgacagatatcacaattctaaacagcaagctcctcacaaatgggggttatcattgttactgctggagcaggtcggagggtatctgtatgccagaggcagtcacagtggtgggcgggctcagttgagaaatctgggctgtcaggtgaggtgcagatggaggccaagtcgtgggatggcacaaggacctctgggtcttttagaggtttccaaggactcctggagccagaaaggtgtggggagaggagggagcagtgggatcccaagatgtcaaggctaagattggtccccacagggctcagagggtgggtggaccccatactgccccaccccgaaggggatggcgtggaggctttgggtctccacaggggtcagggactgaggacaggttctgtgggggcaggaggggccaagcaggtgctctgcagcccctgagcctggccctgggctcgccagcagaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattcgtgaggccctggggctgatcgtggcacaggaagtgagggcccagaatgggctgtgtgagccagctaagcatgcccttcttctgcccccacagcacaggcgctggtcgccacctccccccccagccacagccacatggaggatgagatcttcaaccagtccagcagcacgcccacctcaaccacctccagctctcccatcccgcccagcccagccaactgtaccacggtgaggccccacgggacactagtaccttgtgtttccagcagggcaggactcgaggagacaaatctgggtcactccaaagtggctatgggagcgtaattgaggaaacacagatctaggtatccagggtctaggctcttggagcacacgctaaggtcctatatctgggtccctaaaggacataaagagcaatagggtgcatcccgcgccagtttaggtcctggatctgggaagtgggaggggccggtgcctgggctgcctgaggaggctgggtagctggccaccttgggcagggatccaagggttggcttccctgtggagagcaggttcccagatccttaagaggctggtgggtcagtgctggctcccagaaaacaagaagactggagagcctgaattgagatggtttctccaggcagattaaggacagccatttgaccagctctggggccgcaatggcagtcaattgggcccaggtccccggggcattcagagattggcggttctccatcagagccccagaggtcacacaggtttctattctgcctcccctacctcaggaaaactctgaagatgataagaagaggggacgttccacagacagtgaagtcagccaggtgggtgtgagcctggaccgggtgggcacgccattcactcctctgttgcttcccaaaggcatcttgaggcctgagcgccggccactgtgctgggctggtggacacaggtggctcagaaatcagtgctgccctgagggcaggtgggcagggcaagtggacaggtgactggtgctgtggtcaagggggtagcacacaggtcacccttggcctggccaggcagtcaggagatgctgctgtggagtgccctgggcttcacagtcaggtgagtttgcctggcagggagaggtggcagccagtaacatgggcaagttgtgacagaaagtttggaagtgaggagagatgagtctggccaggtctgcagggccaggggcccaactgtgagcacagggactgggactgtcaggctgaggggctcaggctttgtggacctgagtggcctccagagtccaataagcctaggaagcgatggggcctttgctgtgctgataatacacactgcaaatttctgagaggagacggtggcgggcagtgcttcttcaactcctttgacatctcccaggacaggagcacgctttcggaaacgctgctacagaacaatgttaggcaggagcagcatgggcctgaggcccctctgtgggctaacgggatggatggttccaaggggacaccctgagtgggcattgaggaggctggtgtggagactaaggggacccgcaggtagtagtgagggcgggcaacagggccaggaggtgatgaggagagacactgaggcaggtactccaggggccaggctgggctctgccaccttcccaggcccccactgccaagcagcgatgcccaggagagaagtgggtagtcagtcctgttgggcgcttggtaagcgcaaggtgcctgtggggtggctggaaagaagcccaggaggtggttaggctcagcagcccgagtgctgtccgcagattgcctgcggtagggataccatgagcacatttaccctcccaccactttctggagtgctggtaacttccagccctgtgagtagcttctgtgacccttcaggtgacattcagaattactatccaatttccagctgtttttccttctactcttggacattaggcggctccagctaatctcatattgagaacacttaagtgtttcccactagtcctctggcttccaacagatggatcttctctggctgacaacctaagttgtgtgtcagatccctgtgggggtgtccatggggcggtgtccaggcaggacttgggaagctgggcaggctggaaatcagtgtgagtgttttaagcatgaaggtgattgaagccatgagggtgagtaaggtcacccaggtccccaagagggcaggagcaggtgggggcagcgaggccagagaggaggctgctgggacaaagatggagcctgaggtgggggtggtgagggagaccagctggcccactgggtcctgaccctctgctctctcccacccgcagtctccagccaaaaacggctccaagcctgtccacagcaaccagcaccctcagtccccagctgtgccgcccacctacccctccggccccccgcctgctgcctctgccttgagcaccactcctggcaacaatggggtccccgcccccgcagcacccccaagtgccctgggccccaaggccagtccagctcccagccacaactcgggcacccctgctccctatgcccaggctgtggccccaccagctcccagtgggcccagcacgacccagccccggccccccagcgtccagcctagcggaggcggaggcggcggcagcggaggcggagggagcagcagcagtagtaacagcagtgccggtggaggggctggcaagcagaatggcgccaccagtgagtgaggaggcagcggggtggggggcgtgggcggggctgggcagcaggcagcagccctttccatttactctttgttcccaggttacagctcagttgtggcagacagcccggcagaggtggctttgagcagcagtgggggcaacaatgccagcagccaggccttgggccccccttccggcccccacaacccacctcccagcacctcgtgagtgtctcggccatcggcagggttgggatggcagccttttgaaacagagaggcgcaggcgcctcacccccgcatcggtgggttctgaaccccccgcccttgctgctgggaatggccaagcgctatcctccatctccatcgggtgttacacccccacttctttccagcaaggaaactacatcagcctccctgctttgcccttcagaacattctaaaatacgttctcatctaagtggaagttttctcaagagccccataccctttcctccccatttctgttacctgcctgaggccaattgactgccaccggagggtcactgtttcacttttcaaagtgaattgtcccgaagtccttattcctctgcagccactccttcaaatcttagctcagaccattccactgggtctgcctgtttcccgaagaatgccctaagaaagatcagtgtgcacaaaggaaaggcctgcttcctgccccctcaccccagctccagctggcctgcccaagggggagtgggccctgtgaacacctgcccagggcaagtggttttgatcagcctgtggcctggtggagcacccgagaatcctcacccccacccccacagctctgctctgctgatgagaaaccattccaaagattgggctctgcctttgtttgcccagagaaccacttctttctcccatctgtctgccctcacctgcccctctcagatcccatctgatctgtgcagtctcccctctctccagccaggcctctctgcccatcccaccctcagggaccctcctctcaaccccctcttccatgctctctctccaggaaggaacccagtgcggcagccccaacgggggctgggggcgtggccccaggctcagggaacaactcagggggacccagcctcctggtgccactgcctgtgaatcctcccagctccccaacgcccagcttcagtgatgccaaggcagccggtgccctgctcaatgggcctccacagttcagcaccgccccagaaatcaaggtgggctcctcggacatcccccgagcctctgtgtcctgactctgttgtttctttcctccaggtctctagctgcaccccttgcccccaccctctttctggatctctctctggctttctgtccccttctcacacttgctctttctccaggtctttctgtaccaccctccccgtgaccttgatctctgggggctctcatacctcctctcttgttccctccaaagctctgtttctctgggtctcttttcctttctcttggttgcacttgttgcttgctctctctgggtctccatcttcatcccccccgcaggccctcagtttctgtccccgtttgtcctcacaaggcatagactggtgtactttctgcacaagtagaaagactggttgggtgaatgcagcctggttccaccctttaggaagcttccctgctggggcagctgcagggaaggttgcggtgggcccaccgaggggcatctgacctgacctgggagacaggcccaggaaggtctgagagggggtgatgtttaagctgagacctggaccaggcaggggggctaacagctgcaggaagggcttcaggaggtgctttaggaggagcatgcatctgcctgtgtgcttaggaagctgggcaggatgcagcagagaggagagaggtgtccactctgcaggagacagtgccaccagctgcagggctgagatagtgggtgtagcaggataggacggtggggtcctgatcatcgagggtcaggagctggggcttggcttgtgagccagtatactgtagcgcagcttccatggggggaccagtgtgtatgcccaggctgtccaggaggcagtgtgcgcgcccaggctgtccaggaggcagtgtgcgcgcccaggctgtccaggtccaagtcttggcattgtcctttctgtgccttcatctgggaaacggcaatagtcacgattatacctactatgtagggttatttggaagactaaatcatcctcataaagctcttggaacagtttctggcccaacagaagcattaattttttttttttttcttttttgagacagagtcttgctctgtcacccaggctggagtgcagtggtgcaatctcagctgaatgcaacatccgcctcctgggttcaagcgattctcctgccgcagcctactgagtagctgggattacaggcgcctgccaccacgccaggctaatttttatatttttaatagagatggggttttgccatgttggtcaggcaggtcttgaactccgaacctcaggtgatccacccacctcgacctcccaaagtgctgggattacaggtgtgagccaccgtgcccggcccaaattttagaagtaggtggacaggatatttatagtgcgtgcatttttctggaaaaagggaaacagcagctttgagattttcagaaggggtccatatcttttaacaccaccaacaacaaaaatgaatcgctggggtgggtggtcgggaaccatggcaaggtttggagtagagaaggaacaacatgacttcattggaaaggtcccctggggctggtgaggacaggatagagggagggtggtctgggcaggagaggacaggcctgggctgtgtgggacatggtggcacgacagggaagggagccatccagtggggtttagaagcaggacggatagctgggcgtggtggctcacacctgtaatcccagctcttagggaggcagaggcgggaggatagcttgagcccaggagtttgagacctgcctgggcgatatagcgagacaggatggataagccttggcgactgactcgttgtggagagtccagcacagggctggggtttgggacagctgcacgtggctggaggagatgggaggaaccagccctgactttggggaacagaagcctgctgtaacctttgtaataggaaacgaggctgtggctgcggggctggagacccaacctacctgtttccagcaaggagactgaagcctagccgggctgggcccaccccgattccagtcaccccatgccagtcacaggcagacagctgagcatgtagacctcctgcctccttcaagacaggcgggagctctcccagcgtgtaggtgtccctagtgaaggagcgtgtactattggcacatcctttgacaaaaatggtagcgcactgtacatattctgcaggttggcgtttacttctgtagtatgtcacgaacttgtattttgaaaatctcggcgtagtattccatgctgcagagtcccactcacgagacgttcctctgctgatgaatgcgtcgtggtctccgattgtttccctacagtttgatgcttttacctgtcatgggtagattgtggggagtgggtcgttggccctccacggcccccaaacagggcaggtgagagcatctggggcctgtgtcaggctgcacttgctcctgcagcccaagtgctcaggccaggcctcttgtttcctccccaggcccctgagcctctgagctccttgaagtccatggcggaacgggcagccatcagctctggcattgaggaccctgtgccaacgctgcacctgaccgagcgaggtgagggacccaggatggtggggaagcagcgggccaaagaggaggggctgcccctgacccatcctcaccactgagggggccggacccccaccctccccacagacatcatcctgagcagtacatcagcacctccggcctcagcccagccgcccctgcagctgtcagaggtgaacataccgctgtcgctgggtgtctgtccactgggccctgtgcccctcaccaaggagcagctctatcagcaggccatggaagaggccgcctggcaccacatgcctcacccctctgactctgagcgtattcggtgaggggccacagggaagggggatggtctgggacttgagtcttacggaggaggcagtggctgaacctgtgaggctgtgggtagagcaccaggcccctgacttgggctctccactgaaggtcagcaccgccctgggtctttctgtaccacctccccccgcagggatgcatgtctgagcacccttttgatcacgacaggactagtaggcagctggcactgaccttcctgttgctctcacaggcagtacctcccccggaacccctgtccgacgcccccctaccaccaccagatgccacccccacactcggacactgtggaattctaccagcgcctgtcgaccgagacactcttcttcatcttctactatctggaggtacagcagggcccccggggcagcctcgggccccccggcttcgccgccaccgccgccgtcccccctcgggctggaggggtgaggtgggtgccccactgcggccactgggaccgcaccccctccctattcccactcctgggcccctgccccaaatccacctgtccccgtccccgccttccagcccagagatgttagaactgcttgggttgacagcgaggctggtccactgaggcacacctcagccccgcttccagttgcccactggctcacccgcggcccctccccagccctgctccagcagccccagtctaggccgaccccactctgctcattggcacattctcaggcctccctggagaccactggggagctgtccagccccctcccaaccccagtgagtcatgagtgacctccaccctcatccccacttgggaaattttctaaattgcctcctctctcagctctcatcacacattagtttttcttccttctcaaagcttctctgaaagcaattttcacctcctgtctcattttccttctcctgatcagcattggtatgttctgtgcccccagccccatctccaagaggattgtccagcccaactgtggtctgtggcgggggccggggttcagccctgatgtcctgccccattcccctggctccccacccagtttgggggccccctgatccccctctccactgttcctcccccagggcactaaggcacagtatctggcagccaaggccctaaagaagcagtcatggcgattccacaccaagtacatgatgtggttccagaggcacgaggagcccaagaccatcactgacgagtttgagcaggtgagggccccgccccctctcttcccgctgctagggttggggtagagtccccaggctccaggcagcccctgctggcctctgctcccttgcctccacctttcagctggcgcagtccctcagcctgaccaagtactcctccctctggctgtctgctcagcctggaacaccgccctctcatcctccacttggccagctcctaggcctcctgtaggtctcagcccaaatgtcccttcctcaaagaaaccttcctggagccacccagcccagtgcctcccctttgcagtgctgggcacactcgcttggggtgtgggattttcccagtatgtgtccctgcaccaggctgtgggctctgctgccgagggaccttgatggcccccacttcacctccaggtcccagcactcagcagggcaggggctcagtgcggaaactattttttttgaatgggcttctcaagttctaatactgggaaattcctgctgcttgcaaacactctggaaccaacctacctgggtttcagcccagtccagctgggcgactctaggcaagtcactcgaacctctgtgtctcaattaacttatctgtaaaaatggggggaagaccacctacctaatgcagttgttatgaagattaaatgagttaataacatgtaagtacttaatggtgactgctacatagtcagtgtcatggattttttttttcaaattactttcagttggtgtgttctacagtgatgtttttttccaccaaatacttccctgatgccgagccccttcatggggatgaagtagtacaaggtccttgtcctcagagaactcagtcccctctcctggttctcccaggttgccatctttgaagcacttaagacattcatttagaacctaggtcctctcccattgtgtcctcagatgttaaccacagacttcctgtcctttcctggtttggcccaaaaccatcctccaagttagtacatttcagggcatccagtcattcagaaattcccacaccacttcgtcaccaataaaatgtccctgcagagtgcttggatttagactctgagactgttccattctctagaacaagggtgacagtacccactgcctcgaggtctttgtgaagattaaatgctaggctgtgcatcctgtactcacgtgagaggtgctcaaaagccacagccctcgaggaaacgaaggctgtgcactcacacctggggctggggccccgttctggcagctggcttcggtggaacctctgcggccccctccgtttcctcctcgctgaagtggcatgataacatttcctacccaagaagaaccttgtgaggatggatgagagtgtgtgcgtgcagggcagctggcccggtgcctgacacatccacagccctaagaattgtcccctttgtctgttggtccggcccagatcccagaccacctcctcgtccactcactgaccgccttctcccccggccagggcacctacatctactttgactacgagaagtggggccagcggaagaaggaaggcttcacctttgagtaccgctacctggaggaccgggacctccagtgacaccggcccctccctctacccacccccttcccccgcatgctgatccccctgcccaggtgagggccctgccctggaagactggagggaggccccaagccacggggcatccccctctcccaggaagcagggagggggccgggaggttttcctctcagccccaccctgggggcccgggggcgagggctgccccctcctcccctccccagtgagggacattttttggtaaacctattttcattttggaaaatatttatgaataaatagttttatatgacggctggcagcagcggcctctcctgtaccccctcaggagtcagtgagtaaggtgagggtcctgctggcgggggcgccgggccagctgggggttgaattgggagttgtaccgccgccgccggtcatccgtctcgtcttcttccggctgaccctcctgtagtgcccggccttggacccgggccagcagggcctctgcccgagacctctcagctgcttccctccgcagacgttcagctcgaagctggtccagggatggaggcctgtggggagaggagtgaggtcagaaagctggtagcccctaggaggccattcccccaacctctcccatagagggagctgccgcctggaagccccgctgcatccagcacaccccagcctcagctccttaggcctgctggaagcagccacttggtgctgggacgccatgggcacgtctctggccttcccttctgtgggctttggtcctccccagtctttaaaatctgatgcttctccaggtcaagaaagcacacttagcagccccctggccctcagtttccctttctagaggaaagaagactacaggcagtgtaccccctctagaccaggggtgcagcatcctggagacagaagcctgcttttactctctaacccagcagctctcaaactctttggtctcaggacccctttatactcttaaaaaccaaggaccccaagagcttttgtttaaatgggttctcttaatatgctgcaaatcattagtgaaaactaagaaagtttggacacaagcatctgccattggccatcagagtgagggtgtctccccatcacacagcctctggaaacctgcactacatgcctgagaacacgagtggaaaagtccaccagtgtcaggaaaataggcttgacaccacagcaccccgggaaagggtgtcaggacccctagggctccctggaccacatgctgagaaccacttctccacctagccagcccttcacggagtccctggctgtcctgaccagagacgctgcagtgcccatgctgggctgctgccaagccctgaaggtctgggccctggtctgccgaggtggggtcttcttactccttgggtcgctgcttctcagacccctccttttcctttctgctgcgactgccttcatcaccgccgtgctgtctcttcttccccagatgcttctgcatctcccgcagagggtccagacggctcttgatcttctcatctggggctgggccgggcggggggccccctcgccctgggggtagctggtaccaagggggttgagtctgtgcctccgctgcactctggcccaggtatgtcaggatgcccagagctttctcttgcctctcctgagggggccaggaaatacaagagatgtgatataatctttcaaggtgtcaggtgtgtctccctgacacaggtatctaagcgaacaggtatctaaggcttgttatgaaccagttggaccaggtgctggggatggaagacaaacagaggcaaagctccccctggggggacagtagcaggtacagtaacagcaggggaaggaggggacaagtggagccacttgagtgttcagaggcaggcatctttgcagagagacttgaagagaagcctgaagggatcaagcaaagcagaggagcgatgggtggggtcagcaagtccagagacagcagataaatgacaagagctgatgtacctcttttttttgagatggagtctcgctctgttgcccagactcgagtgcagtggcacgatctcggctcactgcaacctctgcttcccaggttcaagcaatcctcctacctcagccccccgagtagctgggattacaggcacacaccaccatgcccagctaatttttgtatttttagtagagacggggttttgccatgtttggccaggctggtcttgaacttctgacctcaggtgatccacccacgttggcctcccaaagtgctgggattacaggcgtgagccaccatgcacagccactgatgtacct

SEQ ID NO: 12989 - DNA, 23456 bp, Human
tcccaaaatgctgggattacaggtgtgagccacagtgcctagcctttttgtttaagttttttgtaaagatagggtctcgctgttacccaggctggtcttaaactctggacctgaagcaatccttttggaggcttcagcctcccaaagtgttgggatcacaggcatgagccatcatctcggccactgcactgttccaatattgcttagctcaaggccagtgcttattgagctactaagaggaaaagaaaagcagtgtggcagtaggaatatagtttaaatgtagggtgtgtgacttaacccttgcctggcatgaccttaggtcctattcataatttggtatcttattgccactggtgtccccttgaccgcaagggggtccattcagttgttgggggcttaggattttaattttttttgagacagagttctgctcttgttgcccaggttggagtgcagtggtgcaatcttagcccactgcctcccgggttcaaacaattctcctgcctcagccacccgagtagctgggattacaagcatgcgtcaccatgccaggctaattttgtatttttagtagagacagggtttctccatgttggtcaggctagtctcgaactcccaacctcagatgatcctcccgcctcggcctcccaaagtgttggaattacaggcatgagccaccgcaccctgccaggattttatttttagtttacagtgttgagggttatgggatgcccagggcctggggaggaaggggacaggatgtgtccgtcctagtctgagaatgacttttttgagttcaaaagggggcggtggacgcaccaaggcacagtcctgagggcagcaggtgcaaaagtccggccctcccagaggtgtaaggccttagagggatcccaagcatccctggggctcagcctcctggacctgaccccactgcccactcttttggctggttccactctcccctgcatccctcacgttgtccccaacaggaagctgtgggaacctgttctcaggtgtagtgcacccgttggggttctagttggctggatccgcggggccgtcagctgcaactgtgacggcggggaagcgggacgggatggtgcggatctacaggacctcgcctccaggtggaacctacctgctgagccagggattcttcaggatacaaacccagtcaactccaggcagagggtgggagcgtcatgcaccggcgacacagtggaggacgtcatggacgggcagggaggcagcggcaaccgaaactagcggctcagtcggtggccggtgtgcggtcaacggccagggcagtgggaccggaaagactcagtgtagttgtcaactgttgctacctaaaaggttactccaaaactttaagcggctcaaaacaatagacggcgcgtacggggcctgcagcggccacgggaccgtgggaagcagtcagtacccgccacaggccgcgccttccgggttccgggttccgggttcccgccagggaggagacacgcccccacctgggcaggaaccaagcagagccgcgctccacccaggccggaaccaatgggagatgcgccacgacccaggccgagaaacgtgccgcttacccttcccccacgacctgcgccgcgtcgcgcgcggccgaatctcccgccaaagctgcccccgcccgccaaggcgcgacctatcagcgtcgcagaggcccgcggcggcccggccgcctcaatcccgcgggtgggggcaaccttttcctcaggcctctcctcagcccacggcgtccatctggctcccgagccgagggccgggcagtcgggcttcgcggctgcccgcggtcccgaggcctcgccctagccccagtcggctcgcgaggcgcgcgcagctgagtggacccctgcggcgtggcccgatggtctcgcccgacccggcgcgcgcgggaggccgaggggcggggcccggcgcccacataaaggcggttgggggcggggcgcgcagagctcgtgagcgccggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccaggtgaggccgggctgcgcggcgggcgagggagcgcgtgccccgtggggcgggggttgtgcggggccggggtgtgggagggcggaggttgtaaggcggtcccgaacctcccgtgcccagccgaccgcgtccctccccgcagcccgccgtcccccgcgcgatggagcctgggacggaagcgcagagccgacggcaggcgctggaggcccgaagacgccgaggaggcagagcaccgcggcgccgagcgcagacccgagaggtgggcgcgggacccgggggtcggggcgcggtggggcccttgacgaggccgcgggctccagggacctcgtcgcgctctcgcggtgccgggatcggtcaggtcggcaccctgcgtccttttatcttggtctccgcgcggcccgtggactggggcggccgcagcaggcctgggaggcgctggaacactccggaagcctcttgccaggatgggagtcagctgaaccggcgtcagcccgagttagccagttcgagtctgtgttgtgctcccgggagaggtcagggtctctgatgagcttctcgtgaacacgtggaagtcagggacacccgagtcccgaggagaagtgagttgacagggcttacctgcttggccattttctgggttaggcagtgtgcagggagggtggagatgcgagcgaaaggagggcttgatggggtgggacggccgaggagggtctggaggaaataagcaggggtgccagtggtcgtagtggcggggcttttcggggctgtggttagagaaaacttctcgaggggctttggggtggctcgtcccgcactgggggcttgttgctcctgagttccctgaaaggcgtggtgacttggccgagatggagcagtgaaggtggagggaaatgcgtggttcgggataggcttctgaaggcaggacctgtgagacttgctgatgggttggggatgggaggcgtgaaaggaaaaaaaaaaatcggacccaacttcactgtgccaaaaggaaaaaattatgctgagcgcggaatcatgcaagaaactacctttgcgttactttttttttttttttttttttttttaaagacagggtctcactctgtctcacaggctggagtgcggtgacgcgatcttggctcactgcagcctccccctcccgggttcaagtgattctcctgcctcagcctccccagcagctaggattacaggcgcatgccaccgcgcccggctaactttttgtatttgtagtagagacagggtttcaccatgttgaccagactggtgtcgaactcctgacctcaagtgatccacccaccttggccacccaaagtgctgggattacaggtgtgagccaccgcgcccggccacctttgtgtttctttttttttttctaagcagatacctacagatacaagattaaatatctccacgggtgaactctgttcaccttaagtggcgacttactgagcacactaggaatacataattgactattcccctacctgctccttttctcttggaacatgtagatctttctccttcaacctacttttctcttttaaatattgaagccctgacagtcatctctggagaaaggcacagaccacagactctttctgtaatttcgtgttcttctaggtatgtccttaacattagctaaattcctaaagcaattgagacctgtctcagacactttttggtttacacaggaaagaggcatcaagaatgactcaagcctttaggtctgaacgctgttgattggggccatttgctaagatagagaagatgggctggagcagctaggcatgggaagttgtgaggcttgagaagctgcttagagaagcaaaggagatgtcaagaaaggtaacggagtgtaggagtctacatgggaggcatcttcaggcacagtgagttaccaggacatagagatgatatttagagacttgggtctagggggctgggcgcagtggctcctgcctgtaatcccagcactttgggaggccaaggcgggcccatcacctgaggtcaggagttcgacaccagcctgactaacatggagaaaccccattgttggggaccagcctcgacacttacccggaatgagaagagacaggttaagagctcataaaggtgggagccaggggaccagttggaaaatggaggctgcaaaaggcccggagttgcggtctccacactatttattgagtacaatcactttaagaagtaggccgggcgcggtggctcatgcctgtaatcccagcgccttggcaaaaggcgggtggatcacgaggtcaggagatggagaccatcctggctaacacggtgaaaacccgtctctactaaaaatacaaaaaattagccgggcgtggtagcgggcgcctgtagtcccagctactcaggaggctgaggcaggagaatggtgtgaacccgggaggcggagcttgcgatgagccgagatcgccccactacactccagctggggcaatagagcgagactccgtctcaaaaaaaaaaaaaaaagaagtagatgttcagggtgaaacagtgaaagggaggcaggcgtcataggcgtaattatagcggtttcaatgaatctcctttgtgctcaaacagcatatctaacttattggagagtagctagtgggagcgggcttaactaggagcctgcaaatctgtccacattccagtgctttaaaggaatgtctttcttcttgaacactgtttacagataagagagcaggtctcgctctgagcatgggaacatgatggcaattaggaggctttcctcctcagaggcctcttgtggcttttcacaacttactgtgccatatttttatggccagcttatacaggcactcgataagcctttttcccaacaccccatctctactaaaaatacaaaattagtcgggcatggtggcgcatgcctgtaatcccagctactcgggaggttgaggcaggagaatcccttgaacccaggaggtggaggttgcggtgagccgagatcacgccattgccttccagcctgggcaataagagtgaaactgtctcaaaaaaaaaaaaaagacaaaagacttgggtctacgggtgggtacagaagaggccctaggtccagatatgaagggaaggtaaacaaaccttattgagatcaagctctgaactctccagtggtctcatttagctgaagataaaaatattaaatccttacagtgctttagaagttatggaagtttttggtgtcctcattcctcaaactataggaatgcttctgtcctagggcctttgcacttggtatttgcacattgtggataatgcctggaggcacctgacaaatagagccagctcgttgatggataagatctagaagtactctttggaaggttgttagcttagtgtgtaaaattaggctttgttgtcccaagatagggtagattatgaatataacctacttaatctaagaaatggacttaaagataccaaaatatggcatgtagtatatggtcattcacatacacaggctttaaattattcttgtagttcaggaatttgttatgttggcagacccagacttgaacctcttgatacactagtgaggatgcttgtatccaatcctggacaaacctctattgagtcaatttaattttcagttaattacctaatttgatttcataactttctaccatttttagaatctggaaatttacttttagaaatccaatttaagtttatctgagttgtgtgactgtaagggaagaaatgataattacataagaggattattcatttgttactgcaattgcattttcaaagcacagcatttggtttacagctaaaataggttgcttatttgttgtaattaaagttagtatctagtgtatttttttgtgacggggcataactgtcaaccaggctggagttcagtggtgtgatctcacctcactgtaacctctgccttccaagttcaagcagttctcctgcttcagcctccaagtagctgggactacaggcatgcgccaccacgcccgcctgattttttttttttttttttcgtttttgagatagagtcttgctctgtcgcccaggctggagtgcagtggcgcgatctcagctcactgcaacctctgcctcccgggttcaagcaattctcctgcctcagcctcctgagtagctgagattacaggtgcgcaccaccacgcctggctaatttttgtatttttagtagagactagatttcaccatgtttgtcaggctagtctcgaactcctgacttagtgatcagcctgctttagcctcccaaagtgctgggattacaggtgtgagccactatgcctatcctaatttttgtatttttagtagaggcagggtttcatcatgttggccaggctggtctcaaactcctgatcttgtgatccgcccgcctcagccttctaaagtgctggggtcacaggcatgagcctgtgcacccggcccagtatctagttttaatgtcagtagtgatcaacagaaaaatggggtagaaaaataaaaatgtgagtttatgtctgatgtataaataagatacatcaatttgaactgccagaatttggggctcgaagccttaagcttttggatttcctgattattattttttaaattttaattattattttttttagatggaatctcgttctgttgcccaggctggagtgcaacctccacctcccaggttcaagtgattctcctgccttagcctcccgagtagctgggattataggcacccaccaccacacccagctgatttttgtatttttagtagagacagcgtttcaccatgttagccaggctggtcttgaactctttttttttttttttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactgcgcccggcctggtcttgaactcttgacctcaggtgatctacctacctcggcctcccaaagtgctgggattacaggtgtgagccaccacgcccggactattatttatttattcatttattttttgagacggggtctctctcccccaggctggagtgcagtgcacgatctcggctcactgcaactccgcctggtggatcactgcaacttccacctcctgggtccaagggattctcctgcctcagcctccctagtagctgggattacagacacgcgctgccacgcctagccaagtttttgtattttggtagacgctgggtttcaccatgttgccctggctggtctggaactcctgagcccaggcagtctgccagcctcagcctcccgaggtgctaggattacaggagtgagccactgcctggccataaatttcccaatattgactgaagactatcttgaacttgagatggaactgagctcctggatgtggtttaactcaagcacagggggtactttgccagtagacggagtcctgacacagcaaggactctgacatatactcctccatacacattgtaatcatagtgtacataacattctgaattattaattacatgcgcccgaaaggtaaatggatatgctagctattctgtattttatttattttctgagacggagtctcttgctgaggctggaggagcagtggtgcaatttcggctcactgcaacctccgtctctggggttcaagcagttctcctgcctcagcctccctagtagctggggcctactggtgcgcaccactgcacctggctaatttttgtatttttattagagatggggtttcgccatgttagccaggctggtctcaaactccttaccttgggtcatccacccgcctcggcgtccccaaagtgctgggattacaagtatgagccactgtcctctgccaccatatatatttttttgagatatggtcttgccctgttgcccagactggagtgcagtgccaggatcatggctcacacagccttgacctcctgggctagagtgatcctcctgcctgggcctcctgtgtagctgggactacaggcacgccccaccatgcttgggtatttatttattttggagatgacgttccaacctttttattaaaatcaacttctcacaatgtataaatactgcatattagcacacatgaaaaagacaacttctaaggcacccagaaatacgttcatacacgttacaggaccatttgcagagtggacaatttgctgtagacagtcagcattggataaatcagaagattatcatccctcagtactgtacccagtctcagtaaatatttacaacatggtgagaaggtgtcagctgtacctgctttataattctatgaagtactcagacttacagataattcagaactaaagacagtcccatgataatctgacaaaataaaacaagtagtctaaagtcttagtgattttggtgtgtgctacatccatgatcaaatccaaacactcctggggtgggctggataagtttttggtagcctgcttcattatcagaagtttgttaataagccttgccaatagaataccatttcttcagcatcagtcatttctcaactggttaatggatcagtaatctcatcatgaatgagaatggagagagaacagaagacaattcttctcacacttaacaggaattaggatgggtcagtgcagtctgggtacggtggctcacagctataatcccagtactttgggaggccgaggcaggtggatcacctgaggtcaggagttcgagaccagcctggccaacatggagaaactcagcctgtattaaaaatacaaaattagctggacgtggtggctcatgcctgtaatttcagctactcgggaggctgaggcaggagaatcgcttgaacctgggaggcagaggttgcagtgagctgagatcatgccattgcactgcagtcttggcaacaagagtgagactccgtctcaaaaagaaaaaaaaaaaagaatgggtcagtgcagaacaggaggaggcagacatttggcaagtacaggatcatactgtttagtatagacatgtctggaaaattcttaccctggaggttcatattcagatggaggagtctacactggccagataacctggaggaatgccagacctgcacttttattatatggatacaggcttgggactacacagcggaaacacccacctgagatagcctcaattagagacttaccttgcagagccttctcagtatgacagcgaatccctctgtatggccagccaggggaagcacgaggttgctggaagtgagtagttgctctgcaccgtcaagcatgcacacatctgtctagatgtgcccgcgatctgtgaaactcgggctttgttagaataatggaattctttggtggtcggttttatgaaaggcaatattgtcacaatcctgtcaacattgacattggtaatgacttcaagctgggactaatggcatagagacaaattaaatacaagatgggaaactctacactctctgaacttcttagagtcaacttcataagctccagcatcaggccggatgttggatcaatgagataaggttaacccatagaaatgccagaactgaagctgaaaactagatatgggtttttctgactgccacacacactgcaaaaatttgaagcaaatctcccatcttaatgactttataaacacataccagagatgaacgaaataagttgatttcagccatatgatagccctggactactgaagtgtggacacccaaaaggaatcataatttagtttgaagtctaaaatctagttggttttattagacccccaaacacagtgggcacactgccaaggagctccatgacttctgctctagtaagacagccctggatagacagatgcagctgataggttatgttctacatctagtttgcttttgtcctgctaaactccagtttagtatggtttgatacacatagttcactgatataatgcttttatttttttgggtgggggacagagatgaggtctcactatcttgcccatgctggtcttgaactcctgggttcaagtgatcctcctacctcagtttccaaagtgctggtattacaggcacaagccactgtgtcccaccagcctttgaatatttcttgacatacagtttgaaagaaaacaaagtatgtgtcatgggttcagtagcattttccttttattgcagctttaccactcctgaaggccctaaaccccgttccagatgctctgactgggcaagtgcagttgaagaagatgaaatgaggaccagagttaacaaagaaatggcaaggtacacattttggaccaccttgaagtgttaatctgtggcgttttcagtaacacattaaatttgatatttgtcttagaacagtggttttcaaaggtctgggctccagaccaaaggcatcaacatttcctgggaacttgttagaaatacagattctcagacccttccctgggcctgcgaatggggtggggcctggccatcctgtgaaaagccctccaggcgggtccactctttcaagcttgaagaccactgtcctcttggtggtaatccttccaagagtggaagtaggtgcacaatggtgttactgctggattgcaggctggaggactatcagaactttctttcttttttttttttttttttgagacagtctcgctctgttgcccgggctggagtacagtgacaagatctcggctcactgcaacctctgcctcccgggttcaagcgattctcttgcctcagcctcctgagtagctgagattacaggcacaggccaccacgcctggctaatttttgtattttttgtagagatggggtttcactatgtttgtcaggctggtcttgaactcctgatccgcccacctcggcctcccaaagtgctgggattacaggcatgagtcactgtgcccggcctaactatcaggaacttactatagtcatttgttaccaccgaccttctgtatgcggtgctcacacaacccagcacagtagatggagtgctctctccagatgaaggaatacattgacacttggcttaggcaacaaacagctcagaaatgccaacatacaaggaaaggtctcaaacttggattctgtgaacctcttgcagttgcacacaagattgttgtgtgtatccaagttcttgcaaactaagctacttcgtcttcgttgactcattacctaatgcatccttaaccatgtttaatctcccttgattatcagtgtgttgatcctttctcttttgatgagttgtctaactcaaacccagttgcaaggactgggtttattcaaacccagttaaaatgtggctcataattggttgaagtattttacaagataattttagccaacaagtggctgataaacagggtctcaagaaaaatgtgtcttgcgtgtcagccgcggaacgatacctagactacctgttttcattttggcagccagtgatggtatttatatcagcctcctttgaaaagggacgggaatatgtgggaattggttattgaacatttgggggagttatttgtcatttcttctggtatcaaaatgtgtgggtggatgtatgccttggtagaagaaatgaactaggagttcacagatgagagtaccagtgtttttagtgaattattgcatttatataggtcttgacttcctcaattataaaattagaatgtttgacttgacttgtatagtttgtgttgcatgcacaagtcttagaacagttcttgcataccgatagcctagttgctccctcaagtcaccccttgccaggggttatctgcagctcttattcatgcgtattccacctgtccagattgtcctgtgagtggaccctatttgttcttcagatatctcatgggtctgtgcctgaaaattgtcctgttttggaaaacagcactgtttgggctgctctgttgattataccctttgtgatggaaagctacggcttttatttacttacttatttttttgagatggagtcttgctctgtttcccaggctggagtgtaatgatgcaatctcagctcactgcaacttccgcttcctaggttcaagcgattctcctgcctcagcctctcgagtagctgggattatagctgtgtgccaccacgtccggctaatttttgtatttttagtagaggctaggtttcaccatattggccaggctggtcttgaactcctgacctcaggtgatttgcccgcctcggcctcccaaagtgttgggattataggcgtgatccaccttgcctggccaaagctgcagcttttagtgcaacctgtgtaatttaaactgctggccctttagtgagccattactgacaggccggcttacttcctgacagtaagagcggtatgaaatgtcagcttactatgctttaaggagactaacagactacaaactagcaatataagagtatgaaaatggattttctgcatggcatggtggctcacacctgtaatcgcagtactttgggaggccaaggcgggcggatcacctgagatcaggagttcgagaccagcctgacgaacatggagaaaccccgtctctactaaaaatactaaaaattagccaggcgtggtggcagcaacctgtaatctcagctactcaggaggctgaggcaggagaatcgcttggacccgggaggcggaggttgcactgagccgagatctcgccattgcactccagtctgggcaacaagagggaactccgtctcaaaaaaaaaaaaaaaaagaaaaaaaagaaaatggattttcatcatacctgaaaaccagtctttctcatctgtggtactggagagaatgaggccctgcagcaaatgatttgcaggactaatctctgaatcgtacaaagatggtgttatatagccagtgctactctagatgcacgggagataaattacttcattaccttctggcgtccaaactgcactgaacacctcagcaaacttgggtggattttagattttgagaggaggcacagtaatacatgacataatttagatacctgcatgacaggccaggggtggtggctcactcctgatctcagtacttttgagaggctgaggcgggaggattgcttgagctcaggagttcaagagcagcctgggcaacacagacctccatgtctccaaaaaaagaaaaaaatttttttggagatggttgtggcggcacttgcctggagtcctagctgcttgggaggctgaggtgagatgattgcttcagcccaggaatatgaggctgtggtaagccatgatcgtgctactgtactctagcctgggtgacagagtgagaccccatctcaaaaaaaaaaagatactcacatgaacttggagctcaaggtagctcgtggtttcaacgtcagattgcgctagactccttttggagatgtcatacttttttttttgcaaaactgcgttctggtaatgactgcaatagaaagcagatgcctcaggaagttcatgaggaacaagagaaaagggggcacgtttggtctccaggattggagaaggtatgcagtgcccagtaggcatatgagtcccattagtaagtttggtgtttttaaaataatttatttcaatttatgttttgtttttctttttttaaggctgccaagttttagggaatgtaaatttttgttgtgtggatctcactacttaaactgaacctgacaaagatttcttttggcccacggagcttctggattgcataggatggtgtgcctgcgggcatcagggtggagcttcctcagacctggctgctttatttttatatcttttttaaaaacagcaatatttattttgccctcagatataaaaggaaactcctcatcaatgactttggaagagagagaaaatcatcatcaggaaggtaaaggctgtgtaaatgtttcttttctaatttgatagacctgtaatttgttaaaaaaaaaaaattgtgactgtcagaaatgctgactgtcgcagtagcatttattaatacctttttcactaatttgaaatactgtatctgttgtgtactaaattcccatacatgcagtctccggactatttaggattcatatggttgggaatctggagtgaatcttccattattgtgttttgacattttcttggcttaccttacatacatggtgatcttaattgcagggcttattctgttaatctgttgttttttcagttctgattcaaaggagtctatgtctactgtgccggctgactttgagacagatgaaagtgtcctaatgaggagacagaagcagatcaactatgggaagaacacaattgcctatgatcgttatattaaagaagtcccaaggtagtcttgtttcagtggcatgtcttgaacaagctgtgtggcattgcgtttctaaagagttgcttagattgggtagtacaaatgatgctggggatagttcacacctgctaagagctatttaatagggacttactggggcttatgacgtaaataaagaatggattggcaactggaaaactaaagacatgaagattttaaaaatcattttcatataattttgaatgttagataacattttatttcttaggagtcagcaatcatagatgtaagcttattaaaatacatgatggggaaaaatgaagttcaagttaaatattgtaaaattctaattggagaaaaaaaaattggcattgccctattgtctttaagcagcatgttcttgcctatcctggtccctcaaacacacagacacagaaggatataaagaaagctttagtgttttcctgaactttttggcaggattggggttgaaatttacatttctgggccaggtgcaatggctcatgcttgtaattccagcactttgggaggccgagaggactgcttgaggccaggagactagcctgggcaatataaggagacctcatctctacaaaaaatttaaaaattagccaggtgtggtggtttgcacctgtagtcccagctacttgggagacaggtgggagaactgcttcagcccaggaattcaacgttacagtgaaccattaatcacaccactgcactccagcctgggctgcagagtatgagactttgtctcttaaaaaaaaaaattttacttttggctgagtgcagtggctcatgcctgtaatcccagcactttgggaggccgaggagtgcggatcatgaggtcaggagatcgagaccaccctggctaacacggtggaaccccgtctctactaaaaatacaagaaatttgctgggcgtggtggcacacatttgtagtcccagctactcgggaggctgaggcaggagaatcacttgaacctgggaggaggaggttgcagtgagccgagattgcaccactgcactccagcctgggtcacagagcaagactccatctcaaaaaaaacaatttttttttttttttacttttttggaacatagctggcaaaggaatagtaagattcaatgtgatggtgctttttttttttccctcctgaccgagtcttgctgttacctaggctgaagtgcagtgttatatcatgtctcactgtgtattcatttttttgagacggaatcttgctctgttgcccaggctggagtgcagtggcgcaatttcaactccacctctcgggttcaagcgattctcctgcctcagcctccacaggcgcctgccaccacacttggttaattttcgtattttcagtagagatggggttttaccatattggccaggctggtctcgcactgctgatctcgtgatctgtctgtctctgcctcccacagtgctgggattacaggggtgagccaccacgcccaaccatcatggctcactgtagtcttaactcctggcctcaagcaatcctcctacctcaacctcctgagtagctgggaccagcggtgcatgccgccacacctggctaaacttttaaatttttatagagatgggagtctccctatgtcgcccaggctggtcttgaactcctggcctcaagtagtcctcccaaagtactgtgattacaagcgtgagccactgtgcccagcggatagtgatttttttgagaccgagtttcactctagtccaggctggagtacaatggtgcaatcttggctcaccgcaacctccgcctcccaggttcaagcgattctcctgcctcagcctcccaagtagctggaattacaggcatgcgccaccatgcctgggctaatttttttgtatttttagtacagatggtgtttctccatgttggtcaggctggtctcgaactcctgactttgggtgatctgcctgcctcggcctcccaaagtgctgggattacaggtgtgagccaccgcacccggcccggatagtgctttttaattttttaatttttttaaacatatttgttcattttgtaggatctcagttgattttttatttatttatttatttttgagacggagtctccctctgtcaccaggctggagtgcagtggcacgattttggctcactgaaacctccgcctcatgggttcaagtgattctcctgcctcagcctcccgagtagctgggattacaggtgtctaccaccacgcctggctagttttttgtatttttagtggagacagggtttcaccctgttggccaggctggtcttgaacttctgatctcaggtgatctgcctgcctcagcctcccaaagtgctgggattacagcgtgaaccactgtgcccggctttttttttttttttttttttttttaaggtggagtcttgctctgttgaccagactggagttgcagtggcatgatctaggctcattgcaaccatcgcctcccaggttcaagcaattcttctgcctcagccgctggagtagctgggactcaaggcataagccaccatgactggctaatttttggtatttttagtagagatgaggtttcatcatgttggccagcctgatctcaggctcttgagttcaagtgatttgccacacccagcagcgtttgttttttttttttttggaggtgaagtctcgctgtgttgcccatgctggagtgcagtggcacgatctcggctcactgcaagctctgcctcccgggttcaggcgatcctcctccctcagccccctaatagctaggattacaggcacaggccaccacgcccggctaatttttgcatttttagtagagacggggtttcaccatgttggccaagctggtctcgaactgctgacctcaggtgatccacccaccttggcctcccaaaatgctaggattataggtgtgagccaccgctcccagcccctagctgtttttttgttctgttttgttgttttttttaaatagagacgaggtctcactgtgttgcccaggccatttttaaattcctgagcttaagtgatcttggcatgacctcccaaaatgctaggattacaggcatgagccaccatgcctggtgatctataatatttaaaataatactaatctcatagtttggttaatcttcaggctaatgtggaaatgtgagtggcatgtgggcatgtgctagaataatctttctcctgtagacaccttcgacaacctggcattcatcccaagacccctaataaatttaagaagtatagtcgacgttcatgggaccagcaaatcaaactctggaaggtggctctgcatttttgggatcctccagcggaagaaggatgtgatttgcaagaaatgtatgtctttattgcattcttgtcctgtgattctctgattggtccagtgactggagcagctgcgcaccactgggacaggaggtctggtgccaagtcccccagcagctgttggggagcagagcagctgctgcagctcggtgctgagttcttctgtactgggagggaggcagctggaaggaagagtttgcttcctggattgaatttattttttcaagcaaagtcaatctgggaatacagtttttgtttgttgttttgctgtttttgttgttgtagttgtttttcccctaaaaattacaataatctctggaatttgttttttaaatataaatatcctaaaaagtatttgagtcatttcggctcaaccatgaaaataaaagttcttaattaaggaaggaaggctttctttctctattggctttttttttttgggagatgctctgtcaccgaggctggagtgcagtggcgtgatcccggctcactgcaaccttcaccttctgggttcaggtggttctcctgcctcagcctcctgagtagctgggattacaggcacgcgccaccacgcccagctattttttgtatttttagtggagacggggtttcaccatgtaattcctgaccttgtgatctacccgcctcagcctcccaaagtgctgggattacaggggtgagccactgctcccagccccgttggcctttaaacttgtgcctagttgaaatgtctcaggcctgaacttttgctgcatcatggcaatacctgctgaccaggaaggtagagagaatgatcgtgtacctccctccctctatgtggggtttcttctcagctcccctctggtcctgagcctctcgcttcctcagacacattctttaaacaaacaattagagtttctcctctgtgctgggaaattttttagagactggcatgtttgaaacgattgtaagtggctttaccagtttgtcctgacagatgtcatttgggttttttcccccagtgtgacaccattgtcccattctctgagtagaaacttggaaaaattagtgataatgcatagtatgttcatcacagtgctcatttctccccctcaaaaattgggcttatgagtgtttctgtttccaaggatgcttgtgtggtgagcccagcagatctttttgttgcttctcattgccatccgctttctctttgctggattgattgggctgggattaagtctgtcaaatagtcactgaaagctgacccctcagggagcctcgggcacactgtcagtgttgtggctgtaccatatggatggggtttgtctgtagcgccccgtctcctggctttgttaagttagtgcctgacgcacatgttggatcttgtttaacagacaccctgtagaccttgaatctgcagaaagcagctccgagccccagaccagctctcaggatgactttgtaagtactttggataagtctttcagcttgggggttgcaggtgaattgttaataacacatgctgccttataaactgaagtttggactgggcacggtggctcacgcctgtaatcccagcaccttgggaggccaaggcaggcggatcacctgaagtcaggaattcaagactagcctggccaacatggtgaaaccctgtttctacaaaaatacaaataatagccaggtatgatggtgggtgcctgtagtccgtgctactcaggaggctgaggtgggagaatagcttgaacccaggaggtggaggttgcagtgagctgagatggcgccattgcactccagcctgggcaacagagcaagactctgtctcaaaaaaaaaaaaagaaagaaaaccatgtgctgcgcgtggtggctcacgcctgtgatcccagcactttgggaggctgaggcaggcagatcacctgaagtcaggagttcaagaccagcctgcccaacatagtgaaacccagtctctactaaaaatacaaaaactagctgggtgtggtcatgcaggcatgtaatcccagctactcaggaggctgaggcaggagaatcacttgaacccgggaggcagaggtggcaatgagccgaaattgtaccactgccctccaccctgtgtgacagagtgagactctgtctcaagagaaaagaaaaccgtttttaaatgtatcagtttaaatactgtctcctgtcctgagacagccactatttgtggttttgtctaggcttttacaattctttctgtgcttataaactatgtacatggccaggcacagtgactagtgactccttcctgtaatcccagcacaatgggatgtgtgcacatctaaacgtcagtgtcttgtaaatggtacatgtggtttctctttgcagtgttattattaaaatctgtctcagttgcacgtgaagtgtacaccttgctgtgcattacatcacatgatttaccacataaggagtggggtgtaggaaggggcccctgttttcagggtgagatgaatgtcaaccgagccatgcttctgttttccaggatgtgtactctggcacacccaccaaggtgagacacatggacagtcaagtggaggatgagtttgatttggaagcttgtttaactgaacccttgagagacttctcagccatgagctaactgccccctggcggccaggaagagaaacagctcctccccgactaggtggaaggctggccaggcaccaagcatgtgtgtgcacttgtacctggtggtttctctgttagcagtccattagctcatgctgaattatttttgccttactttcttaagaaacattaattttatgtatagtgagtatattttgcatgttttaaattgtaaatggagctaagtccaagaaagtacttgaagctctcttccagcgagcttaattgcgtaatccctgttgtcctccagggtaagctgacacgtctacataactggttttccacaggcatcttcagttattgcttgtcaggtggactgttttggatttaaccatgtaatccatgggaccaattgagagtcagctacttttataggcatcaaagtattctcagacacctttaatatctttatggaaacttaatttttggccttttatcaatatgtcataacagcattctgaagtcagacattgttaaattgagctattaaactaatgagttttatgtaagttatatggtcttaatttggtacttgtaaatagcactagttagactctttagaatactccaagagttagggcagcagagtggagcgatttagaaagaacattttaaaacaatcagttaatttaccatgtaaaattgctgtaaatgataatgtgtacagattttctgttcaaatattcaattgtaaacttcttgttaagactgttacgtttctattgcttttgtatgggatattgcaaaaataaaaaggaaagaaccctctttcactgactggggctgttgccaggtgggccagctgccgtgagagctgacatgtttggagggtcagaattgtgtctgcctttcttgtgtctgaagcaagtggcactcagtgagtggcgctgggtaaagggccttctttatttttttaattttattttttgagagtttcgctcttgttgcccaggctggagtgcaatggtgcaatcatggcccactacaacctctgtctcccgggttcaagcgattcttctgcctcagcctcccaagtagctgaaattacaggtatgtgccaccacacgcagctaattttgtatttttagtagagacaggatttctccatgttggtcaggctggtctcgatctcccgacctcaagtgatctgcctgcctcggcctcccaacgtgctgggattacaggtttgagccactgcgtgtggccgggggccttctttaataggtgtcacatgtcacatttggtctgatgcttattcatcagcactggcatgacagccttccctgtctcttgggagagaccctgcagcaggataatcatcagtctgagggtgccctgctcccactgccttcacccttggaccgtggttgctgcctgcagacgtgaccactagtccacgccacagcgacctgtcccggagatccctccaagtgatgctgggctggtcttaagccagggatgggctcaggtaactttgttctaggagcttgaagagggcagaagctcttgtttacttagcttgtttatggagacctcaagcagtgtcaggtggagggtggtagacactggggttgtagcacatgccctggtgaggagacccagctctttcagggtggtaggaggtgcctgataaaaggtgacatctggggagggcagcaagcagaggccacgaagtgggagcactcagcattgacttcaagagtcctaaaatgtgggaggagttctgggggcctgactgcaagcctcagtcttgagaaggcagaggtgaaggtccttgttagatggtgacagttcagtggtgctgtggcctccatcatgactgacggagagcagctctcctgggtttgtcactaaggagctacttcccctaaactgtgagcaggtccttagcgatgagcagcactcagtgctcttaggctaaaattcagtggcttccaagcaaaaatgacatccagaagacagctggaaaggtgatctaagctaaagctgagggtgtggcatgaaatcctctgttaaccatagaaagttgaacctttctctctcttttcactggagtgcagtggtgtgccttcagctcactgcaacctccacctcctttggctcaagcaattctcctgcctgtctcctgagtagctgggattacaggcgtgaaccaccacacctggccaattgttgtagttttagtagagttggggtttcgccatgttggccacgctggtcttgacctcaggcgatctgccctcctcggcctcccaaggtgctaggattacaggtgtaagccaccgcgcccagctgttagaacctttctttccctcaataagacttcttgctcctctgcaggagcccaagatggtgctagtctgaaaagccccacaggtgtggcttctaatgaactgaaccctattaagagtcacagaattaacatgggcggaagctgctgccaggctggactgaaagggccaggcaatacaagaggccttgaaccctcaggttcctaccagcgggaagtaggaagataaaactctccagctgcaaacacaggctgccttttgtgaaaaagaaggataattcagagatggagccaggagcctggaggactgaggctggcttaggggactgccaggtgatgtgtgcccagctggatttcagacttgctgtgggccagggactcctgggagcatttgcagcaggtgtcctaggtctgtccccgctgttcattgcggtgggggtgtgtgtgtgtgtgtgcatgtgtgtggtgggggctgg

SEQ ID NO: 12990 - DNA, 17352 bp, Human
  misc_feature (1)...(17352): n = A,T,C or G
cgcagcccacccggccggccctcccggccagctcactggctcccatgggccccggacctccttgggctttgcctgaaggtgggagcagatggccttttccttgtgagggtggacacagaagccaacagtcatgtggggtgaggggacccaggcacctccagcgtcccccgcagggcagcaccttcccctcctgggaacccacccctcttcagctggactctgagcccaccccgtggagcccagaacctcgggccagctcaggctctgccaccagctctctgtcatcctccctcagagccgggctgtgctccccaagccaggggtatccagcccccgctcttcatcctaggccgggcaggcagccagccccaggcctgtgtcctccttggggggcggggggtagggacccctcgcgcggggctctcaggcggcttagctgcgtgcggccccaggtcagtcaacgcagcctctgcacctcgccggtcaggtacgcaggccgcgccgggctgccccagacctgcggcgcacacgggaggctcagcctggaatgccgtcctgccctcctccacctgaggaattgccgctcacaccacagggttcagctccgcggcatctcggcgaagcctcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgcagtctcccgacggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcaggtaagaagggacccactaggcacgggagaggccggcccgtgcgggcagaggcgttggggacgggaaccggccccgggtcggaggggccgccgggtgtgagtgacgccccggggttagagcccggattccgctgcctccttgccggagagcgcggccagagctagcgcggcgacttgtggtgcgcccggagccgcagctaccctccaagtgcgaggccaccacggggagccaggctgggggttggcgtccgcagccccgatcccctgcgactccctagccctggcctgtcgggagggcgcggggggccccatttccacgattcccgctgttgttattcgggttctgcgcagacggaaagttcccattgttggcgtccccctcccccgggccccagtttgtggccagcttcagccaaggcgagagaccggacttctaagggtgggtgtgcgcgtcagcgaagcccggcccctgcccgcccgaagaggcagcagcctccagcgtccccgctgccgaccctgcccctgcctgggggccgagggcgcttccccgtgggtgcgcgccgagctccaggcaagcgaggggcgcgtgtcccagcgtcgcgggccctagactgggctggcggtccaggtcccgcgggacgtcgagggtctgaagggaggtcccaaggggcgaggggaggggaaggggcgcccggccggacctgcacacgcgccgcggttcctcgtgggccgggccgagagctccggtgccgccgccgcgtacacccgctgccggctccggacgggcgaggggggcgcgcacagctcagcccggcggccgcgcggagggaggccttggcccggtgagctcgcgccccacccgggcccaggcccgaacagccgcttctttgtacctcgacgcggccacagaccgcgcattgatggcggctcggcggctcgcggggaggtgtgagcgaccgcgggcgcggcgggccggggagggcgcctggagggccgaggcagatggcgtccgccccgcccgcgcccccgcgcccctttctccgtcggcggctgcagcctcccggaacaatgtcattttttttatgaatgaaagtggcccggcgcttgaatgtgcgtgtcattcagcggcgtgacaggggccgtcgggaggtcagcgcgcgcttttagcgtctgctcgggcggccccgcttccaggggtgccggaggggcggccgcggggggagcttggctttcgcattctcattcagataaagatattactccctacggcccgggaatgtcagccagccccggggaagggcggcggccaggctgcggagcctctcctggaccccctgcgggcgcgcggggcctcccccagtcgctcctggaacgccccgcccacccctcccccggggcggcgcccccgcccgcactggagctggtgaaacaggtagtgagttgatcggtcaataaacttaatccggttccttaacaagatgggccgggcagtaaaaatacaaagacctcgtgaaatggactgaggtctaggctggcgcttgcccgggaacataaattatggagccttggctcgcaggggtcaagggcggtgggaaaggttttggccactggactgccctggccaccccaggccctgccaggacagcccccatctccccagggggccgtattcctggttgggacctggagtgaccccccagggtgcagggaggtacacaaggtcggctctcccacagtcccaccccacccagcaggggtctgggggtgcagggcctttcccgaaggtgctggctgcaacctcccccactcctcctctgcagggctggactttgagccgcgtgggcctctgggtggttcattaacctgggctgagcctggcctccaggtccttgtgtgagcctaggaaccccttgttacccaccccccagctccccagccctcaggtctcacttggggctagatctggggctgtggcaccccttgttacagctgagcttgagtgggagcccaggggcttggggtctcctggaggacggggatctaaagtcacctcatctagggaggcatgcagccctcacctgagtgattcaggagtgaatgagccaggagtggagccacctttggtggggtaggggtcagcctggacctctaggctgccagctcaggctcgggtgccctcttcgaacctcagtttccttacctgtccaagagaaccgataatggcaggctgtttgaaggattaggccagataaccctggcaagccctctttagcctgcccagcctccagatcccttttttccggactttattgtgaaactccaggtggggagacagggaggctggacttttgggggccccctcctcttaggctattttatagctcctacctggcaatacctcctgtaccccagagagctgcagagaacttcatgtgcatccgaaaccagaatgtgttgtttcctgaccccaggccctcatctcaccccaaaacccaaataaacccctggggcagccagctccggaagcgagtctggatttgatccttgttctctggggtcaacccgaggggcttatgatggagcaaggctcccccatcctctcagccatgctccctcacatgcactgggcctccactgcagagacccagagcctggagaaaggttccccaggccagagtttggccgtccccagcaccctgcctaatggacatcagtcttggggccagagacccagggcagggagcgcctctcacccctaccctcactcctgcagccatttcagggcctggtgccctccctgagctcctgggcctgtggggtgggatttttactttgtgccacagtgggggaaactgaggtacaggaccagtgagtggcagagttgtggagactctgggacacagcagagggctgtcgttggcatgtggagcccaagttgaggtcggcactgtgtggggttggggcgccggcaggagcacgtgttgtgggatccatagaagggtgggaggtgggacgcgttgcctcctaccccgccttgggtacagcaggagttttgtctccaacgtgtttgggcaccagtgtctgtgtggtgtcagtggggcctcccttttgtggatcaagaaagaaagaacccttcctagggctgctggggggctatagctctccccatgcctggcagctgggtggggtatgggggctccacccaactgctgacttcccagtgggagtcagaccctgaacttatagcacccactcatgccccgtgtcacactgtccttcacctggtgctcgccacccagcccctgctggggtaccctggcctctgctggcacctagcaggcaggcagtggggggggcagtcagggctgcaccctccccaccacacacgggcagatggccactggtgtggctggcctggggctgctgtgtcccccgtccccccgtgctggaccaggctgaagcaaatacttgtgtggatggcttgacctgttgtcgccactcagaccaaaccggaaccaaccggctgttgcccttgggccagggcctgcagctgaggctgccataaccagcctgttctcggccttctggggggcctcgagcagctcccagctctgggtggtccccacaagacactggccaggaccggagggctggaggtcaggccaggagcccccctgactgcggggtccctacaggggcagtccttgagctgtgggtcccggtggggcgagggctccttcggatgcttcaggggatgagtgtgggcccttctggctggcagggtcaccctgggcactaggcgtgtgtggctggatcaggtgggttgggcagaagagggcctggccgggcagccagggactggtgtggccagagtgggcagctgggcccccgaatctaggccacgcgtctgcagaatgacaagtgatggcgcaacccgcccagctgggtctgaagaaggaggctgcctgggggaccacccacccccgtcccggccccaagcccgggacgcctgcctgcatgcattgtctggccctggcagggaagcctaggggcgattgtccccccagccctgcccatggtgtgtccttgggtcacaggctttggtggctctggggagctgggcagctactggggagggacccaggggccacctgcacatctgcccctgtgggtgggcccccaccccagcttctcagcccccagggaggggccagggctgctgacctgccctggctctcacagcttcctgcccccagcctggtcgtcctctgtgagggggccccagtccccctgcaggcagcaggactccaccccccggcccccttgagggcccgcctgggcctccccactccccggcctgtgagacccacttggccggacccagcgccgtgtttgtactttgctcttctcggtatgttttccgtcatgaccgccgtgtggagcttccataggagctgcaggatacagaaccttgcccaccccaaggagcccccacccccgccccggccccctcgcgctgctccggcctgtgctctgaccggtgaacccgcgcatcgccccccagaccgtccacacggccacgtgaccctgcacctccttccttctcgcctgttctgttccctggctgtccatctgaactgcttttcaggctcatatggggtgcgggggctactgaggacggacccctcctggggtgaatctgcaccacgagggggctggctggccaaccctggcaccccctctgagctccatttcagtcagaggccagcaaagggcagcctgtcccctttgcccgcagcacctgcccgtcgtggtgccgcctgtgagacaagcatggattttatgtttccaagcaattgaacaaattaaaagaacgaagagtcacattttgtgacactttgagatttgaattctccgtgtccatgagtgaagcatcatggggccactgctgtggggttggctgcaggttgtgtggggaaggcggctgtcacaccgaggcagaccggagtccttgggacagactggttggcaaagctgaagatagagacctttggcccttttgggacacagtttccagcccctggtctggtgggaccctggatctgggtcagagccttcctcactcagggccgccgaggcttccactgctgtgtctgtaaacggtgccgggtttgggggtgcctgcctcatggttgcccatcttccccacagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacaggtgagctctggggccacgccagctacagaaaggagccgagtgccgggctccctgagtccctgcgtgggtcaggagcggctgggggtctctctggtcattggtggagaggagggcaccccagaagtgctgcccaaatgggggaccctgctccatctgggaggggcacctgggggctcctggggcaggttgggcattggttgcggccatctctgccttgcagacgctccatcctcgggagatgacgaagacggggaggacgaggctgaggacacaggtgtggacacaggtaggagcagggtccagggttcaggccagccggggtggggcccgctgccaccgccaagccctgcccttcacaggcagctgagggactaaggccccggaacaacctccctggggtcaccccgaaggtctggtcccctcaggatacaggaggggctgggtcactgacatggctctagatgccccaccctggtggcagggctggggtgcaaggggacaccgtgttgctgatggggagactgaggcacagggccctgggggttccaggagcaggaggaggccagggctggcctgtggggctctggtgttggctataggtgaggtggaccccgcagacattagcgcagcagggcagggcactcaggtggctgccgtggggtggatggacccggggtgagggcgccggggcacctgccacaaccagtggcgggcagggtggctggcaggagggtggctggtgggtgggctgcggctgtgagagagcagtcggggacgatgcctggcgtcccggcctggaacggtggcaggtggactttgccaagttgtagggtggggaggtggggcttctggttttggagggagctctgaggggagtgcgtgcaggtgagggtcatcgtggcacagacatggggggcagttacgacttgcggactgatggtgtgtgcgctgggtccctgggccagtggggtaagcaggtgaggaagggaggctgagtccatgagagaaacagctgggggaactcaccctgggggtctccaggaggcctgggagggagctcagcaccgtggggtgcctctttccagcctgtgtccacactgctgcttgctgggcctcagtgcccctgatgggcgtgtgcctggagggggctggcagtgagctcactgaggggagggctgcttccctcctggggaatgccagcccatccttgcctggagtcccggcaggaaggcagcaccagccctgaggaaggagaaaaaccagttgggctgtgagaggggtggtgggagccctggacatcgagatgggaggaggcagggcctccagggtgccaccgtctctgggtgcccgccagacttggagctctgcagagggtggtgtagggtcttgatttccgtgggcccatgctgcccagctgcctccaaggctcctggctctgcaggcgactgggctcctctcctggtaaactgctcccaggtcctggcttgtccactagatgggcctgccccctgggtcttcagtctccccgttggtgggcctggccctggcacgcctctctgggcaggtgggctcccctggacaatgccctgtgccctgtgacttcacaggtccgggcagagcaccctggaggggaggggaggggacacacggcccagctctgagaaagccccggggaggggacaagatgtggaggctcctgggaacctcatcccgccctcttcctacacaggacgggaaactgaggctggggatgggcaggggcagctctgggaagggggttgttcagaggggcctctgctcccactcgggtcatggccttcacacgcacctcggcccgcaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaaggtgggcgcggcggggtggctctgggcctggcaggcgcggtggttgctgcctccgctcactcacccgcccgcgtcccggtgcagctgcggcatcagcagtggagcctggtcatggaaagcgtggtgccctcggaccgcggcaactacacctgcgtcgtggagaacaagtttggcagcatccggcagacgtacacgctggacgtgctgggtgagggccctggggcggcgcgggggtgggggcggcagtggcggtggtggtgagggagggggtggcccctgagcgtcatctgcccccacagagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaaggtgggccaccgtgtgcacgtgggtgccgccgctggggctcctgggctggccccaagggtgccccttggctgcgggttgcgtgaggatttgggtctaggggttggagcttcgggggcagaagctgtgggggtgcttgtggggccaagtctcagccaccccacacctcagggccataggcagctgcgttgggacccgtttccgtgtctgcagagggccagcctcagccactgaagtccctgacatggagctgcccacgggcttcttgggggtgggtgcggcttgggcagcagtggtgccccaggacaggagggcagtgtggccaagccctccaggccccctctgggcctcagaggcggtggctgagccccgacctggccgattggctctcgtcagctgtgtgcagtggggcccgagctcactgtctgcccgcctcctgaagcccttagctttgttcccatggctgccgggtgggggccactgaattgggacggttgcgacactcaaagcccaaagagaaacatctattcagagagaagacggtctcttgggggcggggagcaggcgcagggcgagggtggagtccagaccccgcccagagaggccgcctcgggccctgtccagggtgcaggttctgcaagagcccgggggagggcaggccagtgaccagaggttgtctgagggtctgggctgggttgttggggtggaggcagagacgtgcatcctgtgaaaccacagccaccgtgaagtgcctccacgcctcctccaggcagcctttggggctgacgcagcccagcctcgatctgtaccttgggggtctcccacatcctgcctcgtgcccggcggggctgcctcgggggcgtgcctgagccgggtctcttgtccccgcagtcctggatcagtgagagtgtggaggccgacgtgcgcctccgcctggccaatgtgtcggagcgggacgggggcgagtacctctgtcgagccaccaatttcataggcgtggccgagaagccttttggctgagcgttcacgggccccgagcaggtaacgactctgtcccatgccggccggcacaagagctccagctccaaggccctggccgcgcgccctgcacgccccgcacgcccagccctgctcgctcccgccccggctcgcgctccactcggggccgcctcggcaaggctggcagctccagcctccacggtgaccgcccgcttcgagccctgtggcctgcgccgacccttcccgcacgcctgcgacccccacaggaggtgcccggtgcccaccgggccggctccgtgccgtctgtgagcacccctttgcgcctctctccacccctgcccgctgcctgctcgcttccgcagcctgtgtgtccctgtgtccatcctccacctgcacccgcccggctctgcgctaacccgcatgctgcctgcccgcctgccgctcacctgggacagaggactcgccggtggaggggcctggcttcgggctcagtaccggtgtaccaggcggagggccctcagccgcgtggcggtgaccaagttggcgatggctgaggagttggtggtggcggcgttttccttgcagcggctggatcctgccgtgtggactctgtgcggtgcccgcagggcggtgctggcgctcgcctatcgctctgctctctctttgtagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccaggtaccggcttctgctgctgctgctgctccgcactgtctgggggacgctggctcgggacacgccaaagctgccaggacggacgggaatcctgtgacttacggccgtcccgcttcttgagccctcactcctggccctgtgcccagtgtggggacaaagttggcctggcccggtcctggtcccagaggggccccctcagccccctcgagcccacttcccatctgggtccccaaaggcctctcctgtggctctggtgtctcccgggcgcctggtggcggtgtgggactggctggctctgctgggctccttctctccagggtctggccctctagactcactggcgttactgactgcgagaccctccagacaaggcgcgtgctgaggttctgagcccccttccgctcccagtggtgcctgcggctctgggccaggggcatccatgggagccccgtgggggggggggccaggccaggcctcaacgcccatgtctttgcagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtaacagaaagtagataccaggttctgagctgcctgcccgccaggcctcctggagccccacctcggcccacgctggtcctgggctgtgtgagccctctctgcagccaggcgggctcccctctcctcgtctctgctcaccatgtagagcctagggtactttggggcacgaaacattctaaaaatcttcattcaatgctggtggaagtcagaacgcccccccttctggcccagcactgacccccggctgtacctccacgccctgtcgcccacgcggcgccaacctgcccctgctgacccaagcaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggtcagtggtgctgagggccagcgttggctgtagggggcttggtggtgggggtgaaacagccaccagtcagaggcccggctgggtttaggggccgtcagggatgtggcggatgttgggtgtggctggggttctgtggacatgctcctgggacgggtgtatggcagggactgcccctctcaaggtgccctgtctggaggggcagcaagggcgggaggctgtgggtgacactcttcgtccttacgagcaggctgtagggggagcatggagggcttcctggaggtggtggctctgggcctcaagggctgggccaggctggggtggggaccgtggtgggctgagagtgggcgagtttgcacactcatggtccctctgcctccactgccaggctgaccctgggcaagccccttggggagggctgcttcggccaggtggtcatggcggaggccatcggcattgacaaggaccgggccgccaagcctgtcaccgtagccgtgaagatgctgaaaggtgaggagggggcggccaggggtgcagagcagggctgggggcgccgccgccgcctgacacaggccccccgctccgtgcacagacgatgccactgacaaggacctgtcggacctggtgtctgagatggagatgatgaagatgatcgggaaacacaaaaacatcatcaacctgctgggcgcctgcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtggagtaggctgggccctgccctgagatgctgggagcagcggggagaggtggagaggcttcagccctgcctcccaccccttccccagtgcatccacagggacctggctgcccgcaatgtgctggtgaccgaggacaacgtgatgaagatcgcagacttcgggctggcccgggacgtgcacaacctcgactactacaagaagacaaccaacgtgagcccggccctggggtgcgggggtgggggtcatgccagtaggacgcctggcgccaacaccgccttcccacaccctcccagggccggctgcccgtgaagtggatggcgcctgaggccttgtttgaccgagtctacactcaccagagtgacgtgtacgtgtcctgcagagctcaggcttcaggggtggaggcgggaactgggcagagccaggaccccagctgcagtccccaggcctgtgccctggagctcctgggtgtggtttctacccctccctgggggcagcagcgcagccctggcctattcccctggtgcccgcccaggtgtctgtcctgggagtctcaggacagcctgacctcaccttcccctgcagctggtcctttggggtcctgctctgggagatcttcacgctggggggctccccgtaccccggcatccctgtggaggagctcttcaagctgctgaaggagggccaccgcatggacaagcccgccaactgcacacacgacctgtgagtggcatccctggccctccactgggtcctcaggggtgggggtccctccggggctgggcgggggagggactggcagcccttcaggctgttcccgaataaggcgggaagcggcggggctcactcctgagcgccctgcccgcaggtacatgatcatgcgggagtgctggcatgccgcgccctcccagaggcccaccttcaagcagctggtggaggacctggaccgtgtccttaccgtgacgtccaccgacgtgagtgctggctctggcctggtgccacccgcctatgcccctccccctgccgtccccggccatcctgccccccagagtgctgaggtgtggggcgggccttctggggcacagcctgggcacagaggtggctgtgcgaagaggggctcggtggcacagcgctcaccccgcctcccgccagcaggagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggctttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaacctggccctgtgctttctgtctccagttctgggataggggagggaggggtcactttgccaggtggtcccagttgcgcgggatggatgctggcagcagcaccgaaagtcactggtgggctgggagccccaagagcaaggaatgtttatgggaggggcctggcggaagggagcagggtgcctgggggtgcactgccctggctgctcccagcttgtgggttcctgaggtggtggtggtggtggggagggtcctttctcactagctctgaggcagaccttctctcatcaccccactcctggcatccgccttcccagtcagctggggagctttctgggcatccctctatggagccaaaagcaagcaaagccctcatggggccctgggggctacacaggcggtcactctcctccagatcagctctctgccctcccaggccgggcaaccagtgcccccactgcc

SEQ ID NO: 12991 - DNA, 12117 bp, Human
actgactttaccaaaaatttcaacaaaaaaaattagccaggtgatatagtgtgagcctaaagtcgtagctacttggaaggctgaagcaggaggattacttggaattcaaggctgcagggagctatgattatgctactgcactccagaaggagaccctttctctagaataaataaatgtgcacttagtaggaatgcctgtatcatggaagaaactcaataaacagtataaaatgcatcttagttaatttctagcctatgtatgctctgataggatttatgttacatatgattcattcaggcactggtgttcagaatgcaagtgtgatgataatttaatcagagctgcaaaggtgtgttctaaatactgcataaacctaatcatctttgtctccacctttctgaatgctctaaatacccataaagaggtgggtgtggtctccacaggttcttataaaaggacacggaagagacaagctcagttttctctgaaggagaaggactgcacttagaactgcattttggcgacctctgaaattcagtactgcagtgaatgagcttctgatcttgaggtgaacttaacaaaattatttttggaaaaatcgttgtgggaaccattaaaagaactccagggtgagtgaaacatattgataaaattatatcatctttcctttacacaataataaattagagtgttaaaaatatctcattatctgaaatctacacaatgataccatttgtaactcatgttcttactatagattttatgaattataaggatactaattgttgttattttgtgctttctatgattgtttaatatagttctgaaaaacttaaaatatctagtgtttgctgcaacagatatgtattcataatgaatatatggagttgatacatatatgtacacataggtgtgtgtgtatatgtatgtaatgagtgtattaatattgtcaaattgaattgagaagacattaatgaatgatgaagttatttgctttcataacattcaggttttagacatgactttaaattagtaaggtaatgatgagcgatgcaaaatagtgaaactaaaacaatgagaaagctccccaaaatatcctactttagaaatcaaaacacaatttttcgaacaagtaaatttataagacctaatatggtatgtgattgtgattgtcatctcacttgagtctcaatcttattaaactgtgaaaaatttcttaaaatgtcttagatgagttctggaaaatatttgcaattctaagatttttcactgctttcacttaaattcagaagtgatataaaactagcagctttatgctgctttatgctaaaggatttaaaattgccaaaacaaagattatagtttttatattagtcagggttctccagacagaaccataggatgtatacatatatgtgtgcagatacattcatgggccatttgagtcagccacaaaccacatatggtggtcccataagattataataccaatatgtttactgtaccttttctgtattcaattatgtttagatacacaaatagttatcattgtgttacagttgcctacagtatgcagtacagaacatactgtacaggtttgtagcctattgtaggaacaataggctatagtgtataccataggtgtagtaggctataccatctagatttgtgtggtatattctatcatattaaaacaatgaaaccgcctggctgggcactgtggcgcgtgcctataatcccagcactttgcaaagccaaggcaggcagatcacttgaggccagaagttcaagtgcagcctggccaagatggcaaaaccccatctctactaaaaaaatacaaaaattagccaggcctagtgtcacgttcctgtaatcccaggtacttgggaacctgatgcaggagaatcgctctgaacctggaggcggaggttacagtgagccgagatcacgccactgcatttcagcctgcgtgacagaaggatactctgtctcaaaaaaaaaaacacaaaaaaaaactaaaaacacctgacacatttctcagaacatacatctgtccacaagctatacatgattctacatgggacagaattcatcaggaaaattaatttgcttgattatggagtctagagagttccaatataggctgtctctaagctggtgtcctgagaataccggtatcctggctaagctcaagtctgaaagcttcagaacaagtttcaggagagagatggaggaagttgccttttttctgcctttttctttatatctgaggtgtcagctgattggatggtgcccacacacattgagagatgaggctcccactcagctcaccagctcacatatctctcttctctagaaacaccttcacagactcacccacaaacaatgcttcactagttccctaggtgttggttaatccagtcagactgatacctaaaattcaccatcacactatggaaatataattacacctctctgagtttaacaaaaacctcctatatgttagttcagagcttgcacagccctaggggaagttaatttaatccgcaagaaaataaaaagacccaatatctttaataatttttcttttccctactagtgaaacttgattagtttaattgcagtctttttctttgtttatttggttggttggcttttttttaaattttgttttgatttgggtctttgtttttaatttaatttaattttaagtcctgggataactgcaggacttgcaggcttgttatgtaggtaaacttgtgccatggtggtttgctgcccggcttttgtgaccctctataaaaatatgtcatagaaccatcttctcatatttctttggccatcttctcatatttctttggcccgggtagttttttccctcccactctttcacagtcattcatcagttattgaaagaagaatagggacaactatgatttattctgaccacttagaatcaaaacccaatttccagatctatgttcagaaaatgggtagttgaataggttcgtattatgctacagacaggaactaggagtagaagggactgtgagtgctctagttagtaatatctgttataaagccaggagactccctctatgtgtaaatttttaagtttgtaacagaagaaatagtttgttgtactttaatgaacactgtcaagagaagaaaatataactatcacatatctccacatgtttagaagcttttcatcaacccaggccccaaaatgacatgtttctctttgttcctcagaaacatgaattctggaatcttacaggtctttcagagggaactcatctgccccatctgcatgaactacttcatagacccggtcaccatagactgtgggcacagcttttgcaggccttgtttctacctcaactggaaagacagcccatttcttgtccagtgctctgaatgcacaaagtcaacagggcagataaacctcaaaaccaacattcatttcaagaagatggcttctcttgctagaaaagtcagtctctggctattcctgagctctgaggagcaaatgtgtggcactcacagggagacaaagaagatgttctgtgaagtggacaggagcctgctctgtttgctgtgctccagctctcaggagcaccgggatcacagacactgtcccattgagtcggctgctgaggaacaccaggtaagtgatggctctgaagatcgatttctgtaaaggatgcataaaattcctgtgggtctattttcttggagattggataaaacaaactctgagtccctttaagcagctctgtttgggctttcttagcttccaacctctgggctttgacaaacatgaagggaaacaaaggaaatgccatttactaggggtttatttgtctctcattctggggcccctccctatgtcatggtctgcactggtgcttcaatttatggctcttttgcaggagaagcttttacagaaaatgcagtctttgtgggaaaaagcttgtgaaaatcacagaaacctgaatgtggaaaccaccagaaccagatgctggaaggttagtcctgtactactctaccttctccaggaacttatggtgggcaaatgggtgactcttaaaataggaactggatatcaaactgtaatgtttctgggattcagtaaaaaaaaagaaaaaaaaagcgagagaaaacattgagaaaaagtggcctcatttttatatagaatagtatgcctgttaggtaggatttctaagaaaactactgatgtcacccaaagcatgctggtttgtttcatacaaaccatagttatacaccaacagatccaagaaactgggccatcacacagcattctatatttgctggttggataaatgctaggcaaaagggttatttggcagtcatggaatgctcagctgaaacttctgagtgtcggtcagcattaatctgaatgctagtgtgcaagtagtatttgaaattgtatggaaaatttgaggcagaaaaagtgacagggcaaatctagggaaaccatgaaattaagaatctcaactaattaatattgaaaaatacataacatacgatgagaaaagtggtgagaaatacggatttgtgtcttgagggagacatgtaaacatgccagaaatatgggaactagtatctaaatataaggagaactctgaggacttcagaaaaacattaaaaataattttctctttgtggatgtatattttgagggaatgatagctaatattagtttgttgaaaagcatttcatgagaacctagtctacgttgaatattaaattagaaaatatactagtaaagaagaaaggaagcacctttgtcctcacaaatcatacaatccaaataagagagtcaaatggtcaatacacaaatatatgcaatacatgatgtatttgagtgtggtaggttttttgttggagaataatcaagcagggaagtagaaaaggacaatggaggccagaaactggagattagtgtttgagttttaaatagggtggtcagaaaaaagactcactgaaaaattcaaattgaaacaaagttttgaagaggagggggaacacaaatgtgtgtgtggatatatatgtggaccatgagtgtgtatatgtatgtatgtgtgtgtggttgtgtgtatatatatatatgtatgtatgtatgtgtgtgtgtttgtatacatatatatgtaattctagttggagagaatagcatatgcagtaattttgagtttgtgtatatttggaggccagaggaaccacaaagaagtctatgtttcagattgggatgacttagaaaaagaatagaaggaaatgaattcagggagacaaagatggccaaatcataaatgcagccttattaggataggttttgctgagcgaaatgcacttagctggacatgctagtctaaggtcattttcatataatgagtttaagcaacttgttgcatatctcagaaatagaaataattgtttcctttctagtaactatagccctatactccaactcttaagcatgaactcttcttacttttccataaatatgggttggaatagcgaaattcaaattgtgtttttttattttcaactatcttagaaaacacattatcttgaataaatttaatgtaattggtcagatacagctatgttgatctttacgcagaaaaaaggaaaggaacaaaatttgtagattctaagaactggcaagacagaggtttgaactattggacattcgagagacaaaaggaatcagtgagatttaataggagatggatatatacatttctcttttgactaacccattatcactgcaggattatgtgaatttaaggctagaagcaattagagctgagtatcagaagatgcctgcatttcaccatgaagaagaaaaacataatttggagatgctgaaaaagaaggggaaagatatttttcatcgacttcatttaagtaaagccaaaatggctcataggatggagattttaagaggaatgtatgaggagctgaacgaaatgtgccataaaccagatgtggagctacttcaggtaaaaactcgccatgtggtttcaggtttttgaatattcacatgtataagtattttcctcatggctgaaatccatctccctacttttatttccatgatgtgtttccaaaaacacattcacataactaatgctactttgttgggagagtatagccccactaagggattctaccaggccaaaggtccctcctactttatccaccagccacaaaactttgtggaatggtcaaggtaacagccccaagaaatattccccatctaattcaataatatactttgggttgttaaacatgtatagaatagtgagtgattcatttacatttaggttaatttgtaaacatggcaagatcagaagttttgggaatctaggtttgcattaacattattttggggtccactcatttgggtaacaggttcagttaaagatgactgagtaggtttttcatggttaccacagaccatagaccttctgggcctcttctcccttcacttgtttagagaatgtcttcaagactcagactttcccaggacgttaattaataacaatacaactgactgggtttttcattacagaagaaatgaaatagaaaatactttccagaagagaagatggtaggggaataatatcttcagaaactgagtacaaatctcacactgaacttagtgaaagatgcatcttgtgaaatgcactaaatctctcttttttttttttttttcaggcttttggagacatattacacaggtgagtgtgtacctagattttagcatatgttctttaagattccacgactatcaaagcaggctttattaaagtcatggcataaagtcatggcataaataattaagatattgataccactttttttttgcatctactttcgttcccacaccttaaaagacaaggccacgaagtaaataaatgaataaaagaagagtgaactaaaacaaacaatttgattcctgatttttttttttttttttttttttttttttttttttttttttttttttggaaagggggtcgggccctgccccccaggcgggggggaaagggggcgatctgggcccactgaaagccccgcccccggggttcacaccattccccggcctaagccccccgggaacgggggataaaaggggcccccccccaaccggggaatttttttttttttttagaagagagggggttcccatgttagccaggatggtctctatctcctgaccccgtgatccgcccgcctcagcctcccaaagtgctgagattacaggcgtgaaccaccgcgcccggcccctgattttgttttattgcttgaaagcctgcacaggagaaagataagagttttgttttgtggatggtgagaaagtcaccagaggaagcaggagagaagaggaggaagtattttagcagtgaaaaagtgttgatgttttgttttttatacatatatacatatcagttaacagttctgaaaaatagattgaaaaaaactgtggagtgttagaactgtataagtctctagggaagttctttgctaaaaggggagagaacaagtttccattctttatcttgagaaggaagcagtggatgcatcagtctccccagaaccccgctatttcagacaaagatgtcaggggagtctgccaagaagtggaactcagaatttcgtttctaaatattctcaaggccataaagctaaggaaccttacacatttggagcaaaaaaaaaaaaaagaaggatcagattggattctggcttagattcttccatcatgctttaaaatttagaaactgtaaagaattaatttgcaaaaggaaggattaatttttgaattatcaaatgtgtagattcaaaggattctcatgaaatgtcttttatatacaaatagtgatttttatttattttatggctgtagatgttgtaactgcaggtttttccttgcaggagtgagtccgtgctgctgcacatgccccagcctctgaatccagagctcagtgcagggcccatcactggactgagggacaggctcaaccaattccgaggtaagtctccacccacaggcagcactcccactatctaaatattattattgttaggatcacataggtaatatttcatattttatcaaatattttacttcttttaagacataagtgaacaatataaccatgcaaccctttggtatccgtgtctgtatttacagtcagatttatagcattaagtttgaaagatagtgaaaaagaaatactttctggcataatatgtactgagttatataacgggaaaaaggagtagtgtagaaaattttaaaaaggagcaaatgaaataatgctcagaatggtgaattatttaatgttaaatacaaaattgtgcatttctttagtgtattcatttgaactgctaagaactgttctttaggggaatatagttttctggagattcttgggggttttgtatttttttaatgtgtatatattattcatatattgcaaacatttgaattaataggtaaagctaaaaggaagaaatcattttgtgaatataagtaaaattacaaatgaaaataagttcagtttaattgcaatatgaagagctacatgttaagtctaaaatccagcttcagcccagagctagcatggaggacagcagagagactggtcaaagattttgcagagatctgctttaaattatcacttataacatgtaaatatggacttttatccagatacctagagcagttcttaagtgaaaatcttcacattcacattctttccaaaatgatagcactagtttttaagaataagaaacatttctaaataatgatcttgataacagcattacatttagggcatacaatgtataaattttactttgaaaattggattgaaagaagttggtctcacatttggctctcaatatgtttttttcaaaaaaacataatatctgtggttagggttttgtttgtcttgtatataatattaaccatctctatactttactagaagttacaagcaaaactttttatgactttacatttgctggtaaagtaacttcttgatagacaattatttttttcttatttacacgtctatgcatgttttctcttttttttgcagtgcatattactctgcatcatgaagaagccaacagtgatatctttctatgtgaaattttgagaagcatgtgtattggatgtgaccatcaagatgtaccctatttcactgcaacacctagaagttttcttgcatggggtgctcagactttcacctcgggcaaatattactgggaggtccatgtaggggactcctggaattgggcttttggtgtctgtaatatgtattggaaagagaagaatcagaatgagaagatagatggagaggatggactctttcttcttgggtgtgttaagaatgacattcaacgcagtctctttaccacctccccacttatgctgcaatatatcccaagacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtatacgtattggttctttattaaataatttttgaaaaatcattattcatgatcatggcatacagtatattctcttttttttctttatttatgactgtcactgagtgaaataatagatgacagacatgtctgaatgaagtaaaaatcaatggaagacagtcgggatcttttgcttcatgcaaaaaacttggagtgaagtctcagtgataactgggaaatgtttttcttcctctttatctaactatattacacttatccatcaggtttcattgtattaatctatcctttgaggtaatactatttgaccttctatgctgggctttattttgcaattctcaccacagatatgaataatccttcattattagtgtgcttgtctacattgaaatacacaatgtgatcagaccaatgctggattaattgaatttttttttaaagtaactaaatattgactcctacctcaaaccatacacagtcatttccagatagtttgaagtcctgaaaggaaggggaacctgatacaatattctcataaggatttcttaaccagggcacaaattaataattaaaacaattagttcatttatattgataatgatgacttctgtgtttcaaaaaacattatgcaaactagtagtggagaaagatattcaccccaacatacataaagtaaaatataatacatgtatatgatgaatacttaaattgtaataaataaaagacagtgaactcaacagaagattggctaaaatatctgaacagacactttacagaattggatacataaataactagccaaatataaaaaagtgctcactttcattagtcttacaaaagtaagaattaatccaccagttgtaccacaggccctcataaaaaaataccaaaatttaaagacacacaatattgtgtgttgtcaaagatacagaataaatgaaatttattcatggctggagagatgtaaatggaaatcccttttgggaaactgactattagcatttcttatgggctagatattctaattctaaaatatagtcaactgattgcctacatatacttcaacatacacaatattgttcactgcatcaatttttatagtagctccaaattagacccaaaatattcttcaactgtagaatagctaaataaatttggtgtatttatgcaaaataatcctataaaacaataaataactcactgaatgcaacaaagctgatgaatctcagaaacaagttaataaacatatgccaatttaaacgataaaattgaagttaagaaaagacttttccatgtatataatatgttggtaattgtaagctctttatgggttccataattacatgaacgctgtggaattataacttttaagacccaaaatgtcaaataatgcataatgtagtagaataaaaaaggagcccaggcatggtggcacacacctccaatcccagcacttggggagaccaaggtgtgagaatggcttgtggccaggagttccagaccagtggaggcaacatagtgagacctcatgtctactaaacattcctttagaaatcagcctggcatgatggcacatgctatagtcccagctactcaggaggctgatgcagcaggatggcttgtgcccagaagatccaggctgcagtgagccatggtggtgccctgcagtccagcctgtgacagaatgactgtctgtctcataataaaacaaactataattacttgatataacacaaaccaatatattataaatacgctaattataggtattttaaatattgatttatttaaaataactgagaaagctgggatagctacatgtttgcttagactagacaaaagtgccttgggaagtaagtttaaagtatttttattagagtaagtgaggatgaagtgcttcattacaaatgtgatacacaccagaatctgctatgaatagtctcatgtctagaagatttgcggatatctaggtaagcagtaattattgggtgcctgaagcctagcaggtgcatattcagtgtgtcttctctggagatgtcttctctggaaagtttgatttttttttattatactttaagttctagggtacatgtgcacaacgtgcaggtttgttacaaatgtatacatgtgccatgttggtgtgctgcacccattaactcctcatttacattaggtatatctcctaatgctatccctccccctccccccaccccataacaggcccctatgtgtgatgttccccttcctgtgtccaagtgatctcactgttcaattcccacctatgagtgagaatatgcactg

SEQ ID NO: 12992 - DNA, 17879 bp, Human
gacacaagacccagggagtgcggtacagagccccagacagagaggcacacccctgataaaatggtacagaaaccaagagaaagagactcgggggagctggggtgggggggcggggactgagacaccagggaggagagactgaggcctagagagaagaggagcaaagactcagaaggagggggacagaatcagagacccaggagggcagatttacaaacgaggggtcggagactcagaggggtgggaacagagacggcggcacaaatactcaagaagggagaaaaagagacgccaagaaacccagaaacgggagcgggggtgggatggggttgggaggcgatacgaatcagccgccgcacctgcagcaggaagcggcgggccagaaactgtgctgcccgagggcgcccgcagccccctgacccgcccccttcgctcccgcaggcgccgcctcctccctccgcagccccagccgcagccgctggccccgccccagccccctgagcctgcgctctgcctctcggagcctacgaccgcccagggggcggggacggcccgctccgaggcggtcccctttttctggccccgcccctcactccattcttccccagaacccgacctctgagactcctagcccaccccattttttatcggtcctgcctatattgcctcagtcttgacggtgcttcctggcgctttggcctctcccctctcccgtcctctctgcctccttgcgtgccccctcctcaccagtcctcatctaccctcggtcctccaatctgcagtccgccgcggtgtagcgttcgttagaagttctcgcctcgccctttgagaccctgtgacctttaggcagtgccctctcccaggtcttctgatcccgaagactccccgttccaggtccctcccctccatccagcccagtagctttgtactctttgtagtctcattgttcccctgggatccacctctcccgttcctctaccctcccttagccctgccctgccctcgcctaccctggttgctttcaagaccctcaagccccgctccttccttagtctctctttcctaccgcccattcaagacgttttctttttcttttatttatttattttttgacacagagtctcgctctgtcgcccaggctggagtggagtggtgcgatctcgactcattgcaacctctacttcccaggttcaagcgattctcctgcctcaacctcccgactagctgggactacaggcacccacaaccacgcccgactaatttttgtatttttagtagaggcggggcttcaccattttggccgggctggtctcgaactcctgacctcaaatgatccacccacctcagcctcgcaaagtgctggcgttacaggcgtgagccactgcgccctgcctcaagacgttttctatttgtcgaccccactcaccttcctcagtaccactcatccatccggacactcattctccgggcccagccccgactaaccaggcccgccttggagcctcagccccgctccctcccttaggcctatccagaccctctcgggtttccaggactctctcaagtttcaacaccttctcaccgagtctaagtctttgttcttcccgtgtcctctttcagtccagcctgtcccccttgcgcgggaaagtcctccatctctagttcccgccccatgcagtctcatctggaccgtttctactttctgcggccctgtctcttccaagcaatgctcctccccaccaggtcctgcctagcggtgttttaggtgagggcgtgcgatctgttttgtttctctccgcccctttctcagcccaatcaggacggcctctctcatggtggccccgcccctccaggccagtcgggcgtctttaaatagcttggatgtgtcccctcctccctctaccccgcccgcacttttttcagttcagtaaggtctctctctatcgtatctagccccgccttcccctggctaccagtgctgccgaacacaattagtagtaaccggtcccgcctcccttgacgccccgccccgcccctcctccctgctctcttagaaagagccaatcgctccgtctcattggcggccccgactcgtccagctgggtcgcgttagagtgcccgccccactcctcccagccacagccccgccccacctcccccaggccaatcagtttggttcctctcccctaagccacgcccccgttacctcggctcctcctcccacccaatcccgtcggtctctcccccggtgtgcccgcccttgcgtctccgcaccctcccgccccgccccccgtccaatgctgagctcagtctgcgtctcgtccttccgcgggcgccagggggccagcaagcagcagccggcgccaccgccgcagccgcccgaggtccccgccgccgcctaccgcatgcacgcgcgctagacagcaagcagcctgcgcagcccggccccgccgcgtcccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccagggtgagcgcgctctcggggcccccatccaccccacccccgcctctccaggcgcccccagtctcccaggagcgccccagctccaaccctccgggtccctctaggcttctcagtctcctagaagcctcttccccaatcctgagtctcctgggctcctccgaacacacccccctctcgcagccatcccccagatcctccaaagacggatctccaaccttcgggctcttccagacccctccaaagttccccctcccccgccaaggccaccctagacgcttagacacttcctccagaccgtgaatctcccgtgcttctctgaacaacccggtccccacctttcctgggctcctctgagaccctccccaaccctcatgtctcctgggccccatcaaatctcttctcactactcttggtcaccgtccagcccttggtttcttggaccttccccagcccctcagaagacatcccttctcagccctcaaattctcctaggccctgtgagccctgacccccactttccctgccttctccagactctctggggccccctattcaactctcagtctctcccagcacctccccgattcaccccgtggcccgtctcccagaagacctctctctccaagtttgaatcttctgattattttttccactcccttcctgcagtatcttctgctctcagagtctcagaaaactcccccaccccaacctcacagccttctggacccctctaaacctccacttgttcttgcctggacattttcacctccccctcactgcaatactgagtcttggggcatcttctccgttggaacctccaggccccctctgtgttcactctgtgtttaacactcttcaacctccacgccaactcccatctcaaggactttccccataaagctccagacttcccccaagcctttcacactcctcctcagtgcctccagaagcatcccatgcccccatcatatgcctttcctctccagaaccctcacatgtcctccagaattgttcttcctcctccatagatcctcgcagcttctcctctccatcattttaactgcacagtgcactctctatccctgggactccccccatccaaagcccccacagcccgtttcctagtctaagtgactttccctcctgctctagaactttttctaacctcaaaccctgggaggcccctcaagtcatcagccctaaaactttcatctcaaaataacttacaattctttctaccttgccctgggattccttccacctgccctcttcctttctcgaacctccccccccgccgtgcaaaacccagaacctagcccctcagtctgtccccctccatcaaagtgaaccaaagagccttctctctctctccaaattctagattttccccaaagctctctccatcgctcccagaaaactttcctcaagcatccataacttcctaggctaaatgactaccctccccctgggttctctcctgaaccatttcctcctactaacttcctccctgtcccggggaccccggagggagaatgtggtggaaaaggggggcagtgcaaaatgggggcaattggaaatgggggaaataagagcgatcccaagaccccctcctgggctcctgggtacccaaacacagaggagcaggtcttggccccctccccccaccgtgccgcgtcctgagccgggaaggacgcggagccgcagtgccgcattcgcgccgggggagggagcggggggacgcctggagccaccgcataaagtttggtccccagaaagcgctgagttggcgagatttggggttggatggggggaggtggggaagaggaggtgcggaagggacatggccctggatgccccctcaagacactgagcggctccttcccccatggccggggcgcccttctctcctgtgaccccattgaagggtgctgagatgaggagcgggatgaagttagagttcttctgtgatggtcaggctaggtgttcgggacagctacgggagatactcatttactccgccaatgtgttttgggtgtccaaggtgtgccgagccctttccagcctcccagtgatatggcttgagagagttgggagctgaggccaaagcaaagtggagggtccgaccctacagccccctgcccccgcccccttcctcgtaatcactcctttccttcttacagagactccatgccctcctaccccttctgcttttgacacactctggagtaaggggttaaaccagcccgacgccgtccagcctctgcagctgcgcactgcggcgggtgcccacctttccctgtgccctgggagggaaggagttaattagactcttggcccttggcctcccgccggaaagcagcaacactgcggctgcgcgttgaataggctccggcccggaaggggttaagacggcccctagccgctgcggctgcgcactgcggcgggggagctgtccgcggtactggccgccgtgcgccccgccccccggcccggctggcccgcccccactgcggtgccgcagctagcgccgcgcgcccggctcggagggggcggggaactaggcatgcgctctgcgaaggcctctggcctcttaaaccactgcagagaagcgaaggtgggggtggggggggagttcagagaggacctgcgccggcccccagcccaccccaacgtccagggtcctctctgtggccccgaaactctccacccactacttcccagctctgcacctcagtgaagtcaagcccagagcccaacccctgtggaggaaggggggtgcacagagggacagtgctggcccttggcccaccccaaagtccaaggtcctctctgtggtccagcagtggcctccccgtgctctgtgcccctgattaatagcaaaactccccatgccctccctcctccactacccgcaggattaaaaccctctctttactataacacctgtcttccttccctctccaatgcactcctctcccctcccacccctctgcatatctgataaagcccatgacatctctaggggcctggcccattgctttccttctccaagaccctgaccccactccctcctcttctaggccttcatcaaaacccacatcactgtgtggcaggactctggttatcccccatcttgaaatggctcaggacccttcacccctcattctctgcccctttggcaaatgccctaacttctctttggccctggctctgccttttcccacaatgtccaggccagtgactctccttcctcttcagggccctaaaccctgcctgactctcctcttttatctcctcttccatttttgcaggcttaacccttcaacccctcctcccttaagggcccggacccccacctcccctctgtggcaccaccactgccctgtcctctctgggtgaggccttgaccttgccccccaactaactgctgcctgcataccctaacaacagctcaggtcttcttactgtgttccaggcactgctccaagcactgtgtttggagccaagtccttcgtacgctcatctaatttaatcctcacaacaatcccactacaaacttctggttcagaaagctcagtctccttgcccagttttgacaggttaaaagccagattcatgcccaggctcgccgactcttaaccacctcacgattctgcctccctgcccgccttctcccttcccgtctgcccagctccaagctgagccctaaagcctccgagacacacaggatgtgtgatcttaggcctggcggctcccgtcccacagcagaacccgtggaccctgctggggggccctgaaataggacacagggaacaggagggtggggggaggtggtctaggaaacagcaaggggccagaaatgtttccaaggaaagaagctgcccatctgctgcgtctgctggggccagctcttctccaactgcctctgttcctttctctccctttttgctagctttagaggggagaatgggattctggaagtgatggagccacagggctgagacacctggattttgcccagagtttgggcccaggaggctggggaagggggcactggaagggtcttctggatgttatggccaacctgatgcctaggtcacctctccccctctctctccctccctgccctgcagtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcaggtgagcctgggcgtcagggatcgggggcacaggtggagacccggggaggactggggaggtagctgccggggttcagagaacctggggtggttggcgtcgaagaggtgagggagaaaaaaaccaacagcaggagctcaggcgaagaaggaggcacagataatcacacagagacataggtttcatgggaaagagttttggggagaaacagatttgcaagatattcagaggggctggcgaggcagaggcagtgtcatcagctgtgcagagagagggacccggaggagcgtggggctcagagagacacagaaagagggtctcacaggaatcacaggcagacccgaggcagaaccccagggaacgtagcagcatctgagcatccgggagacagccctgagggaagagagactgaagccgatagggtctgaggcggggagtcagaaaccgagagattgtcatggagaccagagagagatgggatgtagattttgggcggaggtgggggcggtcagcggcagagagtttgggttctaatgacagcaagcccaagaggcagacagacttcaaaacggagagtcaggccagggcagatcccccagggcagaacggaaaccagggcctggtcagtcggctttgctgtgggcagcctgggagggtcccaaagagagatccagagaggtgctgctcagaggaagagacaagcgagagatgagggagaagaaagttacctgtgcttctgtgtgtgttcctcccccagggggtgtctatgcctcagaggcagtggcttgggagtctaggaggaaggagaggctggtggcccccccctgcactgccccgccttaagtaggtcaagaaagggagctgggccacttggcccccatcttgctccctcagccgctgacccagtttcacaccagttaaaaatagctggagtcagagcctaggggacccccacgtcccacctcccatctctcacctaacctagcccttccccttggtgcccttcccagagcccagcactcttccctgaacagccacttcctagcttgccacatcctctccagccatgcctccacccgctacccctaccccagccaagccccctgaagtttgctccagccaaccaccccccaacactgcctcatcttctccccgacacccagcttgcttcatccgcaaccatctctctcttttttttttcttattccaagacggagtctcactctgtctcccaggccggagtgcagtggaaacatcttggctcactgcaacctccgcctcccgggttcaagtgattcacctacctcagcctccggagtagctgggattacaggcgcccgccactgtgcccagctaatttttgtatttttagtagagacggggtttcaccatgttggccaggctggtctcgaactcctgaccttaagtgatctacccacctcggcctcccaaagtgctgggattacaggcgtaagccaccacgcctggcatcttttatcttttatcttttttggagacagggtctcactctatcacccaggctgaagcagtgaaactattatggctcactgcaggccgacctcccagtttcaagtgatcctcctgcctcagcctgcagagtagctgggactataggcgtgtactactatacccagctaatttttctattttttgtagagatggagttttgctatgttgccagggctggtctcaaactcatggcctcaagcaattctcccacctcagcctcacaaagtgctgggattataggcatgagccaatgtggccagctccagaccatatctttaaacagcatcccaccccagtcctacccttcctggcaccccacacctggcaccaccaccacatcccagctctcaacacctccctgcaccaccacaatctgtccaactccctgtccagaccacccttcccaactgcagtcgcccttcccagcactcaacccccatgatcaccccccagccgcgcccccttgataccctctcccagctgtgccccctgccaccctcctggccactccttcccatcaccctgcccttgaatctccacttccagtgccaaacatccgccgaccatcccagcatctgctcctcgcagacatcttgccccaccgcgtgttcaccgcacctcactctctcctttgtctctctgtctgacccccttgggatgcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaaggtgaggtgccccccctactgatcccctgggaccctccctctctctcccctgcccaggggagggaggagagggggatgggggaggaggcggtggacttcccttcccccttcccttggccccaaactgcctccctcccagatcttccctgtacccccgccccaagtttcctcaccactgacccttcacctgtctttattccatgtccattccccccaactctctggcctcttcccccacccccagccactggtgctcccccactgcccccccaagactggcgtaagccaggccccccaagcttcttgcccgacctcaacgccaacgccgcggcctggatatccccctagtggacgaaccccctccccccggggtaagtagcccccaccctctgatcccccggacccccagactccccactcctgcctgactaacccttctgagaacatgcagcccccactgaccgagacttcggccccctcactgcaagcagctgcacccagttaacccccagctcctgacactgaccccacacccacctacccaggactcaccctgctcctcactaacccccgaactaactcaaccctgcctcccacactgcacctgccctcacgaccgaccccatcctcacccccatcaacatctctgcctccctccttggtcctagggttttttttaaaaattcaatcaggaaaacggagggcatacccagaacacttctgggtgcagaatggggagagaaaggctcagccatccgtccatgcccctgtgaattcagccagcgcttagacagcacccacgcatcccaggtactgggcatggggagttcaaccgtgaacaaaaaccatgcccccaggagcttccgctttggagcaggaggcagacacggacctagaaagtcatggtttgaggcgatgtatgctaaaatggagggagcacagacagtgagaggaacactagaaactcccaggggatggggccgggcatcagggaagactcgatatctgcagtggggccttaaggttgagcaggagttctgaccacacgcagaggaagaaatcccatcgacaggaacggttgaagggaaccgcaggacagagcttaggagactagactgtggagggaggattctcaggtagatatgaggcaggcaccgggctgagaggctgccaccttgtctaggggcttggggaggaggcaggtgagctgggaggggcagctctggggtcttgtgaggatggactggaggtgggaggctggaagttaggaggctgaggtgacaggtggaagcgtgagctggggccagggctgtgaggatggagaggaagggacgaggccgagagagtcggggtcagggatcagaagggacagactgggggctgccggccatgcagaagtgagggggataagacagtggtgctatttagtagacgaatcattcagcaaatatcaccaagtacctaccacatgctaggaatttaacatatattctttaatccttgtaacaatccaagccaactcctagctcctttcattcatgtattcaatccattcattcactgtttcagcaactgattctttttttttttttttttttttttgagactgtcttgctatgtcacctgggctggagtgcaatggtgcaatctcggctcactgcaacctccgcctcctggattcaagtgttggggtctcgctatgttggccaggttggtcttgaactcctgggctcaagcagtcctcctgccttggcctcccgaagtgctaagattacaggcatgagccaccacccatggccacaactgattcttgagaacacagttgcaggcactacaaatttgggataaaacaaagcgtgaatctgccatcacggtttacagtctccagattgtaaggggtccgcaaactaactccagcctgagggcctgatctttcagcatctgtttttgtaaacaaagctttattggaacacaaccatgttaagccacgacagcagagtggaataattgggacaaagactatacagcccctatagccaaagagatttactatctggccttttacaggaaaagtttccagccgctcataggaagaagcagaaaataagcaattaaggctgggcggcgggggtggctcacatctgtaatcccagcactttgggaggccgaggacagtggatcacttgaggtcaggagttcgagaccagcctggccaacatggtgaaaccccatctctactaaaaatacaaaaattagccatgcgtggtggtgggcacctgtagtcccagctacttgggaggctggggtaggagaatcacttgaacccgggaggtggaggttgcagtgagccaagatcacaccactgcactccagcctgggctacaaatagagtgagactccctctcaaaaaaaagaagaagaagaagaagaagaaaagaagcaattaagataaagataaaagaacaagactattactctggccacttcagttaaagaggtctggctgggcacagtggctgccgcctataaccccagcactttgggaggccaaggtgggagtatcatttgagcctagaaatttgagaccagcctgggcaacagagcaagaccatttcctcaaaaccaaaaaacttaggtgtggtggtgcatgcctgtagacccagctacttgggaggctgaggtgggaggactgtctgagcccaggagtctgggaggctgcagtgagccatgattgtgccatggtgctccagcctggggggacagagtaagaccccatctctgggggaagaaaaggagttctgcaaaggactttttgaggaggtgacacagaacctggagggtgaaaagggccaggcaggcagaagaaacagcaagtgcacaggccctgagcttccctgggggagggggtggaggatgagcttggcttgttcaagggacagcaaggagcacagtgaggctgatcccagtggccaaggggagagggctgctggagtccagggagaaagatcaggacggattttcggccatggtgaggaggcgggactttatcttaaacgtgaagggaagccacctgaaggtatgtgatccatcatgcattcattcaacagccgtctgtggaatcttctttagaaatgcagagacacatcctaaaggatccctgtccacagcctaaggagatgccataggggaacctggggggcttccaggaatggcctcacctaaacccctgtgtttcacagacattcagggaaggccatgaccaacccaccaccccaggccacagagcacaagggccgagaccccaggcttccgggctcctagtccagaggggggactgtctggctcctcttgttccatccccccacctctcctttttgtaacctccccgtcattgtccatttccagctcattacccccccactcccctccctgctcctatctaactcctccccctgcttgcacccactcccagtcctttaccttcctctgttccccacccccaggtctagaggggcccctatgggattgagggggagagggtgtgggcctatgggtgagggaggattggggtgggggtggctgggtgggggaggtccctgcttctcttgcctatgatgccaaaatccattcattgaactcaaatcatggctggagctgatggggttggctgaagcttctatccctggtgccctggatccttccccctccagccctccccaagccttttccttgctgtccttcagccccacaaccctccctcccacaagacccctttggcctattgccccccatgctccttcccccaagagtctctcctaccacaaccttcccttcccaaccctttcgtttttgtttttgaaatggggtctcgctctgtcgcccaggctggagtgcagtggcgcaatcttggttcactgcagcctctgcctcccaggttcaagtgactctcctgcgtcagcctccagagtagctggaattacaggtgcctgccaccacacccggctaatttttggatttttagtagagatggggttttgttggccaggctggtctcgaactcctggactcaagtgatctgcttgccttggcctcccaaagtgttgggattacaggtctgagccactgcgccaggcttcttccctccctaattgtcccctatggtcctcccaagaccctcctttcctccaggcttgtcctccacccctgctcctccctcctacatctgccctcacctgatcactggctcccactcctccccagaactctccctcctcccatccttcctcctcccctccccctccccagccagcccggaagctccttccatatttgatgtctcagccgccccccatttcactgctcccctcccgcggaaaacaccagagaggaggaaatgatcccggcggcgtttctccatccccccaacagtgaggctgtgttggggggtttcccctgaccatcctctccccacccccgtgactctgtgtatttctgtccccagctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccacccccccccactgctcctggagttctcatcggattccccaagggcacttgccagcttcgctccactcagcccccttgcagaccccaccccctgcctgctctctttccctacaactaggtcagcccccagccccgctacggcggccgcaccgttccctgccctctccgctggctgctcccacatgcattccacccagcccctccccacgcccctgccgcccaccatcccgccttgctgccccccaccttttgcctcaggtgaggggaccagtggagggggggaagggcggtggactgtggtgggaatggggcgggggaggctcggtgggcaccaacctgcctcctaatccggagtctctcccccctccccgatgtctccccctttctcatcgatgttgactgactccccgatttgttcactttctctctccatctccttggtccatctctgtccatctgtctcttgtcatccgtccttttgtgtctctgtctgcctgactctgtctgtcttgccttctctgtctctctgggtatctgttgtcctccccttccatttctttctctctctgtctctttctccctgccttgggtctctctgtctgacccttccctgcaccccatcttcgtgcttcccccctgtgtctgcacacctccccaccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaaattatgccagttacatcttggggcacctccccccacacactgcatgccttccctaacctggagcccccactccaagtccacctcagcaataagccgccaggggccgcatgcgcgggtttgaggggcaggcactctgggaagggggtggcacctcccgggggtcgggctggcctttaaggtctccagccttcccatccttcaccccaggaggacaaccaaccctgtgcgttgattaggagaaaacaaaccagaaactagaaacagtgtaggggaaggaggaacagttacccaagccccagatcggagttgagctcaggtggcgggagggcggggccgagttgagctcaggtggtgggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctccccactcctgccaccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtcccttccctgagatggtgccccaaaggtaccctcttcacagacaccagtg

SEQ ID NO: 12993 - DNA, 55387 bp, Human
  misc_feature (1)...(55387): n = A,T,C or G
ataggataggaccctttcaaatcccacaactgaagatacctaaagaatgtacatctagagtcaggaagaaagcactctaaatgggatttaatatttaggaacccaagactggcaataagactgaagactacaacacgtgtaggccagaggagacagtggcctatactggggacaaataaagaggtctgtcctatttaagaaaatcaaccctgtaaaggaaattaataggactaagtacattttagtaattcctctaagcaggctctaaagattatgaaaaatagacgggacagcagacacaaaagcccttaaagagcatgatgaagactttctaagttatttcactggaagcctgatagtggggcaagtgtaaggcaaaattcttaattaaattgaacatgataagttgaattctgtcttcgagaacatagaaaagaattatgaaatgccacatgtggttacaagtaatgcagacccaaggctccccagggacaagaagtcttgtgttaatctctttgtggctctgaaagaaagagagagagaaaagattaagcctccttgtggagatcatgtgatgacttcctgattccagccagaggcagcatttccatggaaacttctcttcctcttcacccacacactgctccatgtacctgcaaagcctgttctgtctcaaaaaagttgtttggatgagccgtgacttttttttttcttaaataatgagacaaactccagaaaaagagaaaaaagcagagcagtctgacattccggcatcatcgaaatagtgatggcttttcctagaatgcttcagctaaggacccaaatactaatgatctcctcaaagctttcactttcttttactttttcattaatttcagtggacccccaaactttaagtatggaagaggacaaagaaggaagcttcagaggggcaactttgatttgactactctttttgtcactcttcagctcacaaaagagctcactttagttcaaaacacaaagtctttaagcccctccatagattggtcccaggtttaattttctatgatgtgtggaggcctcagtttaatgctccaacttgatagatgaaacacagttcccacctctacacatttcccctgtctcaggagttgtatatattctcagttgtctgtccaacttatgcccactctttgagatattaatcaaggcactcccttgataacacttgcatattattatcaaaattatgcaattctttctaatatcagcccacaaatacatctcttccattaaaagtttgacttaattatctatactactcatttgaaaactaacatagttaagttgtatttttagccatgaatttcagtttccctagctcactatacacagagaaggaacttttgaaataattgagatgatcaaaaatatttgctgaagaaatatatttctcctttttcattcactcactaattgagaatgtctttgcacaaaacacattgcaaaaacattttcaaaaaaattcctaatttctagaattgataggaaaaacaatatggctacagcattggagagagagagaaaggagagaggagaaaggagagagagagaaaggagagaggagagagacagaggagagagagagaggatagaggggagagagagagaggagagagacagaggagagagagagaggatagaggggagagagagggagagggagagagagggagagagagggagagagagagagagagagggagagagagagagaaagagagagagagggagagagagagagagagctctttaacgtgagatatccccacaatgaagcaaatcgcccagttatcaaagtgagctatccttaggagttgtcagaaaatgcatcaggattatcagagaaaagtatcagaaagatttttttttctgatacgttgtataaaataaacaaactgaaattcaataacatataaggaattctgtctgggctctgaagacaatctctctctgcatattgagttcttcaaacattgtagcctctttatggtctctgagaaataactaccttaaacccataatctttaatacttcctaaactttcttaataagagaagctctattcctgacactacctctcatttgcaaggtcaaatcatcattagttttgtagtctattaactgggtttgcttaggtcaggcattattattactaaccttattgttaatattctaaccataagaattaaactattaatggtgaatagagtttttcactttaacataggcctatcccactggtgggatacgagccaattcgaaagaaaagtcagtcatgtgcttttcagaggatgaaagcttaagataaagactaaaagtgtttgatgctggaggtgggagtggtattatataggtctcagccaagacatgtgataatcactgtagtagtagctggaaagagaaatctgtgactccaattagccagttcctgcagaccttgtgaggactagaggaagaatgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcaggtaagatatgctagatatacgatgtcagagtagggaggaaccttaacaatcacttcttcaggcagggtataaacttctcacctgaacactcattgcagcccccatcaaggacagaaatggtgccctgttaagaactctcaatgtatcttgtatttttcctttatagcacactttagatatttgtgtaattatttgtttaatgacttctactaggtttctaaactgcaatgaacagagtacttgattcattattgcatttcccagaacatagtatggtgcctttaaaaatggcaatagtgcattatgtattttgtgaattgaataaatgagtgaatgaatgaatatctggatgattaaaaaaacaaatgatatacactaatgtctctgaaaaataaaattattattcacaacaggattcatatggtgtacaaattaaaaatgcaaattcctggccttatcccagactaattggtcagaatcttcaggagagagtcccgagaaggcacaatttactaaatgtctatggtgattcttttaatcaggaatgtttgggaaataattattggattagatcttcatttttgaaagtatgaagatcctgaggcttaaacaggtaaataatgaagatggctaatattcattgaacatctagcatgtgcaaaccccgtggcaagtgtttttgtgcattcgttcatttcatgctcttatcagtctttccctattttagaggttataaaggtatcaggtaacttgtataagatcatacagctaataagcagcaaaaaaaaaatcacatttattctctaatagtccagctgtatgaccactgtatcctatttccaaggatgtgactgctgtgatatctttagctaaaggatctggttcattctgtctcactttttctttaggctgcattagaagttagctttctttctcagtccttgaaaactttagataaaatatgaagcattactatttggaattgaattcctatttcatctattctgaatttttcattctgaattaggggcaaatggtaaccaaagaaatatgtgcttaattatttatcattttaaaaccatatgttaaaggaatgcttttctgcctgtcttccaaaaatttctaatacagcacttttgactagcaatgctctatgaaattaagcccaatatgtgaatgggatgggaagaatcttgcactcaatttcccacaatctgcagttttgaaatgtagatggccttctccgcccaaccaagtttgtaccccatcccaatggagtctactgaagttcatttaaaaaatagccactgtataatttctggtgttattagtcagctatttaccaaatgtaatgggttttgtgcaggaaaggctagaaaaaatgtgcttggaaaaaaatctatttcaataagctttcagacctcctaccttaatctataatgtgcaaactctcatctagctcttatatcctctgttcctgtttaaaaaactgccaggattggacatgggattttcagtcagttatgatgctttatttaactatgtggcttaacttgacccagaaaggttggaggactgtctaaattaccaaaataagctgcaacatccacaggaaatcttaatagatagatacacattaatttttaattacatgagatgtgtaataccagatgctatccacaactgtatgagtattattttcctaattacttattaattgtcgagcagaactttttcctttttctctcttcatgaatgtgttcaattttaatactctctagaaaaaaaaaaaagtgtgtcaagtcagtaagccctgaactgaaattgatacaattatcaacttcaaccttgttctatgattaaattgctgtgtagaaacaggtttcaaaaataaaattagaaaacagagtggaaggaagatgactgaagagaaacaagcaaaccacagtttaagaaaggtgaaatgagcatttgctgctcacctactatgttttagtagtgtcaagggcttattagtggcaaaggtgacagtcaaaccccactcacattggctgtttccattccttcacacagcctctctggttacaaagtccttaaaatagttaagatcgattgcttacattgctttaattcagagttctcaatgtcaaaatcacctaggaagcttccaaaaaaccatttaaaaagtaaaaataaaaaactgttgcaaggtttttatgcacctaatttcttgccagaaattcagattcaggtggtctcctgtgaggttgtaaagttcaagagtctttttttttggcagtggtgcaatctccatacgctgcaacttccgcctcccaggttcaagtgattcttctgcctcagtctccctagtagctgggactacaggggcccgccaccactcccagctaattttttgtacttttagtagagatggggtttcaccctgttggccaggctgctcttgaactcttgacctcaagtgatctgtccgcctcagactcccaaagtgctgggattgcaggcctgagccatcaagctgggccttcaagtgtttgcatttttaaaccctcattttgtgattctaatgtgcagccagcactgagaatcattgagttaatggagattgttttggtatctttttactttcactttacaaaaacgcatgttctgtaataaacacaccattaatttgaatgcctttgtccaaattgaatgcttaaattaagaactagactatttgtgtgagatgagatcaaatagtttctagattgagttaagaccttccaaattagctaggctgatgcacctttcacataaagccttctttttttattggtttcagatatcattttacttgaccccaaaattgagatttgagagatttgatagcatttattaactctgagctgagagatcttcaattttatttagggtaacctgtgcattttattaaaaaactatagaaaagcctaaaatggtaggatgattgtccaaagtcacacatctgaggactaaaaccaagcggctctgactgcagtgctttttaagtcaacaatgttatttcttgtttataaggatccatttaggttcagaaggggtcaagtaacccgctaatttctgggtgtataatttgacatttgatcacgttgactcccttaaaattgtcctgccccagacaacataggcagacacagtgatgtagtccttttaatttatatcataatgaaaatattctgagacttttactgatccacctctgttactcaggtagagttgaccctctccccgtctttgtgctatcattgtactttatacagatttgtatcatagcacttgtaacttttcattacatgtagtggttttccagcctgtctgtatctgccagcctgtcagtcgctccaaggtggtgatcatttctaaatatttttgtatccacagagcacaggactataatatacacatggaacaggctttataaatacatgctgaatttaacatcaaagaaacgttagctccaatgctaacatacataaaatattaaactctgcatgggtagatttctaggaccattcactgcagtttttttatagcactggattcccaatgccaaggatacaacaatgtcaacagtagccacttactcaaatttgggtataatatatcttgtgtcgttctctctggtagttccatatgtatgtctgcgtgtgtgcatgcaaagaaagacaatacaagagagaagatgaagcaaggtgcaacatagctgagtgtgatttaaatgaagttaatatttattggtcagagttttctgttaaatatgttaaaatcaggtaattaatttatttggaaatattgtgttcctaattcatgtctgttgtttgctcatttatttaactcccaaagctttaaattaggggccatgtttatcatcaattaaaatagttcattatatttggaggtggagggttgcttaataacatttaagtacaaactacccatgctcaatataattagatctaatgttatgcaaccaacagatcagctagctacaaaaataaaaggggtatcaggaataggtgtcatcatgaacagaaacaaagaggaaaaaacatttcctagctgatacacatgagtgaattgtgaccagggaattcactcatcaggtgaaaagcacatcacatggaagcaaagagaagaaaaaaagtcacatttcagcagagagtcatgggttttaggtaaccatgacgacagctcagtgaaataacagcttctcttttttctttatgaaaaagattttgtggaatgtcatacggtttacattttttcccccagataaacctctaatgctataacaaaatctttgctcccaaaagcttttaatatctggcagtttattgctatttctttaaatttaagagaacagtatttaggttcaccttcctcattaatatatctatttcttctatctccccttttttctttgacttggaacacttgatcgtccccccagcatatgttataaatcacttgcgttgaaatagaaaaaaaacagagtcatcatcagaacatccaggctcaaattctacccctgccatttagtagacgacattggaccagttatttaaaatctttgacctttgttttttccaaagagaaaaaaaatgaggtagaattaccatctatacatgttttgtgtgtgtgctaataggaggattaaatggaatgggaaacagaataatgtagtggaaagagtatagtcttttcagtcacatcagcatgaatttgagtgaactttcatacttacttagctacaagaccctaagttacttaattattctgagacgatttttgtccctaaaattagaataatataggttaaagcattactgtgaagggattcaataagatgtgtttatatggcttgtttaggatctgacctattgtttgagtttcatgtgtggaaataatatatttttaaatgatacatcaaagttagatataataatgaatattcaaacagtgttatacacccaaagttaaaaacaatttggtgacctgcccaatggtcttgttttcaaaaataattatgatagttgtcattattaaacactttacacttggcactatgctaagtgctttatacatgttagattatttgatcattgatagaaacgtataattcccatttacagatgaaaaaacttaatacccagagagcttaagtaacttgcccaaggccatgtaactaatagggtcagtattggaaaccaggtctttctgactagaatcttcatgatcataagcacaatgctaatataatttctcctagcctgcctcctctcctgtatgcagtgtaaagactaaggtttggagtttttcaaattatttctggaaccagggtagattttctcctcgttagtaatacctccagtcatccgaacacttagtcacttggcagttggcatttcagcaaaaatagtttcattcaagcctctctaatttaactgagttggctgtaggagtctttaaggcagcaggatcttttgaaaatatcctgagattactcaaagaggaataaaaatgatttagtctacatacttgtagcgtccagttaacccaaattataaaagcatccaacatattacattcaatgtaaaagttaggttagttttattcaaccattcctaagccattaacacgtcataattaatgtagtgggtattgcttcagaataaggaaacttgtgtttcagtgctttggttttgactctaaatatcatatggccctaagacaagtcactcaacagttctagttctcaattatatatggataaaaggatttaggaacgttatgaggtataaggcaaactagaaactggcatttgttgaaacagaaattatttgttgaatagtttcttttcgtatattatgtcatagtacagtttaaaaaaattgagatttagcaagtctaaaaaacatgttcattgccagtaagaaaattagccagaattgaagttgcatctacctgtattacggagcccaattttttctctaccacacaatgcataaattcttaagttatgtcttagtgaccaaaaattaagagtaggttctctaagcatttcttatctaacacagtagcagccatctatggtggggggactgcccattcaattctatttgagatgactacatttgtttatacatgcttatagatagcaaattcagtgggataggaggaccaataaaatagtcttgattattttcaaatgtgatgcaaacagttgaccgggaagacattttaccttcaaattattattctatacgtctcgcctactgttcacaaaattataaatcataacatgggtctttatatcccgttagccttttgtagtcttccacagtctggcttagtatcctcatcatgaaaatagagataaaatcataaaaatccacagggtagttgtgagaatttctaattttaatgtatatggagatatctcccttatggcctaggacagagtagtgactcaatataggtttaaaaaaataagttctagaaatatattctatggtagaggtggtaccaacaacatgaccaagaaaaatgagcactcaacacatactttttgtaggagattctttggctcatccactgactctgttcattcatccaacaaattcttactgcacatcaacagggtgctagaaactgtactagattctgagagaaaagaaataaacaacaatgtgaaaataaatgtgtcttcatgaaggatgcgtttttataagggacgtaacaatcattgtttattagagacgaaaatgagtaagtgtaagttgggtaaagaacaatgttatctccctagtggccccaagcctcccacggaagcatgcacctgttgtgaacagtcaatgacggcagggtggactctcctgaatttcatcttttgcttcgaatgtatctctcactacctaattactctattttattaaatctaaggtatcaatgaatttaagtgatgcattcatttatgtaccactaagaaaaataaaaaaatatatttatcttaaaagccctttttggcttacgtagtcacatatttttatcatagtttattcttctgcctccatataaatgaaactacaagaaaaataatttggtgaaggattcctgaaatgtttttacattcagagtcagccccttttgagttacttttaaagtcagagtcaacaatgcctgtttttactaattatttgctttggccttaaagaatgggtaggatattagatgcatggcaaagagtgggcatgcttagccacaatcagagtcatggaatggagaagcacaagcagtgtccagagaaagtaggccatctgactttagcagcaggatcacacaggatgtgagcacatggagaatggttgcctgactcgagatattttttggaggtagaattgccaatataaaagcagtgccatcgcacaatgctccatgctcagaagcagaccctacatttgaggtttaatgatctgtggtcttggtgttgaaattcttattaatcttatctttgggtttgtgctttataagtgaagttatagggacaatggagcatatgcttggttcatatgcatcctgcagaccttttgttctttgttttcctgggatgggtcttggctaccactacccatccaccagccctacctagtttccacctcctcaccctctgcccaaggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctaccgaggctggctgcaccttagcacggtgcacaggtgattacatatagacctctcagccagtattatggactgaattgtgtctcccaaaaacgtgtgtgttgaatccctaatttccagtgtgactatttggaggtaggtctttaaggaagtaattgaggttaagtgaggtcattaacagtggggtcctaatccaacagtactcatgtcctcataagaagacaaaaaagacagagccatctctttctttgtgtatgcgtagagaaacggcaatgtgaagacagagaaaaggtttcctctgcaagacataagagaggcctcagcagataccttgatcttggacttccaaactcatgaactttgagaaaataaatgtctgctgtttaagccacccagtctgtagtattttcttatggcagcctgaactaatctacccacctactcaaacaagtcttagcatggaggtttcaatccctagggagtcacctattcactatagactgagactgtgggatacctattccctgtagattgagaaagtgaatattgatttccctacccccagccaaggcctcaacatttatctggtgctgcaaattgcatagccagtcctgcctagagcaccacaatatttacaggtaagacagacgaggaagagctagtaggacacaccaagtagtaacagcaagagagaaaggcaaaaatcaaaggggatgtgattatagaaatcagtacatagaggaatgtgttttgtgaaaatgaaagtggtcaactgtgcctaatgctatcttaacatggggacttgcagggataattggattttataatatggagtctttgaaggttcataacaaactcattggccaagagatgacaggggaagatgactagagtgcctttatgtgggaatgggtagccaggaaatggaattttcatttaagatacttgctaagatttaagctttaaatcatgtagtctatattcaaatattaactccccccgttttataaactataaatgtttgatgaagccacttaacctctataagcctgttttctcattgatgagatggaaatatcaaaagaactcctctcatagaataattgatttactgttattgaatttcaaaccaaagttttcaaatgtctttgtgtcaggcaccataccattacacaataatacatagtgaataggatacagtttatattttgatagagtttatcacctaacaggtatgtttataaagattaaatatatacaccatattgccttattcattgatttaaaaattcatttacaaaaatattagcactttaagtattgagtattttatgtaacttatcttctagtggagtaggtctagtaagtgtgtgtggtgagacagtaaaacattatatataatattttatttaaaaaagttaaaggagttaaaaaatataataagttatatatattgttttactgtctcacccactcacacttcctagacctactccactagaaggtaagttacataaagtactcaatacttaaaatgctaatacttattaaaaatgtttaagtcaatgaataaggcaatatggtatagacattaaatcttcatgaccatacttattagactgtaaactctataaaaataaaaactatgtttatcgtgttcagtatgtattcttgtattctggtataatgcctgacacatagacattttaaaacttcggtttgaaaagcagcaacaataaatcaattattctatgagagttcttttgattacatagttcgttagaaggtgctaagtgcacagataaagcagaaattagtggtgtacagtaaatgtttaataacttgttctcaatggaggagtgggaaagtagggagagatgattctgatttgccaattgttgtggtgtaaatactgacaatggtagatttccatctaatgatgggatactgctgaacattctaatattgagaagggttacacactttgaacttttgctagctagtgctaaccagctctacaacactgctaaagtgggtaaggctgaatatgatgttaaatagatgtttagtgtagatttcattaagataatgaagatatgaataacccaagcaggtatcaagggaaaacagtctacccagaaaaaataaccagtacaggaacatgttgcataagagtgattggtgagttttgggaagtgcaaagaggccagtgaagttatagaagagagggaaagggaaagatcagtaggaaataatatttgcatcagtctggatctcagtaggaaatagatacccaaaccaagttatattaagacagtttatttagaaaaatttgatcaaggtttagggaaaccaacaaagaacaacatcctgttgtcagccacaactgagatacaggactagaactctctattttattttaacctagaacctacttttaaaaattttttaatgttgagttctgctagactagttataaaagcacaaaatacactaaagatgaagttggaaaacttgggttgccatcacaacactgccatttatttgccatataacctgagaaatgccacttaccctctctgagtctcattttccttatttgtgaagcgaaatgtattgttttgtgatgtaaatgaaacaatgcatgtgccgtgttttcttaaaaagttttgcttatagaaaggtgagaaattcttatttttaagacggtatttctacaatgaaaatcaccttggttctagctaaaggatcagagaaatttcttttcttaaaaaacaatcaaccacgagtattgtactgcacatcaaaaaaaaaagggacaataataggatattttatgaacaaaaagcacaaaatgaaactatttctagtccttgacattctgaatataatatagattaatgtttttaaagctactgtttattgagtgttttctgttggtcatgccatgtgctatgggctttatatacagtaagatgcctatctctattgttaccaaccccagcctcagcacttggcacagtgcttaatatataataggtgtttaataaatattttattttctataactatgtgaggtagttgttattatcttcatttgatagatgaggcctagacagttaaatcattttcttaagtggtagatgcaacactagaatcctgttccaggttttaacttttatggctcattctgtaaccttcaaaaagctaattctaaaatacagtagtatgccacacaatggcatttctgtcaaggatggaccacatatatgacagaggtcccacactactataatggagctgaaaaattcctgtcacccagtgacatcatagcagtcataatattatacacaatgcattactcatgtcttcgtggtgatgctggtgtaaacctactgaaatcccacttgtataaaagtctagcacatagcattatgtacactacataatacttgataatgataataaacaactatgttactggtttatgtatttactatctatattttatcattattttcgaatgtacttcttccacttataaaaaagtaagttaactgtaaaacagcctcaggcaggctctccaggaggtgttccacaaaacgcctggatgttttatagagattgttatagagatgatagctccatgtgtactattgcccctgaagattttccagtgggacaagatgtggaggtggaagacaatgatattgacaactttgactctgtgtaggcctatgctagtgtgtatgcttgtgtctcagtttttaacgaaatttcaattatgtttataataagtaaaaaattaaatagcataaagcttataggctaaggatataataaatatttcctacagttgtacaatatgtgttttaagctaagtgctattatcaaaagactcaaaaagttttaaaaaattaagtaaaaaagttacaggaagctaaggtgaatttatcattaaaaaagaaaaatatttttataaatttaatgtagccgatatatatatagtgtttataaaatctactgtagtgtagagtagtatcttaggcctttatattcactccttattccctcacttacttacccaatgcaacttctagtcctgcaaggtccatttatggtaagtgtcctgtatatacaagtatgccatttaaaaaaaaaatttatactgtatttttactgtaccttttacatgtttagataggtttagatgtatagatacttgccattatcttacaattgcctatagtattcagtacagtaatgtgctggacagatttgtagcctaggagcagtaggttttaccaaacagccaagatgtttagtaggctataccattctaggtttgtgcaagtacactgactatgatgttcacgcaatgacaaaatcacctaatgatggatttctcagaacatatccctgtcattaaagacacatgattgtagtaatctcctcaggagaagtctaacaacgataattaggagttccaacatttctgccttctcctactgactcagtggtggtgacaatttgtttaacatgagggtgttttgtacagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggtaatctctttcttttcacttttaattttttttctgaattcatatttacagtctcttatccaaagtcctaggaggtatttgagaattcagaattttctgagttgaccaagaatatgtgttgtatatacttatatcgacaatgaccctagctgacactggtcagcacgttataattcaacgtgttagcttcaggagccaggcatggtggctcatgcctgtaatcccagtttacttgggaggctgtgacaggtggatcacttgaactcagaagtttcaggctgcagtgagctatgattgtgtcactgcattccagcctcggtaacaaagtgagagactctgaggaaagaagcagcagcagaagcagaagaagcagcagtagcagctttagtgaaatatatgaatatattcatcatggtaataaatacaggcaataggcaacctaatggtgagtaaagtcagttttttccattaaaagagaaaaattaatttcatttccagaacattttgtattgtggaatttcagatataagtctgtggactgatactattttcctacgttttagtgttttagttttctcctgtttaaaatattctaggcagtgggttctttgaggtaagttcattcatttaactgtaataaggacacagcacataggtaaagcctccctctcattatcccttaagttttctgttcttcatcagagattacatctcatgatcttctctaactcctaaatatttatcctacaaatgttttcatcttgcttgcattttgcattcaaacatcgattcattcttttctgcttatagctgactcagtcatgaaacccatttcactcacataaatttgcattaggaaaacaaaatcacaaacaaacacaacaaaacaaaaacaaacaaaaaaaaactcaatcaagtcacaaatttaccaggagtttggggaagacataggcactgacttgtggcaaggcagacaactcaaaatttaacactagacatcgcagctcctaaaaggcctgtgacaccttaacatgtagaaaaactttcctctcttttgtaatcctttctccttgacttgttctttttttttcctttttgtcattgttttacaccccaacttttattattgtactgtgcagagtggttttactgtttcattcatttccctgttttattcaaaaccataatctcagggtcttacatccagaatcaactgaagcaaggcaagtctcatcctaaagatgaattctgttttccagctatgaaaatagaaattaggtttattcttctatggtaatattcatgattaactttttaaagtaatcaccgtatccaaaacaccatgtcaaacactttgtatggcattaactcactcaattctaataactatcccctgaggaagattgtatttattattcccacttttaagggaggaaacattatcagagatattcatcttttggttattgattcccattgaaaagtggtggagataatctgcccccagctttatcaagtaccaaagtccaagttctttccattgcactctgataatcaacagtgggttgagagtttctttaaagtggacaataccagtttggtcttttgacataagaaggcaagacataatgccaggtaatctcagagcctatataacaaatctaaggtacacaatttcaaagtcaccatctgggaggattgggtgacccactggactcttcagggattaacaacagtactcagaatgctgatattaatgacattgcaaagcgaagctacatctttaaggaaactggagcattttgctgttttttcagccataagtgacaaagcatatattttattattaagaagcatgggttagttgcagaaataaggcaggggaacatcactcgtctagggtctcaagtcaaagaaaaaaagtggctcaagatgtgtcaactcagccagtggttttcaagtgagagtctaatacacacaggtgaggagggaacagcagatttactacaaataatttgctactacaaataatttatgtttgtaaattattttttcccataatttattctcattcttacacactttagtaggcaaagtgtgtgagaagcaaacagatgcaacatagcatattgtctggcacacagtcgttcggtaagtatctgataaccgagtatgtaaataatagctagaatctttcaaattgcatctaaaccaccacttaccttatccatgcctgttgtatgaagtccatgtcatgagagaaaatgtgagaaaccattaagctcagctgctaagaagaacttttctttaccaggtacacattttaaaattattttttcttaaatttgtattcagcaataattttaagcttacagagatgttgtgaaaataaaagcaatacaaaaaacatgaatatatattttacccaaacttacttacattgtatcctgtttctctctctctctctcccagtctgagccattttaagggtaaattgcatagactgtaactctttacccctgaatattttagtgtgtatttcctaagaataggaatagactcatatagccacagaacagttttcaacttcagtaaactctatattgatataatgcttttatcaaatctactgtatatcagtttttaaaattagatataataatatcctcagtatttttcctctccaaaatagaatctagtctaggatcaaatagcatttagttttcatggttctttagtctgaaatatttccataaccttgtacatatgtgtctttatgtgcttgacagctctggaggatatagttcctcctcttcctcctcatttttttaatagaacattcttcattttgagtgtatctaatatttcttcatgactagatccaggtaatgcactattagccaaaattccacataggtgattatgcatctttctgagatggtgtcacatctggaggcacatcatgaccatctgtctcacgttggtgatgttaatcacctactccagatgtggtccaattttcccactgtataattatttcttccccttgtttaataaactgtctacatggagacattttaagactatgcaaatacctcacctcttatcacaatttcttctacagttggcatcgtcgatggttacaaatttatgatttttcaacttcagcactgcttttaaatttattagccaatattcaggattctactattagcaaaaatcctccattttttctatctatctatctatctatctatctatctatcatctatctatattaatggtatggagtaaaggctttccattgtttgatagtgtataactcattgatgtgcttaattatctttgtgttccaatggttccagaatttgcccatggtacaccttcaagctggttcttatgtctccatttcatatacacattttttaaaacacacattctctctggtaagcaaattattctagagcatcttgtacctacaatgctccaggcctgaaattagccatgactccaaggagtaatgttttctttcattgggaaggaaactcaagatcaagattcggaagcaagttttcctcaccagagagacacattttatctcacatcatgaataggacagggatgtggggtgtcttggtctataaggagtacacaagtgaatatagcagtgaggacagtaggacttgagaggagagcaaatgtcaaaattatactctgctctctcaataaatgcatatgaaatggaattgttacttttgattatacctcaaagttattgcttccttttctttcttggtctcgtgagaagtgtataatgcacttcccatggaacaaaatattcatagtcattgctaggacaaaggaactgttttatttttgtctactgaagttatttaagtaaactcagctttcctcttagatttcattgctgaaatagtgaagatgtgtaatttgtgaattgtgtaagagagacctcatggccgggtgtggtggctcacgcctgtaaacccagcaatttggaagtccaaggcaggtggatcacctgaggtcaggagcttgagaccagcctggccaacatagagaaaccccgtttctactaaaaatacaaaaattagccaggcatggtggcacatgtctgtaatcccagctacttgggaggctgaggcaggagaatcgcttgaacccaggaggcagaggctgcagtgagcctagatcatgccactgcactccagcctgagtgagactcttcccataaataaataaataaataaataaaaataaaataaaaacctcatgtttctagataaagcaaagaaaaataagtctgtattataagaagttttctgattaggttaaataggggaccctgtgcagtgtcagttgtcacattaaaacagaaattttctctcatgaaactctctatccattatgtcctgtatttcagagtttacaagagattttttgtttactttttcttttatttatttttttaatagcactgttggagaatgggacatggggactgaaatttcaatgaattggttaaaagtaatcaaactgactaggtttacatcctagctcaaccacttcctagatgtgtgaccttgggtatgttatttaacttctcatatgtaaaatgtggataacaataataatgtataagattcaaagaattaaatgatgcaatacatataaggtagttagaacattttttcaacaaagggcacaacagtattgtgttaagctgtggttagttactgacaacttagcaatcattaacttctctggcaattagcttaacaaagtaagtttacagtgagtcctgagaaaatatattataatggcctacatttagtggaaaaataagggaaaggggaggatggaaaattcatgaagatagaaccaaaaataaataatgtttctggagacagataggatttcaggacaagtttcaaaaatgaggtgacagcaggaacaaaggtatcttctgttacccaaaagggaaaaaggagacaggaacaaggaacaacttcttggcgtttaatggtgtgtttccaattctgagcacagtggctgcctatagtaggtgctcattaagtattggctgacagactgataaatcaataaataaaagaaaactaccttcattgtaaaacttacatataccaagaatagtgtaaaatcaaattaatcataggtaggaccaagtcaatcttggttgatcatatattgtttcaaaccacccccttctaacaaatgcagtttatgactatggaaacttactattggaggagacttctcagtatattcagtccgacatcccacactatgctaagatgcccattgggataacaccaccatgtgacccatcaagggaaaacctaccccacaagggaaaacatgaagttctttaggctaaaccaaaatctaattccattcgacttaaatagagccatccatgaacctggtattatggtatactatggaagtacaaaaaaatacaaagatgacttacacagcttatcttactgaaaagctcaccatcaagtgaagaaactccacgtaaatacataaaatggtaattgatataaaatgaggtaggaacccagatacaccagaaatatttcctaaggaggtgaaaatagaattggatcttgaaatatcagtaactgctcactgagcagagaagaggaggagaggcatttccagcagagggaacaacatatgcaatgacacagaggtgtgaaagtgtgagatgagttaccaaaaaatgagaagttctacgtggctagaatattgagtttgtagtgggaaataacaagagatgtaaggagtttagaaaaatccgtgtataccagtgtctctcaatcttcttgaaggaaaaaaacacattataggcctctaggaatatgttcacaaatccctacagaattaagaaactgaagtttattctaagattctttcaaatcttcacttttaaagagttataaattcattcgtaatacattaaatgttagctgtcatcaccataaaaacccaatgtttaaaaaccataacattcttatcttcaaaagtatgtctgaaaaatttgccttgaaaacatgccattgacaagggtagttgtgataggttattaaacaaggaattgatattatcctacctatacttcaaaagatatgatgttagtggcattagtagaatgcagaaagataatcagtgagctattggggggagtcatggatgagagcttgatctaaagtagtgagaatgaggatgaagatgagttggttagtatacagaatcagaagctctcggtgactgactgtaaggcagcaaggaaagcaacaagttcaggatgattctgacacatctgtgattgatttctaacaattggtccttgtttttgtcctagtaagctatacgtcattttaaaaatgtaatttctcttcatataacagcacttataaagctgatattatgcttccttctctagaaccttaactttttttctgcagcccttcagctctttttgtttcaatgtcactatcaaacacttcactaggaactatttcaccacttcacatgcaaggactttttaaggagcaatctacagagtggtaaatgagctgtgggctttaatgagaaacaagggaagttttgaaatttttaatgacatttaaacaagaatagtgtgtgtatttgcagagaaaagccagctggaaaactacaatgaagcctccataggtaatctagttttcagtcttcctgcctgagaaatggacttccttagttcatgcaacaacaacaacaaaaaaaaaggtcacacagattcaaaaaataaattcatttgacactaattgtataaactagatagccaaggagatagttaacatggagtgacgcattctagtaattggaaggctaaactatttccctagtatcttcctcactaattctgagggaatcagaaactcagtagtttggtgtaccctgactccgagagaggcagaaggttttgaaagatgattgccagaccaggaaaacctttccgggcctgttttaattaatcccccagatttaccaccttgataaccacattggtattctgatcaggcaataatcctgataataacaataagaattcctatgtgccagacattaatactcctcacatgttatcttatttagtcctcacaacagtcctaggacatttcattgattaaactaaagcaccattctcagcaaagtaattattctaataaatttaggagacagtctctgtccttacattataagctcattccactcattttactcaaaaggtaacttttttctcatatatatatatatatttttatactttaagttctagggtacatgtgcacaacatgcaggtttgttacatatgtatacatgtgccatgttggtgtgtgctgcacccattaactcatcatttaccttaggtatatctcctaatgctatcccttccccttacccctaccccatgacaggccccggtgtgtaatgttccccaccctgtgtccaagcgttctcattgttcagttcccacctatgagtgagaacatgcggtgtttggttttttgtccttgtgatagtttgctgagaatgatggtttccagcttcatccatgtccctaaaaaggacatgaactcatccttttttatggctgcatggtattccatggtgtatatgtgccacattttcttaatccagtctatcattgttgtacatttgggttggttccaagtctttgctattgtgaatagtgccgcaataaacatatgtgtgcgtctttatagcagcatgatttataatcctttgggtatatacccagtaatgggatggctgagtcaaatggtatttctagttctagatccctgaggaatctagttgtactggcatatgcaatttattgttcatgccaaatatgaatattgacaaagtaaagtgaatttatgtaagccttgtgtcatcttcactctgaattaaaaggtgcaggtattatcttatggcaagtactgtcttaggaagattcactggaaagagagaaagagagaaacttcccagattagtgcagagtcctttagggtcaatgaaaacactgatattgaagacatatagaactggatttcagtatcagttctaaaattctgggcatctacttcctcatttataaaatttcttcaataattacatgctcaggttatcatgagaatttatgtacatctagctcctattacatacacaaaaaatgtttccctttttctcctgccaccttctctgtaatcttcaatagtcttctcaacttctcttataatttagcataggctgtcagtcttcatgatgtgtatttatccaagctaaagagcttttgtttaatttttcatgatttgaactcactgctgtggaaaatggctatttaaaagggataatgtcattttccaagaattcaattgagggtcctagaagatctttatggagcaaaataataatacaccttttctaagtatagagtcaggcattaagacatatagacatttcacttccttgggataagtcttgggaaaaatatcactacacattagcaatacatattgcaaataaaatttataactctattttatgcatttattaaacaaatatgagttaaaagacttcaggagttttggtctgtagcccaggctggaatgcaacggtgcaatcttggctcactgaaacctctgcctcccgggttcaaaggattctcaagccacagtctcccgagtatctgggactataggtgtgtgccaccatgcctcgctaatttttttgtatttttagtagagatgggatttctccatattggctgggctggtctcaaactcctgacctcaagagatccaccaccttagcctcccaaaatgctgggattacaggcttgagccaccacacctggcctaacttcaaggtatcaaagacaaattaacaatgtctgatgcatacataggactgctttgtaatcttctacactaatgatttgtactattttggtttcagaatccatttataactcttacaatatatgaaaaatttctgccagcttttatttatgtgggttatatttatgactacttctcatttgtaaaactgaaataaaaagatcttgcatatttgtattaatttatttaaaaaattaatttgttatgtgatagtataaataatataattttaatatttcaaaaatactaagtggaatgagattactttatattttttaaaaacacactacatctgactacttctacattcaatatattataatttattgtttggttgaagaacttgatgaaaatctagcctcacacaactatgtaatcagaatagagagaagtatttttaaaaacattttcagataattgtagatcctttctttttgatactaaaacttcacaaatggtaatttcctcagagtttaattacactgtcaaatctgaaatcatatcaatgaactttttgtccttgctacattaaagtccattgatctgtctagcatcatgaatgagtattttacccattagtgattttataatagcatgcattggtcatttgtaaaatactcagttaagtgatcttccaaatgttaaaatatctcattatacaatattcaaaatcacattattaatatcaccaccaatctcatcagaaatatctttaagtatgaagacattgacaagctcataatgatgtcatcaatttttcttaatttaaatttttgcttgaaaactcaaattgtagcattggcaaaaaagaaaaaataccattagctttttttttctgtttaagtgacagacttgctttgttcacataagaagtctgccaaatgcctgtctaaatagccagtttatctctgaatcctacattcaagtgaaaatgatttcctgtgggaaacatgattatttcagctctcaacacaaataatggcacaaatgttttttccctagacgaacatatttcagaatgcagcataaatagtgcatatgtaggttccattttgtgaaacagaaaattaaaaaggcatgtaaaaaaagatagtttaaaaaattgttttgcttcattatggacattaagtgaaacttgcatttattcatttttactgcaagtctgtggctggtgaagaatataataattacagtacacttggttgccactaccttgatttgtgctaagacaccagaagatttgcccaccattgcttttgcaccatcagtgcaaatgtgaacacagaaaaaggcaaaatcacatcatagtatcattaggaaaatagttttgacattgcaaatcctctgaaagagtttcagggacttcaaggggtctgttggccccattttgttaagcaataaaatattgggattgtagaataatttcttttttaaaaataagggcatctgggaagaccttattaatttcaaatacaattctgcattttcaggatgaaatgtcaaagaatgttgatatctaaaggcacatttgcgaaatccaaaaagacatggtggctaacaacgtacattatcaggcctttcctctagagattttggttcagtaggtctggcagtggaagtgggggtgtttatgacctccagtgagccacagtgacttatataataatgttatatatatatgtgtgtgtggagatatagatatatcacataattatttgtatttatatattaaaccttattatcaatacaaagagcacacacccacacacttatttttgtgggggcagggtaaaaggtgttttcctgcaatggtacattagtcaccttgcttctctctctggtggctgttgaggttgtctacagtggattgggtgcatcctgagggccctcaacagaatgaggtccacacacaaccttctagtatttggaaagttgagggacagcatgaaaattgcacagtaaaagcacacactgttgagctatgaaaatgaagcagttttttttttatagtaaatagtaggtcattgtgtttcccaaacgtgatctaattggctattacaaattatctggcacatatattgattccagatgtgattagtgttcacttggttttagggttttacatatacgccaatttggcagtcctaacgtgttgatgttgataatgtttcatggccaaaactagaatatattttcataatacacacacacacacacacacacacacacacacacacacacacactgtatagctggatcctaggaaactttaattttagtaaatgcctcagatgatttttatgatcaggcatacagggcagctctgctctatagctggttactatattcacatttcttttcttaagatgtaataattaatggagggggagcagattttataatcaactgtagaaatatggttataaaaactcgttatttcatggcttatacttctcttcattgcaagctcctcttacctcaaggacagaaaaaaatgatgctgtttctatgaaaagatttttctgtttagtaaaatctctagtgtaaaaggagtggcctgttttcaatttgcaagtctgatcattagcctttgattcatataacataaatagacttctttgatatctaaaaagcttggctatattaaagtaagaaagtaatagatacttgcatttccacattacaagtgagcaacagagaaaacaaaattagtacttgttgagcacctgataccttgtacattttcaaataaatcacttgaaatttgcaattacaccatgagacaggttttcccttgattttacggatagggaacctgatagtcacatggttgataacaaccatagttaagtctactattccaaattcatctgactccaaggctgatacaaattccacttcactacaaagccttcttcagcctgctaaagtaaagctgaggactctgataaactcccaaccctgcctctggtatatgacccaacactaaccactctgctcagagtaggtatctaaaagaaattcttgtgtgaaacaatgaaattttggtgggaaaacagaaacatgattgtcaataacaaaagtatacaacacagacttctacttctgggaaggtaaagtaggtacacttttctctattagtccctctaaatacaaccacaatctctggacatggcatataaaagaaacagaaagaatgtaaatagtgaagagaagaagccaggtcagctaggaatattgggatctcacggtatgatggtgagtcccctgggttttattttcctcatatattcaagatttggagctgaagaagcttgtaacctagaaacacccagaggtacaaacaaaagtaaaacaaaacaaaacagaaagaaaaaaacaccaacaaaagccttctctctctagtcaaatgacaaagaaaggtgcagaaaagttttaaacagtaactactctatttcattcaaattcaaaaacagaaaaactgaggcacaatccccacccaagtcagcaaaagttgactggggagactagacttctacccttactaggctataacaaggtgcctcctcaattcccttccagggtgatgtaagagaaggctcagtttgcattccaaccagggaggaattaaccactcttcctactttacatggaggcaatgtggaggacctgcaattctatccccaccaggcagtaaaaagaggaatcctttcttcccttctggattgttgtcagaggaggcctactggatagttaggtcttctagcactgtctagtggtaattaggccacccaatccatggcattaggggaaagtagttgaggagcagtaatgaggggtattcttacctctcctagcaaggaagacatcagtagaggcctagtggggagccaggtcggtggggaacttggacttctattgctacttaaaagtaataatgcagtgtttcccttctgctggagctgagtcagagaaagccaggagattatacatttttttttttttgagatggagtctttgctgtgttgtccaggctggtgtaaagtagcgtgatctcagcccactgcaacctccacctcccagagtagctgggattcccctgcctcagtttcccgagtagctcagattgcaggtgcccaccaacaagcccggctaattttttttatatttttagtagagacaggatttcactatgttggtctggctagctcccaactcctagcttcaagtgatccacccactttggcctcccaaagtactgggattacaggtgtgagccactgcgcccagctgagattataaacttttataaaacagaagatttaataagatctgtagtctcataaaatacccaaaatgtccaggttgaaaacagaaaataatcccttatcatactaagaaaagttacatccttgaattaaaaaaaaaaaaaagacagcagacgttaacactgaagtaacagatatgttaaaattatctcaaataataggttgaagcaaaagtaattgtggtttttgccattgaacagaatggtgaaaaccgcaattacgtttgtaccaagttaatagatttaaaacactcatttttgaattcctcaatgaataattataaacatagttgaaacaaatgaaaaaaatagaatgacttcgcaagaaaatggaagatatcacaaagaacaaaacaaaattagaactaaaaaatacagttaccaaagtaaaagtctcaatactaggttcaacagcagaatggagaggaaagaagaaagaataagtgaactggaagatagaaaaatagaaattaccaaatctgaaaaacagaaaacacactggaaaaaaaattaaaaaggctcaaagagttgaataactacatgaaaatgattgaacttttgtgttattagtgtcctagaaagaggggagaaaaatcagttctaagaactcaatgaaatagtgactgaaaacttcccaaatttagcaaaagaaactacaaattaaagaatcagagttaaacccaatttaataaatcccatagcaatccacatcaaaatatatcactattaaacttctaaaaactaaaacaaatattcaaagtagtgagaaattaattatatcttatctattgtggaaaaaaatgaatgacagatctttcctttgacactatggaggccagaaggtggcactgcatttttcaaatgctgaaaaaaatgaactgttaacccagtgttctatgcccagggaaaatactcaggaatgaaggagaactcaaggtctcctcagatgaagtaaaatgaaaagattttgtcaccaccaagcagacctgccctgaaaaaaaaatggttaatagaagtttcttaagaagaaggcaaatgataaaataaactttcttaagcaaaaatatagggaattcaacagacttctgttgagttttctaaattgtggtttaatggttgaaacaaaaataaaattttatgtcattcatctaaatgaacataagataaatatttaagacaaataaggttttacacttaatttgaactagttgaaggatgatgccagcagagataaattatgtaaaaataatgtaatacttagataaatcaccaataaagtgatacaaagaaatacattcaaaaaacttgataaataaaaatggaatttgtaaacattttcaagcaactcaaatgaagacaggaaaaatgaaccaaaaaattcagaaaagtaacaaacaggaaaaaaataggtttaagccataacattatataatacttatattaaatgtgaatagtctaaaaataccaattaagagattgggagactagattttatttaaaaatgacctatattgagcctagaggaaattcactttagatataacaatatttgtgaaagttaaaggatggaaaaaatcataaaacattaatcaaaacaaagttaaagtggctatattaatatctaataaaatagacttcagagcaaaaacaattattggagtaagagaggcacattttatcaagattaatgagtcaatccagtaagaagacatcacaatcctaaatgtgtatgcaccaaacaagcttaaaatttgtgaagcaaaagctggtagagctaaaaggaagaaatagacaaattcacaattacagttggagaattcaatactgctgtttaaccaacaggactaggcaaaacatctgcagtgataaagaacttaacaccatcagccagaagaatctaatcaacattgatagaacattccattcaataacaacacaacaaaaaatatttatttgaagtgctgataaaacatatgctaaacatatgactgccccttgagccataaagcaaatatcaacaaatttaaaaagattggaattatacagactgtgttctcctaccccaatggaatcaaactagaaatcaataacatgagggaaagatcttcaaacacttagaaactaaacaaagcacttctaaataacccaaggagtaaagagaaagacttaaggaaaataaaatacatttaaataaataaaattaaaaaccaaacttaccaaaatttgtcagacatactataaaattgtgctgagagggggaagtatagtactaaatgcacacatgtggaaagaggtaaagtctcaagtcagtaatacaaactcaaactccagaacctagaaatagaagagcaaaataaaaccaaagcacagagaatgaaggaaataataaagataggagcagaaagcagtgaaattaaaaacaggaatcaatacaggatatgaatataacaagcagctggtttttgggaaatattaataaaattgacgaattagcaagattgaaaagggaaaaagagaaaagacacaaattaccaatatcaagaatcaaaaaagggatatcaatacagatcttgcagacatcaaaagggtaataaaagcgtactatgagcactctatgtacataacatttgacaacttagatgaaatgaactaattcctaaaaaagcgcaaactataccactcacccaataagaaatagacaacttgaatagccctataaatgtaaaggaaattgaattggtaattttaaaactaccaaaatagaaatcctaaggaatagaatgttttccttgagaatcaaccaggaatttaacaaattaacataaattctatacaatctgttccagaatgtagaagggaacatttctgagtcattttataaatccagtattaccttaatattgaaaccagataaaaggatgccaagaaaatgagacagatcaatatccctcatgtacatatatgtaaaaattcttaaaatattgacgaatataattcagctgcatataaaaagaattttatgcattgaaacaaatgaaatttattccaaaaataccaaactgcttcaatatgtaaatattctgtatcttgaccctttcaataccaatatcctagctgtgatattctactatattacataatattttttcaaggttaccattgagggaaattgaataaggagcacatcagatttctctctattatttcttacagctgcatataattctataattaactcaaaataaaaagtttttaaggccaggggcggtggctcacgcctgtaatcccagcactttgggaggccaaggcggggggatcacgaagtcaggagatcaagaccatcctggctaacacagtgaaatcccgtctctactaaaaatacaaaaaaaattagccagatgtggtggcgggcacctgtagtactagctactcgggaggctgaggcaggagaatggtgtgaatccaggaggcggagcctgcagtgagtggagatcgcgccatggcactccagcctgggcaacagagcaagactccgtctcaagaaaagaaaaaaagtttttaaaaagacaaagttctttaaggcaaatatttgaaatttacatttaaatagatagatgagataaaagacgtattaggaaccctatttcagtcaagcaaggagcaatacttacttttatttattgacctttcttgatgcataaacatcaagagaaccaatgtgtaacatcatccaagataatatcaacagttatcaatatatgtgagaaaagacttagggaggacttccaatatatattttattctaaattttacattatacaaacagctattatcactttgttttctgccaatttgagatgaataattattgtgccagagaataaaataattgctcagtgagtatgcaattcatctgaatctatggatcatttacagagaatctccttaaaatatgcatcataattttaatcactaacatatacccaaatccctaattttgtaagtacttctaaaacatatctaatgatctttgtaatcattcttcttagacgtatttactttgtttttatttatccaccagcattagcaattgcttatttttgttgcttactttataaagaaagattttccatatcaatcaatttttatggccactatttatgttattgtaaagtaagaacaaaggtaagaccttttgctcaactttcagttgagtttaaatccttgctttgggagagcttccaagatgactgaacaggaagagctctggtctacatctcccagggagatcaatgcagaagatgggtgatttctgcatttccaactgaggtatctgattcatctcattgggactggtcggacagtgggtgcagcccacagaaggtgaaccaaagcaggatggggggtcacctcacctgggaagcacaaggggttgggggatttccctttcctagcccaaggaagctgtgagtgactgtacctggaggaacagtacactcttgcccaaatactatgtttttcccatgctctttgcaaccagcagaccaggagattccctcccatgcctggctcagcaggtcctgtgcccacagagccttgttcactgctagtgcagcagtctgagatagacctggcatgctggagcttggcagggagaggggcatccaccattgctgaggcttgagtaggcgattctatgctcacagtgtaaacaaagcagcagggaaactagaactgggtggagcccactgcagctcagcaaggcctactgcctctttagattccacctctgggggcagggcatatctgaacaaaaggcatcagacagcttatgcagaattaaacgtccttgtctgacagctctgaagagagcagtggctcttggagcacagcgttcgagctccgataatggacagacggcctcctcaagtgggtccctgaccccgtgtagcctgactgggagacactacccagtagaggccgacagctgcctcatacaggcaggtgcccctctgggacgaagcttccagaggaaggatcgggcagcaatatttgctgttctgcaggctccattggtgatacccaggcaaacagggtctggagcggacctcaagcaaactccaacagacctgcagctcaggggcctgtctgttacaaggaaaactaactaacagaaaggaataccatcaacatcaaacaaacaggacatccaaagcaaaaccccatttttaggtcacatacatcaaagaccaaaggtagataaaaccacaaagatggggagaaaccagagtagaaagactgaaaattccaaaaaccagaatgcctcttctcctccaaaggaacacagctcctcatcagcaaggcaacaaaactggatggagaatgagtttgacaagttgactgaagtaggcttcagaaggtgggtaataacaaacatctccgagctaaaaggggatgtttaaacccatcgcaagaaagctaaaaactttgaaaaaaggttagatgaatggctaactagaataaccagtgtagagaagagcttaaatgacctgctggagctgaaaaccacagtacgagaacttcatgaaacatatgcaagcttcaatagcagattcaatcaagaggaagaaaggatatcagtgatcgaagatcaaattaatgaaataaagtaagaagacaagattagagaaaaaagaatgaaaagaaacaaagcctccaataaatatgggactatttgaaaagaccaaacctacatttgattcgtgtacctgaaagtgatgacgagaatgaccaagttacaaaacactcttcaggatattatccaggagaacttccccaacctagcaaggcaggccaacattcaaattcaggaaatacagagaacaccataaagatactcctcgagaagagcaaccccaagacacataattgtcagattcaccaaggttgaaatgaaggaaaaagtgttaaaggcagccagagagaaaggttgggttacccacaaagggaagcccatcagactaacagcagatctctcagcagaaaccctataagccataggagagtgggggtcaatattcaacattcttaaataattttcaacccagaatttcatattcagctacactaagattcctaagtgaaggagaaataaaatcctttacagacaagcaaatgctgagagattttgtcaccatcaggcctgnnnnnnnnnnnnnnnnnnnntaaaaatcagagtgcctctcctcctccaaaggaagacagctcctcaccagcaatggaacaaagctggatggagaatgagtttaatgagttgagagaagaaggcttcagatgatcaaactactccaagctaaaggaggaagttcgaacccatggcaaagaagttaaaaaccttgaaaaaaaattaggtgaatggttaactagaataaccaatggagactagtccttaaaggacctgacggagctgaaaaccaaggcacaagaactatgtgacaaatgcacaagcctcagtagctgattcaatcaactggaagaaagggtatcagtgatggaagatcaaatgaatgaaatgaagtgagaagagcagtttagagaaaaaagaataaaaagaaacaaagcctccaagaaatatgggactatgtgaaaagaccaaatctatgtgtgattggtgtacctgaaagtgacagggagaatggaaccaagttggaaaacactcagcaggatattatccaagagaacttccccaatctagcaaggcaggccaacattcaaattcaggaaatacagagaatgccacaaagatactccttgagaagagcaactccaagacacataactgtcagattcaccaaggttgaaatgaaggaaaaagtgttaaaggcagccagagagaaagtttgggttacccacaaagggaagcccatcagactaacagcagatctctcagcagaaaccctataagccataggagagtgggggtcaatattcaacattcttaaataattttcaacccagaatttcatattcagctacactaagattcctaagtgaaggagaaataaaatcctttacagacaagcaaatgctgagagattttgtcaccatcaggcctgccttacaagaactcctgaaggaagcactaaacatgaaaaggaacaacgggtaccagacactgcaaaaacacaccaaattgtaaagaccatcaatgctatgaagaaactgcatcaattaatgggcaaaataaccagttagcatcataatggcaggatcaaattcacatataacaatattaaccttaaatgtaaatggagtaaatgccccaattaaaagacacagactggcaaattggatagtcaagacccatcgatgtgctatattcaggagacccatctcacgtgcaaagacacacataggctcaaaataaagggactgaagaagatctaccaagcaaatggaaaacaaaacaaaagaaaaaagcaggggttgcaatcctggtctttaaactaacaaaaatcaaaagaaaaaaagaaggccattacataatggtaatgggatcaattcaacaagaagagctaactgtcctaaatatacgtgcacccaatataggagcacctagattcataaagcaagttcttagagacctacaaagagagttagactcccatacaataatagtgggagactttaacaccccactgtcaatattagacagatcaatgagacagaaaattagcaaggttatccgggaattgaactcggctctggaccaaatggacctaatagacatctacagaactctccaccccaaatcaacagaatatacgttcttctcggcaccacatcacactgtaaaattgaccacataattggaagtaaaacactccacagcaaatgtaaaagaacagaatcacaacaaactgtctctcagaccacagtgcaatcaagttagaactcaggattaagaaattcactcaaaaccacacaactacatggaaactgaacaacctgctcctaaatgactgctgggtaaataacaaaatgaaggcagaaataaagttgttctttaaaaccaattataacaaagacacgacgtaccagaatctctgggacacatttaaagcagcgtgtcgggagaaatttatagcactaaatgcccacaagagaaagcaggaaatatctaaaattgacaccctgacatcacaagtaaaagaagtagagaagcaagagcaaacacatttaaaagctagcagaagaaataactaagatcagagcagaaatgaaggagacagagacaagaaaatcccttcaaaaaaatcaatgaatccacgagctgtttttttgaaaagatcaacaaaatagatagaacattagcaagactaataaaagagagaagaatcaaatatatgcaataagaaatgataaagaggatattgccactgatcccccagaaatacaaactaccatcagagaatactataaacacctctatgcaaataatctagaaaatctagaagaaatggataaattcctcaacacatacaccctcccaagactaaaccaggaagaagttgaatctctgaatagaccaataacaggtgctgaaattgaggcaataattaatagcctaccaactaaaaaaagtccaggatcagatggattcacagccgaattccaccagaggtacaaagaggagctggtaccattccttctgaaaatattccaatcaatagaaaaacagggaatccttcttaattcattttatgaggccagcatcatcctcataccaaagcctggcagagatacaaccgaaaaaggagaattttaggccaatatccctgatgaacatcgatgcgaaaatcctcaataaaatactggcaaactgagtccaacagcacatcaaaaagcttatccaccacaatcaagttggcttcatccccgggatgcaaggctggttcaacatacacaaatcaataaatgtaaatccatcacataaacagaaccaaccacaaaaaccacttgattatctccatagatgcagaaaaggccttcaacaaaattcaacagcttttcatgctaaaaactctcagtaaactaggtattgatggaacgtatctcaaaataataagaggtatttatgacaaacccgcagccaatattatactgaatgggcaaaaactggaagcattccctttgaaatccagcacaagacaaggatgccctctctcaccactcctattcacatagtattggaagttctggccaggacaatcaggcaagagaaagaaaaaaaggatattgaaataggaagggaggaagtccaattgtctatttgcagatgatatgattgtatatttagaaaaccccattgtctcagcccaaaatctccttaagctgataagcaacttcagaaaagtctcaggatacaaaatcaatgtgcaaaaatcacaagcattcctatataccaataatagacaaaaagagagccaaatcatgagtgaactcccattcataattactataaagagaataaaatacctaggaatccaacttacaagggatgttaaggacctcttcaaagaggactacaaaccatggttcaaggaaataaaagaggacacaaacaaatggaagaagattcaatgctcatggataggaagaatcaatattgtgaaaatggtcatactgcccaaaataatttacagatccaatgctatccccatcaggctactactgactttcttcacagaattggaaaaaactactttaaagatcatatggaaccaaaaagagcctgcatatccaagacaattaattctaagcaaaaaagatcaaagctggaggcatcatgctacctgacttcaagctatactacaaggctacactaaccaaaacagcatgacactggtaccaaaacagatatatagactaatggaacagaacagaggcctcagaaataacaccacacatctacaaacaacagatctttcacaaacctgacaaaaacaagtaatggagaaaggattccctatttaataaatggtgttgggaaaactggctagccatatgtagaaatctgaaactggatcccttccttacaccttacacaaaaattaactcaatatggattaaagacttaaatgttagacctaaaaccataaaaaccctggaagaaaacctaggcaataccgttgagaacacaggcaaagacttcatgactaaaacaccaaaagcaatggcaacaaaagccaaaattgacaaatgagatccaattaaactatagatggttctgccagcaaaagaaatatcagagtgaacaggcaacctacagaactggagaaaatttttgccatccatcaaactgacaaagggctaatgtccatcaaaaagtggacaaaggatatgaacagacacttctcaaaataagacatttatgcagcaaatagacatatgaaaaaatcctcatcatccctggtcatcagagaaatgcaaatcaaaaccacaatgccataccatctcatgcctgttagaatggcgatcattaaaaggtcaggaaacaacagatgctagagaggatgtagagaaataggaacccttttacactgctggtgggagtgtaaattagttcaaccattgtggaagagagtgtgacgattcctcaaggatctagaactagaaataccatttcacccagcgatcccattactgggtatacccaaaggattatatatcatgctattgtaaagacacatgcacgtgtatgtttattgcggaactatttacaatagcaaagacttggaaccaacccaaatgtccatcaataatggacaggataaagcaaatatggcacatatacaccatggaatactatgcagccataaaaaatggatgaactcacaggtcagacccactgaaatagcaccaaatatcagatccaagggatgaacagagctctaaagtaaatcaaaagcccagaaatcaggagactaagaggcagtaaatcatgtgattaagaacatagattttagcatcaaacatgcctcattttgaatcccaaagctgctacatctagctacataatctttggcaagctgcttattcttccctaagccttctttttctcaccataaaatggtgctaatatttgtagccatctaaagttacagctttgatttttagtacgatattgtaaaaatatatatgtaacaacgttcttagcacacaattactagatagacaaggaacttgctattaaaatatttgcattctagtgaggagaagcataagcaaaccagaaaagaaataagcacaaaattcagttaagcactatgatgtgatataatatctatatattttataaagaattacttgggagaagcttgcagttgagataggctacttatagctgacttctctgatgaagctgaaaaccatcattctcagcaaaatatcacaaggacacaaaaccaatcaccgtatgttctcactcataagtgggagttaaacaatgagaacacatggacacaggatggggaacatccctgtttgggggtggggggctgggggagggatagtgttaggagaaatatctaatttaaataacgagctgatgggtgcagcacaccaacacggcacatgtacacctatgtaacaaacctgctcattgtgtacatctaccctagaacttaaagtataataatagtaataaaataaaataaaaattattgctttggcaaagaataaatggctatatcccattggctttaaaaatttgagtctaagcaatccattaaaataatctattttaacttaaaattttttatagatttaggggtacaatcatgattgtgttgcacagatatattgcacagtggtgaagtctgggctttgagtgcacctgtcaatcaaatagtgttcatagtgttactaagaaatgtttagaaatgtcataagaatcccaccatttttggagagagatcattaatactaaagacgcaagaccctccataagtcatttaacttcatacagctcatgttttttatttataaggtgaagataatatttctgttctatctgtttatgtaattatcaactaagataatgtttgttaaacatagaaaacctctgttactatattattataatgaagaaaataatttttaggatttatacaacatactaggattttggtatctttaatcaataattttaattgaaaccatatttatttttctttttcatcctgcagtaaattcagattttgtgcagtgagtgacttcacttaccaatagaaggtgtgaaagcttatgaacctggtgaaagcttatgaacctggaattgtgactttagtgtataaataaacagaagaaaatgcagtaagaaaaagcatcagatttataggtgaaatacttaaaggatggcacttaaacagagtaagaaatatgacttgtatgtatactaaaagcaactgtggctcagattattccttctgaggttctatctgccattcatttcatggaatattgtggaattagcctatttcaccttctattaaatggggcccactttatggtatcataagaaaactcaaggctgaggtgcactgattgcctcagctctggagtttgacacgagcccaggcaacatggtgaaaccccatctctactaaaaatacaaaaaattagccaggcatggtgatgcacccctgtagtctcagctactcagtaggctgaggctgcagaatcgcttgaacccaggaggcagaggtcgcagtgagccgagatcgcaccactgcactccagcctggatggagtttttccatctcaaaaaaaaaaaaaaaaaaaaaaataggtaaacccaaataatatgccttttaagaaaaagaagttgattttgctcttatgaaacaatatgaagttagatcttcaagatctggtagtgcaattctgtcatccttaactcacagcttccatctcttgatcttcatcctgttttcaccctaatcgaaagggtgaaagtgggaagaatagcgtatgactatttttctttaaaggaattatttagaagtgtttcttatcatgatcaaacagacatggtaacatttagcttaaactggaagatgttatctccagctagtggccatgtgtccaacaacatttagattattattaggaaaaagagaaaaaattagcatttgtgaaaaaagtagtagtctctgtcacaatcttttacccatgttttgtaaagtatttaaaacaaaaatcaagcactcttaccataatgttctgtcacagtgttgttttaaatttcatgtaaaacaacattagttctgtagtggtaaatgaagtgttaaagtctctctttaactccagacctttcaagttattaaaaatgcgaacatttattatctaacttaggaagtagagaatattggagtaagtaatactatgcagtgttaacaaacgtatgccaaaatcttagtgatgtaatccaataaaaatgaatttcttgctcatccaaaatccaatttggatgtttctggttggggaatgaccttccctatggctatgttagtgagtctactgtcccccacttatctgatgtatcttctccatcttcctgggagactgagtatgaggatgcatggagaattgtacatgagaaatatatgggccaagccttgaagtggcccacataccttctgcctacatgtcattgaccactacttattcacagggccacatataaatgtgaggttcattgtgcatccaggagttaagggaaagtggttttttgaacacagtgaatggatgtgtcttgggtgtttctgtttgagtctcttcgttgttttatttttccctctaggatccagtaattcctgaactttagttctggcctgggctggcctgcctcattttcactgaagcctcgattcttaactgtgaaagaatagataattttctctttcttaccattgcttgctgccctactctttctgaaatagtttcccatgttatcccattttctactacatggaaaaagatcatgctattctgttttccataatcattatatattcttttttccccatggtatttcccaaaaatttattattccatgttttatgggtgaatagttatttctattaactacttttttagagtgaagaatcatcgacctcttctatcctaacatctactgttatcccctccatgctgaacaacaccaaaactatttttcatgtaggttgttcagggctttctctctattcacttaattattccatcaggagactattgagagaggcctataacataaaaacataagggttaaattcaaagctatcgtcaatcttactcaaagacataaaccttagaacattataggaatcttcaaaaaagttagcttaattgattttaaaattatgccagcaactaaagctacatgttttagaaagagaaatatatgcctcatgtttattgattaaaaaacatttatagatactttgcaatatactaggaataaatgacatattctgccctcttgaaacttaatataattaagaactagattgtgaaaaactaattataatccaaagaaaataaatgattaaaagaggcaaatttaagtgtcattaaatgaaggaagctaaccaaatatttcttgtcaaagaaatttttatggatgatctgatatcaccaagaatgagctggaatagtttcagtaaagtacaaagaagaaaaggaggaaaattgacaaattctttcctacatctttacaaaataaccttacaaattaccagatagcctctgtaattaataacaacagttaacatcactacaatcctacttttctaaaaacttttcacgtccattatcttaattattcttcttaaatgccttataccatatttattattatgcacactttataaatgaggaaactgagattctgataatttatccaattgacaatgttacagagctaacaggtagaaaacatggatcattagcaagggagatcatgtcctcaagtgttccaaatagaaaagccaagttttagatgcagctagagaaaagcagttaagagttggactacctgggtttaaattctagtactatcacttactagttaaatgacttttgtaaatttaacctgcccttgcctgaggtccctcacttacaaagtgataataatcacaatacctacctcatatgctattgtgaagattacataagtcagtatttgtaaattacttagaaccatccttttattgcaataatgaaagttccttaaagttactgtcttgcatgctgatgcacacactgtaattttctagccctatatagaagccaaattccaaacaatagactaggacttgagactcaaactggacaaaaattgtttcaggaaaatattagtcctaaattaaacttatatccaaagtgtaaagagcagcagaatgacagagtgacttttttttttttttttggagacagagtcccactctattgcccaggctggagtgcagtggagcgatcttggctctctgcaacctgtgtctcccaggttcaaacgattctcctgcctcagcctctcgagtagctgggactacagacatgcaccatcacccctggctaatttttgtatttttagtagagacaccatgttggccaggctggttttgaacccctaatgtcaagtgatccacctgtctcggcctcccaaagtgctaggagtacaggcgtgacccactgtgcccggcctgatagaatgcttttaaaagcaacctttaggatgaaattatgtccttccacaaattcttacaatctagtaaaaaaattaaatttgataagaacaaaaattggccataagtatgtgggtattgggtcttatacaatatcttggtgacactaccaaaaattcttgccttctctgatccagttgactatgtgccctggagtcctgtgataggaagctgatgaagttttcatccagagagtaagaaccagcatgatagggccttttctaccccaagagagtactctgtgaaaaagctgggttgcagctttttattccaatggatatgacaagaattaaaggaaataaaggaactatcataactgcaacagaacatctattgtctattttaaattttattgcaactaatggctttatatcaactgaaagaatgtaacagaataattaagagcaaagcttggaagtttggcagataattggccaaaattctgaccctgccacttatctgcttgtggtaggccgttctcacattgctttaaagaaatctcagactaggtaattaaaaaaaaaatggttttatttactcacagttctgtaggccgtacaggaagcacagtgctgacatctgcctggcttctggggaggctgaaacttacaattatggtagaaggcagagagcacgcacattatatcgccagagcaggagccagcgtgaagggtagcaggtgccacacacttttaaatcatcagatcttgcgagaactcactcactattgtgagaacagcaccaaacggatggtactaaactattcatgagaaatttgccccatgatcaaatcaccttccaccaggtcccacctccaaaagtggggattacatttcaacatgacatttgggctaggacacatatccaaactatatcattactgaatgaccttagataaaccacctatcctctttgagacttagtttcaacacctgaaagttggttaaataatatcttctttacagagttactacgaagatagccgggcgtggcgggtgcctgtaatcccagctactcagaaggctgaggcagaaaaatcgcttgaacctgggaggcggaggttgcagtgagcggagatcacaccactgcactccagcgcctgggcaacaagagcgaaactccgtctcaaaaaaacaaaactcaaaacaaaacaaaacaaaacaaaaacagagttgctatgaagatgaagttctataaaaacttaaggaaatgcagcctagcacctaccacataggaatagaaggtgtagtaatagcagtaatctttgttgtagagaggcaattaagtagtagagaagagaaaacacaaacaccgaggttaacaagtagagaagcccacttaaaataataaacactttaataacacaaaaacctttcttgaatttatggaaatgacttataattcattgtgatttgtcattgtctttgtgcaaacaatgaaaagaatgagagcagctgttttcaaaccttatttgcattagaatcacctgtagaactggttaacacacacgatgggtccccacctgactttctgttcagtgactcactgttagggttagaggatttgtgtttgtaacaagtttacaggtgatgctgctaactctgggaccacatttttgaaaaacacaaaatatgtggagtgtttgtgccctgggctctgctgtaataattacatagtatgaaacactcatgcaccacttcatttgcttcgttactctattcctcataatcaaagaaatctcctgagtcaaattaaaagtattttctaataaacataaatgctaattaattacatttatggctgtagagctagcactttgagcaaactggaagttggttgaaagttaatgcttctcgtgtatctagggacttgcttagatccaaaaatgttttttgatctgcaattctgtatttcttctgtaagtagtttaaattacaagccttttcaaagtattcagccatcaaatacagcctcctaaaaccattgtgcataaccttttgaagctgtgtacttaattcctcaatcaagttgcacattaggagagtaaattggaggaatataagtcagtgggtcttaagtcactttttaaaaaatcttcagatgcactaatgtacattttctatcttctttttatttcctcttctccaattccatctctgaaacactatgaaatgttaaaataggttaaaaatgcacttaaatgaaatgcaataaattaaatgtgctctattcttctgaagatttaactacacaccttttcatatttcagactcttagcaggtatgattaaagtgcaacatctgtaactcatcttcctcaaaggaaagatacggaattatatgagatgatttatgtgccaatgcctagccagtgactgttacatagtagttgctcaatttcttaaatcataattttcaaaggaacatggaacagttaccaggaagaaaatatgtcaaggcataagtttatagtgtaagattttaaaggcagaaggatttttggactgtcagaatatagaaggtgaaaatttcatatcaaggaaatcatatattcacaggtagtttttgaagcatgagctcaggtttagagaatggagatcagtccagcttaattcagtgcagtgcaaccctggtcacatgttagaacgacccggagtggttttcaaactccaagtgcctgagtcccattctaaaccagttatatctgaatctctaggtatgagagctaagcatcaatattaaaaagaaacaaacataaacttttcagagtagtattagggaagaaaagagcaaaagagatcaactagttgcaattttctattgttgggtgccgggcacggtgtctcacgcctgtaatcccagcactttgggaggccagggcaggtggatcacctgaggtcagtagtttgagattagtgtggccaacatggggaatccccacctctacgaaaaatacaaaaattagccaggcatgctggcttgtgcctgtaatcccagctactctggagtctgaggcaggagaatcacttgaacccaggaggtggaggttgcagaaagctgagatcacaccactgcactccagcctgggcaacagagtgagactccatcttaaaaaaaaaaaattctattgttgccattgacctgaaactgggtttattaatttcctataggaatgtagcttgcaaatgttaaggcataacataatttgggggaactcttactgcctttcacaaagaacattgagctattttggcatctgtgactaacatgtctctactggctcagtaaaatttctttccatgaggaattcgtggacaaggttgagataataacacattctgcaccttgctgtaatttggtagctaaaaatgacaagtccacaaattcattgcaggggtatagtgcaaagaaatttccaagggtaagtcagtacagacactacccaactgtatatgcaaaaaggagcacaggaattggaatcaattattcagttcattgattccccaactactagctttaatgtatgtgttatttaacttctataagctgtagttttcacatttgtaaaactgaggtaatgataatattcatatcacaagtagccctgagattcaaatgagattatttacatgaaagatatttgaaaagctggatatatatgggcactattttggggtacttagaatttcctctttgacttattcttccaaaacagagtcaaatctcagccagagaagctaccgatgttggagtaattatttctattttttttcaagttgacttcaccaaccaagaaaataaactctatgaaaagataaaatagaaaatagtttgttcacatttttatattatttgtcattcataacattttctctgttttgtcacttgacaggtgccagagtagagctctctaaaattccctcgtaggttttttggaaattgtctctcttattcccaatctctgtaggatatataagtgaaagattgagagtattttatatttgtttatcttttaaatatgaaggtgttcaagtctctgattttgattatcggaaatcaaaacaaacaatttggatctctaattctgaggtgtctctagtctatttgaagagacaatatatacattatgttaaaattgttactataataaaactgtttacaactgtttatattaatctggtatgtattacaaagaatcttggttcaacctgggcctttacattatttctaagcacatatcacaatgtattccgacaaattccttgtgctttttctttagctgtttttttttttttcttaataatattaggggcttttctagatgcaacatctgtcaggtcagtatagtagtgagtaatgaaataccagcctggctgaaaacgctcttaaaatgtcagtccattctacttcctaagacacctaagaacacctgatataggatgagagcaggcagcaggcaggtttctacagaacaatgaagtttaggaaggagggagatgcgtgatgctagggtggtacctaatggttgcagcaaaagagatacttttgcattgagagtgcaccatattcttggttagcagcaactatttaccacatgcaacatgattatagaaatactagttactactcaggaagtattcactttgcaccagatctgtactaggtgcttttatacctgctatcaaaattaatccttgccaccaactgataagtggacattatttacttcctctcttatcattgaagcccaaaaaatataaataacttgacaaggattatacttccagtatgtaacacagaatttaagccaagttctactcagttcaaaaatcttttttacagcagtatcttcaaagtggcatagatacactactgcaggttcacaaaaactttctaaggggtacatggtgcagagagttttaagaaaatttatttttagctcatccttccaagcatacttttccaaatgaatctgattgagaagactcctgaagattctccttcaccaactctcctttcaaaatctcccttctctgatgtttcagaagagcctatcttccacctatcctgaattcattctcaatacagtctgctcccagaatgggaaaaacttccagagtgtttaacaagtggggaatccgaaacattggtgctagtgttgccaacatgtataactttaattactaggcaacaaacttcttacaagttgggtagtttataaataaattcatcatttgtgaaattgcttttatcaaataattcttgcttgagttgtcagttgatggatcaaattgtaaaaactatttttttttttgctggattgtatcattattagcatatttagctcaaatgagttcaaaaagataagtaaaatttaaataaaaatttctttacccttatctagttatttatgggaacaaagcttcttggcagttatttatttttttaaaatttagaatataattgatatacctatttttgttacagagaattttggtaggctacttattcttttccctttttaaaatttataaataaaaattgtatatatttatggtgcatcacatgatgctttgatgtatgtatacattgggaaatggctaaatcaagctacttaaaatatctgttacctcacatacttatttgagtagtaagaacatttaaaatctactctcttagcaattttcaagtataccatacattattattaactataatcaccatgttgtatcatagatctcctgaacttattcctcctatctaacaaaaaatttgtatccttagacatagatctcctgaacttattcctcctatctaacaaaaaatttgtatccttagactaacatctccttaatcctcactaatatttttcaaatattttaagcataacatatataacatttagatataattgtgtagaaaaatagtatacaaatacaagttcaagtataaaaaggtaactccagaaagttacagactatcaaagaagagtttaagttgtttttgatatggatgatggaatcaaataattatggtggatacattttttgaaagtaatattatatgttcatttttaaattgacactatttgcaatatccttttattatatcctctgaaactatttatgattatgattaaaacaatttgatagtgcagtaggaaaattatagttaacaacaatttattctattgtatatttttaaatagctagaatagaagatttgtaagattcccaacacaaagaaaagataaatgatcgaggtgattgatattccaattactctgatttgatcattacaccttgtacattataggcatcaaaatatcacatgtaccccaaagatatgtacaattgttacataccaatgaaaaatataaaactttaaaaattcttttaaattaaaaaaatcagtttgggacctactttaaaaagtgtgagagtatacactttaaaaagtgtgagagttttaaatttttcatttggtgctactcaaagataaaatcttgaaaacaacttctatgaagaacattgtcctcagtgacatgatttattgctacatagcaaaggaagtaaaccattgtatttaggagcataagttctacactaaaacaggcatctgctctaaccttaacgtccaatttgttattttaccttagacaagttctttgtcccctctaagccctttctttccatttctataataatgtaggtacttaattggtcagatccttctaaatgtcacataaaattatgtcaagatctagaaaaatttctacacagattaagtgtcatgtatgtatattcacagaagttgtcatagacaaaactgtgtaaaggagagggatgtgcatgttcttaggctaatctcccagagggatcagggattggtatggtctcccagaatgaataaaataagttcaaaaggaggtaaaaggaggaaaaaacatcactacccgaaggggcagaaacactgtcagtcacaatagtgggagagcacaaggcatgtgatgcaaaaattaagaactgcacctttaataaggaagatattgccaataaaatagttctacttgtatgaaataaagctagaacttccctgcctaaatcctgtcttttttcactgtttctgttgtaactctggtttacattatgatcttattcacaatttctgcttgcttgatatttcttaattctgaaatttaataatatgcccttcgtcgtgttcccccaacttggttcctgcttacaattcaattttgttatccaaacttctttttctggtcctaactctcagttttgcctgagtgggcactaaaaagttatcttcctcttcctcttcttaatgggcacatgggagagaacacaaaattctaagagctcatatcttagcgtctaattgatacggattaaaatcccaactctacctgggtagcttggtaaactcagaacttctctgaacctcagttttctttgaatagggataataatttctaaccaacagagttactgtaaagatagaagaacatatgtcacaataaacatttagcatactcaacatttagaaaataattgctcttattaaaatttttcccattattactgttgctgatgcaataaatggaaatatttattggagttctgaatatttttgaaatgaatgttttgtaaaatcagacacattatgaactgatatgaaagatgttcctgtgaaagaggaattgaaatgtgaagagtcacaaattttacgctttctctggaaccagaaaccaaacttaaagtgttctccagaactggaaagcaaggggacacataacaggctgaaaagatctgctatgagtgttgttacagactgaagtgaaagtgactgctggttattataaaatgttcctatgacttgtccatattgaaacagaaattataggcagaatgaacaggagggaacacaaattggctcaacctcttttacctggttaagctctccattgtacccaaatttaggccatttaattccacaaatatttattgaatacacactgggtatccagaatgtaaagagtctcaatacggaatgaattttatttttgattttatattttgaaacagtcttcaagttatagttataaatcaaatgggataatcacataggttttcagtcattaaagtaaacatatttttttcatttttttttaatgaacaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacaggttggttaatatttctttataaataacgtgctcattggatttaaatagagggtgcctatcaaatgtgatttaagttattaaataaaagctaagaagttatggtagtctattgtctgtgatcaggttgtcaccaaaacagaccttaggctaagaatttgcatgcaaatgtataataaagaaagtgtttataaagataaattaaaagaaggtggattaggcaggatacaaaagaaagaaaagtaaaataagtgtacaatgtcagttgaaatccaagactccactagatcctggtagaaggtaaagtataccctagtttgtcctaccttaagaaaaagacagatgagtctttgtacttccatgctaaatagccattggctacaggatgccctgaggtaggggatgtaaaactcccaggagcttgagtccagataggctttgtggccccagtacccaagggcagccttctaaaggcttcaggagaaagttgttaagagcaaagaatgaaaaagcaggaggatggacacacagaactgctataggaatttaaggccatgtgggcctggcactaacctactacatctgtcatcaatacatctttccttctggaaattgtattgttatttcttctctttttgaacctaacacactttcatataaggaagtacaaactgatctcttccactggcctgaatagtatatgattaattctccagacagagtgcactatggcccaactgtcctatttaatgtgatttaattctcttggagcttttatttcccttattagccttcttccattacatttgtaatgtcttagatatattaggttttagacttaattgtaggtgatgatagcagaaaagaaagtattcagaggaaggtcagctgtctactcttgaaattttcaagaagaaaggagaaaataaagcatcaaatcatgactgacaaatgctatggagtgttctttgtcccctctacagtaattttctcaccacagttaatgaataaagggcacagatttatacctgccattaagataatactatcatcctcttgggtaaaaataagaggagttatttttcgtgttttaaagataaggaaactgaaactgagaattaaagattttacttaatttaccaaaatcttctcttcattcatgtccacaggaacatggacataaaatcaaataagaaagtgaccattatccaggaaaatcattaggcagatttttattggcttcatggcaactctcatataatgagaattaagtaacagtctgtgttaagttttattcagaaatcagtgtataagaacatgtatgaacaccaaagtgttggtgtcaataccaacatcacaaccacctatacccatacataagagagaaaagcatagtgctggaataaaatgttatcagaaaagataaattgaacgctttttaaataatcatttttatatcactttttggtataaattttttgccatttttaatatctagaactacccagtgaactctaaagatttaagtatgaccactcttgccacctccattcaatatagtattaaaaggtctacacaattagcaattaggcaaaacaaaaaaaaaaagaaaaactatcaaaatatgaaaggaagaggatattgtttctgtttactgatgatctgcccttatacacagaaaagcctgagaattcactggaaaactgttaaaactgataaattaagtaaacttgcaagatacaaatgcaacatacaaaaaattagtagtgtttctgtacactaacaatgaactatctcaaaaagaaactaagaaaacaaccccatgtacgacagcatcaaaaaataaaatacttaggagtaagtttatccaagaaaatgaaagatgtgtacactgaaactatacaatattgataaaagtaactgtagaacacaaaaataaataaaaaga

SEQ ID NO: 12994 - DNA, 86956 bp, Human
gattattaataaccctgataagttgtagaaatgggcagataattacaggatgaacttaatagacagaaatacagagtaatttagaggaagtaaactgctgtaaatataagtgagaagacttggctttgtgggaaaaggtgggaatcagtaaaccacaaatgaaacatgaattagccatattatacagttgttttattaaaaaccaaaactttgtagagtacattaacagaaactgtatttaagagaaaggcagtcatcccttagtcatttatacaattatttattaagcacttatgtgctagttgatacttctgggtgctggaataaaataaggaaaaaatcaagatctctaccttcacgaagctcactaaagtgtggtaaatgacagagcaactaccttcaatagtctctagtttgtattctgcaaccaactgaatacagcaaatactaaaagctacttgaggtagggatccatcctatttttacctgttggatcccattccgtgcctagcacaccagcttgtaagcaatcgacatggattaaggggtaaaaacaggcccttaaatagctaaaattttgacaagtaatcacttgtctgatcatcaaatatgtcgttcgaaatcctcatttttttcttcaaagcgcagtaaacaagtatttgcgcacctattacgtgcaaaacagttttcaacacaatgctttgtgtgtaaaaggaacggcgggaatggattcaagttgcgcatcgtgataaatggcgtgaatatcctgagcgggtggacagcccttcctccgtgagttttttctttttcttttctagtcaccaagacagcacgcgtgtgcagaagctgcagcggtgggacgcagtgctaagtctgggggcgcacacaccagctcgcgcgtcgcgagctcgcctgggcagctcggcgggcgcggcgaaacagctcccacgtccgccttccaccgactcctcggtctcagagcggacgaggcgtccccccagaggaaagactgggcgccgcagacgccccttggagaagtccctggccactcgccccacctcggggtcctcttcctcttgggcttctcctgacccttcgggtgggcgctccagacaggcccgtcggacgcgatttggaaacgggtcgtgcccggcctagcccgcatctactcgcccggccacagcccagccacagcttagggactttgaggcgcccgcgcccctttgtcgcggtatctctagcccaagcaggccggacgccgaggcctcgcggtatcgagcctccgtccgccccgcctcctcgccctccactccgccccgccctcgctctctcacccctcccccgctcccgcctcgcttccccgacaatctcctcgcgctcccggcccggcacgcgcgctgcgcccggccgccgctgccgccgccgccgccgccgccgctgccgccgagcgttcctccgctgcgcctggcttccagcttcgggccggaaccggaagtttggggggcggagcccggcggaggccaggagaccgaaaacgcggccgagcccggagcccggagctggagccagagcctggaccagaacttggccgccgcctgcaccgccgccgccgctgccgcccgccgccccttccccgcgccgcagccgcctcgccgccaccgccgcgagctcggccgccagtggtcctcggactttaggtgtctgggttgaaggtcggtccggacatcggacccagtcagttcccagactgtccgggcggcagcggacgccgctgccgccgccgcctcttcgtcgcctcagcctggcgttttgttccgagagacgggagaggcgagcggagctgacagtgattttgacagtgatttaaacccgcttttgttgttgttggcttttcgttgtttggttttgtgtgttgtgcgtgtgtgtggcggtttttcccccgtggtgcattttattttttatcgttgtgctcttttttttcttttttttttttaacccagtgagcgtttttttttttttttttttttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtaggtgcagggagcgcggcgcggtggggctgctcctgcggccgcggcggccgctgctgggggccgcggctggtgttgagtcggagagtccagtggagcctggggaggttgcccactccctgcgcccctcggctgccaccgccccccccccccgcccccaggtctgattgtgatctggaaacctccatgcatttttctctttttgagttgggtcggcgagctgataagagtgagtgctgtgttgttgtggaagtgagaaagtcatgttttgtggccataacactggatgacagcgctggttgggttgcaattaagccgcaaataccacaagtgacaatttatgcaaaggttgagatctgaaaggagtatttagtgtgggctcctccaaaacaagggttgctttttgtcatcgtttaattagtgcttcaccggtgaatatcacgacatagatcaagccagttgctgcttaattttggctgtgggaaacaatacatcctatcagcaatttaatctgggtctcccctcacgttttcttcaacttcagcgtccagcagtgttaaaaatagttgtagttgttgttggagtattaactataacccagtgcagaagaggtatgccgcttggtattggtaatgtgctggcgttcaaccaccatttgtgtgctcttttggggcatagattttgcttacctacggaatacttattttaaacgctttgtattgaagcattgttttcggtttagaacaacccatgtgaaattgtttttgttaaatatagtacactcataaaataggttttagctcaaggttgggggaataaacgggccattttatattggaaattttgattttgtgaggacgttctatggttgcaaccagtggttggaaaaactatctagtcttttgtatttgaaattctataaataaatacagcatctagctgaaaggtgtgcagatgtacataacaggagagttagttcaatagatgaaacattttaaataagtctcattggatctatttattgtaaaatttaatattcagttacaagcttgtggcatagaattacgggggactcttggaaacgggggcgaattgacaggtttcatggccatgtctttatctcgtttgccacaggaaaattaaagggtggtagtcttctttgtgtacctctgtggggtgtgtgtgtgtgtgtttgtgtgtttgtgtccgtcttccccacccccctttaaatataatcttttgtaatgtatagaattttgctgaatggtacatttccttgtggttaataaatggataaagtctagtcttatgtctgtagtggtattgatcagttccgggtgggctgaatgtgttgtgaaatggcgatcattgccagagattaaccaaaagaatcatgtctgtttaaatggaagaaggaacatgcttaaggcaggctgacagttctttttgtgcacggtttgggaaggaagctaaacaatggtgtgtctgaaatgaatgaaggccttgataacattaaacctcttgcttttgtgacatgacttaaccatgtagtttttatctttccagtagtactcttttttcctctgcttctatatgttgtggctggtgaactcctcttgttcaaatcccttgttctgatctcttgcccttgaggaggaggggcatcatggccactgaccaaggaattgtggacattattccctctcaaacccacctgagtcacactaattgatgaaggaggttattcttgagcagtctcaaggtattacttcttgaaaagcaggctgtcgctacagatcttacagcttcttctgcttggtttggtagtaaaaataattgagcattagtttcttgtgggattattttcattgggccaggattattttcagtgggccaggaggttaatagctataattttgaaataaagtgattttgttgctgtagggcatatagatattccacttatattaaactaatattatgttgttgcataggctttttaagatgaacattcccagttgaactaaaatatgtgattctgttgaagataattgaaataatcataaagaccttaatccatatttatacatgaacaatttgagtacttaaaatgtctgatttttaaaagccttttgttatggatcagatgcactctaaaaaaggattattatgtttctccaactaattgatttttctacaaaatgtgtgatctgacatgttggaagcatgaggtgactatttttatgagaattttaaaaattctcaggttgtcagtttttcatttctagatatttgattttttttaaaaatcaaaatgggaaacaatagtaaggaacagttttgttccaggtgtttaggagggatgtttactatttcgtggactctgatttttcagtttccatcccatggtatgtattctggagactgattatgcagactattcctgtaggatatggccaagtgtataatttcctcctctctctcattccaggggaaacattttaaattttgcccctatcctggagtgccttcagattacctttgattttgaattttttcattcctctcatactttctcagattctgtttcaaaacataaatcttagttttctttttatagcattgtggtttatttgtgtctttccccacagtttgttgaagtatgagaatgactttaatacttgctttagtacttagatttatcctatctagagttatgcagctattgtggtatttgagttgcatagaagtaagttgagaattcctttggattttgtgggagctggagcagtatggtcaatgtatttgatgaaagaggaaatggaaatatggtaattatgttttcttcagttcagctaggcagtactgtgtatgtgtgaatgtatgtgtggttggagggggagttagcattacagagaatcttttgggattcttttgaactttgattaacaagtgatggatgataaatactttgttttctaaaaggcagaatctcttataaatggtgtctgtggtcaaattcaaatataatacattgaaacatggagactagaaacaaaatgaaacaaaattctccctccattcattttctatttttttttcctgtttatgatctaagccaacagttctcaagctggggtgagtccccctccctacttccccagatccccatccatgggacatttggagacatttttggttgtcacaacaggggacggggtgtgctactggcatctagttgggtagagggcagggatgcttctaatcgtcctaaaatacatggtacagccttccacaacaaagagttagctggctcaatatgtcagtagtgtagaggtcaaaaaaccctgttctaagaaaaccaaataccacatgttcctataagtaggagcaaaatgatgagaaaacatgaaaacaaagaacagaacagcagacactggggtctactcaaggatggagggtgggaggaggtagatgagcagaaaagataactattgggtactggacttaatacctgggtaatgaagtaatctgcacagcaaaccccattatacgagtttacccatgtaacagaccttcacatgtacccccaaacctaaaatacaaattaaaaaaaaaggaaaaactcagttctaaactcttaaattttaaaagcagtagtttattagtaaaagggctctgctctcttccccctaaagttagtaatctaaattttacaagtacatggtattgatgatctccaggtaacgttgtattgaaagatttttatcttttcattatcttttaaattagaatatgattaaattagagaaacagactatagatacgcacattctttcatccttgatgaaatgcttgagaattcaccagtatagtataatattttatactataataaaatattccaatgacttatggataaactctcctatcaccgattttgatagagtgctcatgaagactgcatgttcctggacataatgaatgattggttaaggtatcaagtttaattatatttgctttagatccaggattttctttgccatgatatgatctttaaggatatttgcctttatttttactgacatcattgggctgccttatggcggtattcgtgtgtgtgtgtaacatgttgcctgaaatatgttcactattacatgttccctgaatagtttcaaggtagaaattctgtttttttaaaaaagatatttcttttgtctagctaactttaatttcaagaaacttttaacctaatctcttaattacataattatcttgagaatcactagctgggttttggttaccgttagactaattcatgatacagtaagtaatattttatgatctattgcagatcgtttccctttttaaggctaaatcttgaccataattaataaaatgcttaccttgttttgaactctggttttaagggagttaacctagccaaccaagataagaattacagtgaaactcttagcaaattaaggagcattataccatagagaggaaaattctgaagtcattcccacaaatggtgtccaaatgagcctcacagtgtctttgtaacacacctctccatacccttctctctgatactgacattttcgccttttgggtccaccagactcactgttcttaagagaagcacaactaaaccaaatgagattttagtaatctctaaattgtttctttagattccaagactttattttgttgcattttgactttttaaagtgctactatgattttctcatctttgatatttcatgagtccaatgatttaaatttgtgttttcatggtctgttaagttgccagttgccatgttgtctcagattataggtaaggttggcaacatttgatactaggggtcactggtatgccttagctttttgctcactgctctgtaactcattgttttttccattccctttcattattgttccctttccattttcctcccttctttgtctactcccttttcttcccctgacccttctgtacttccttatactgcttgcttgtggaacccacttgtggcttagcatcatgggtgactccagagggcttacccgtagttttaatgaaaacagattgaatttagaatgcttgagaattgaccagatagtcttttccactgttttttcatttactggtttctggactacctcgcacaccctcttgggaatagtgttactctcttagaatcaaatggcttgaactttagattgctcttattctcttttttaatattcaggttttccttaactctttgctgcttcagaaaaagtttcgctcatcttattattcatttatcatctctgtttaagccaaaatttgactagaaccaagagtatatttattgctgctgataggaccacattagacttcctctgtggtagatttaattctgttagattgtaaaatagtcatgtctagacagaacattgatttcaaattgactatgaacatgaaaattccaggaatagtgtatagaggaaggaggaggaggaggagaaatcaagaaggtaagaaaactactgtagatagcaagtgactttctgtcattctccacctagatttcttgttagtcacttttgtatacccagtgcatctagaggtcaggctttgttttaataaagggacttaaaggaaatatgtttttgtctctgagattggattttttgaactgttagagtggtggacctaagggaaagaattggaaacttcatatggatagtgatcaagaatgtggtcgtagaggttggtagacttgagctctggtgtcagtgctgccagtatctagcttatgtatcattttctgttacttgattattgtagcacttttctagctaagattcaccagttccctatcactacttccttttctttctagtccatctgcatagctgctggagtgatcttattaaaaaataaatctgaatatgttacccttgcttaaaacctttcactgactgtgagtcacctttagcatagaatctaaagtcttagaatgtcataaaaggtccttcatcgtttggttcctgcctattttttctaacctcttggtattggttaagagtatagactctggatatagacctaattggtttaaatcttggtttcataacttaaccttggtcaagttacttcacctttgtgtgcctcagttttctcatctacacaatggggggatattaatagtgcctacctcagagagtggtttgaatattaaatgctagttattctgctgcagcttctcctcagcctgagtactatattccatccatacagacttgacttgcagtttcttaaatgtgtaatcctttattgtatatcagtatggtgcctttgtacatgttactcttcctcttctacctggctaacccctttttggttttaagactgagaagtatcacctctttagaaacattttctctgtcactcaacccagattgagttagttgctttctgttcatctaacaccttgtaaatgaccttgatttcagtaataattgcaaatgtttacttgcctgtttccactttagactgtgcaaatgtttactttcctgtttctactctttgaagacatctttcctttatccacacacccattcctggaacctggtacacaataggtgctcagcaaatgtttattaaatgaatgaaatgaaattatttcacttctctgagccacggttgtcctcttaatgtattgaagtggtgaacttggattagatgatccctgattttttttcctactctgaaagctttatggttctataattttaaggttagagttcagtggtgacattttattaagaaaagatgattttgctcattgttttgatatctttaagttatgttcaaatttaaatttttttaaataattaaaattagaatttgaattatatagatttagaggggatcttaggtatcctcatgttccatggctttcatacttttttgactgtaatacacaataggaattacacattgcattatgacttagttcccatgtagtagtaggggtgtatgtatatatgtctgtgtgcatcagaaatgaaagtttcatgaactgtgtactcttaactatgtgcaggacacttatgtatttttatattacatttcatttaaaaaacattgatcgtgacccattaattgattcattgaccaactaatggattgtaaatccctaaaaccagtgacctagttcaacaatccttatttcctgtattcagtactctcttagtggaaaaggaagcttcatatgtaaatgtgtgcaatgaaaaatatatgcactgaaaaatatggtcattaattaatctacaatagagactgtgtgcctaggtatagaatatagggaaaactggtctcaagggagaacatggctcttccctgattaaggtcttctctcttttggactagtcgaataaattaagcacacacgaaggcgctgaaacaacattagattgtaattttggggagttgggattttttaatttaggaaagacttgctggacttagtactggaaaaaaagtcttagacggagattaggaaggatgttaatatgaaggaaaagacacaaaatagcatcaggaacacaatagccatttgagagtaaacttgaccatggatgaaggcaaggtgggatggagaaattttgactaaatctgaggaagagatttgtgtgatgaagagagttcacaattgcttgaagaagtaggacaatctcagggggttaacccttaaattcaaatgaaaagtaattaaaactgaggaggtaagagtggatgatacatatcctgatgtatgtcccaaataccccatatgtggatataggactgaaaagcaactcgaagactaaggtagaatggtagcactactaaataaaattggtaaggaagtaatgagccagaggaaaattgaaagtgccttcataactaaaaaagtttacagatagatatagttttagatgataagcatgaatagaaataaagacatgtatttggaaaaataagagtacataataaaacatgataacgtaatattctcttaaagaggcagacactgtatgatggatatgtcttcattgtgaagtctagttaaagaattctaaacattagtggctcaatatgttgtttatgtttaaatgatggtcaaatttcagtaattactcatactggtcatccagattatattctttgaaatctgtatgagaccctacagtaaaatacactgttctaaggaagtagatttagatgcttttctgaatttggtatatggtattcacgcttgaaacctaaacttttcagtgaccattcttttggactagttttttctttggttggctgtagtcacactgggaattactttattctctaatattgctaaagaaaataaatgtaaagcaagaagagagttactacattagaaggactggctacacatgtggggaggggttgcctttcaaaagattttaaaaatgaatcaagtctttacatattgtaataaaagtaagcctatttataaagcttagagggaggagttttcgtagttatgattattaactttaaaatttttattttaaaggaaaagtttattgttcttcccatcttcataactatatgtgatatatcaagcttgctccaaggcattatttcaagaggaaggggcatggacaagttatgagatcttggcacatttctaaaactctgagattaacttttaaaatttgtaaaccaagatgtattaaatgaattgataactccacataacatggtagctggtccagagtagatcttacatattagtttttaatctatctttaagtcccatttaaaaggatatggtatgtaaaacattaaaaaatatagatttggttcttgggggatatttacatttgcaggttacttatcagtcagttaatgtgaaataatactctgactaaatgatacagccaaagaacatatcattatagagagccagatagctgccaataaatatctagaatattcagatatcgtggttccttacaaagagttctttaaggtctcactgttttagcatgcattaaaaagaaacaatggactaaatcgtctctatttattagtgggaatttaaaatatctttttttcttggacaacttctcttaaactttttaagtgttttaaaactttttagtagaagtaaagttttgaaagattctcaagtctgttttttaggtaccagctactttaagctttgaaaacacaaagctattcaatgactgtactttgagatcaatattttgaatgtggtataatattttggactaaaacttaagagtctgtcattcaaattcctactttcctactgactcttctttgacctttgacggccattaagatttcactttactcaccctaaattaaagagggtgaaataggtattcattcacttaacaaatcaatattgaactacatgctagacactatggtaagtgcttgggatacattattaaacatgaagacagatatgattatgcctttctgaagcttatagtcataaagtaagtagtcaaatgaacaacataattacagattgtcatacgtgctcggacagaaactaacagggtgccgagaggattactctttatttgccttatcacatatcacatctgtttactttatctgcctatttcttttttttttgagactgagtctcgctctgttggccaggctggagtgcagtggtgcaatcttggcttaccacaaccccagccttccagttcaagtgattctcctgcctcagcctcctgagtaactgggactacaggcatgcgccaccatgcctggctaatttttgtatttttggtagagagggggtttaaccatgttgggcaggctggtctcgaactcctgtctcaagtgatctgccctccttggcctcccaaagtgctgggattacaggtgtgagccaccgcgcctggcctatttcttatttgtcctttctaatattagaatgtaagctctactggggtggggaagggtgtgactttttcttaatacttccaatgcatggcacagtttctggcacagaggcgaagctcagtgaatatttaactagctgcctgaagcaatgaatgcagtgatgggactggagagatagggacaggatcatgcaggtctttgatgtaacaggggaaggagttagaataaaatgcaaatggcagtgtgaagcaaagagttttaaggaagagcagatctgggttatgtgttgagatcactttggcagctatctgaaaaacatactggaagagtgtaggagggaagaggtgagaccattaggaacctgttgcatcagtgtaagctagagagactctcctagatcccttccagctttgaacattctctgattgtattgtaaagcttgcctacacttatcagtcttccttttgtatcttattttagtcatcttattttttttcctacttgtcattgcttaaaaaaaaaacatgaatggataggcttcttgtgcatatgtgaactttgaatacaaattctcagaaaaaagaaataatgaaacgcagactagaggttattgaatttttgtaacaaatttctatctttagattttgtacatttgctaatttatatatattcttatttaagcattcctatttctctctgaaattggctttactccttttcaggtgtctatttttttcataagcttaccacctctttattgtttcagatgtaatatactatattgttggtatggttgaagattcagaagtagaaactcagtgtattttatatcttaattcttagaaatttgatatcttttcaggttatcaaggtcttacaataaaggctgaaaggatgaatacttaatactttaggctattagttttactcagggctgcagcctctaactctaggtattcagcttgaatgtttttatctggaaagatttcaatcctctcctgttggtggtaaagaggtggtgcttggcacagggaaataagctctttattatggcagaagttcagctgtagcatctgtgcctaggaaaaactgcattattacacacaggtaaaaccagaagagatgttaaactttactgaatttaaaaaatataatggtgcctgcctcttttcatctggtttcacttggattttttcattttggaagcagataaagctaaccatctttgataagccaccttctataaagttcagttttaccctataaatactataggtcattttatttattattaccttaagtaaaatagttctagaagaagaactggatgctaggcctttcttttacctggtagtggagtttcatacttcaggattagtgaatacagtttgctaattaattttatataacctaagactcaaaatgaacttgtaataattactaaaattatatgaggagaaatgaaaagtcaatgagtaaatgaggacgatgataaataatgaataattgcaagataacatatacaagacggatatggtaatagtaaagcaatttgattagtgggcattcaaagtagaataaaacacctttctgaatggccagaaaaatggttgaatagccactgaccatctttttaattctatattatataacaaatctttcttggtaatctttacttattttcctcctcagttctttagagatacatatacttggtttgggtgttgaattaggaaattaattgctaattgtagtttttgttaaaatgtaaatagagattgcttattagctgagagggttagaaataatagaggaaattaaattagcaagcttttactgctgggagggcctaacaaactgtcaggtactattttctccagtaactacctttatcggaatgatgcttaggaagaataaactactcaagctgatcctcacttctgaaggatggagtaaaagtaaaaggttagggtcagagaagaagggtggttatactttattttccttttgaatcattgaagagtagttttgactttttacctgcagatcttatttttcactattgtatccctagaatatccccacatcaagaactgtagtttctagttagtctagcaacatatatttagcagtcctcaattagacagtatttttgtaattaatatctagccttgcatctgtgatggaaggaaatcagctcactaagccagagcacagaagagtagaggagcctactctgttatagataatagaaccattgaaacgttatttgtcagttagggctggttaatagaaataaaagctcattttgttggtacatatgtagccgtttgttggcaagaatggttttctttaaaaaaaaaaaaaaaaaaacaaaaaaacccctaacacttgctttatcttcagattcaatgaaagtaattaattatgcagatctttgggttgatatagtagaaagagcaaacattctgccaggagaaaacctgggtgttgtgcctgtctaccacagtatggaatatcatgtgaacttgggaaaatttcattaccttagtttctattttatagtacctacctcaaagatttgagtaaggatcagaggctacacacacaagcccaagcatactcacataaacatatatacatgcgacttaaaaaaaaaattattttaagttcaggagtacacctgcaggtttgttacataggtaaacttgtgtcatgggggtttgttttatggattattttatcacccaggtattaagcctagtactcattagttattttttctgatcctctccctcctccctcccataggccccagtgttcccctctatgtgtccatgtcttcccatcatttagctttcacttgtgagaacttgtggtatttggttttctgttctgtgttagtttgctaagcataatggccttccagctccatccatgtccctgcgaaggacgtgctctcgtttgcttttatggccatacatgcaacttaaattatttttcttctctcctaccttttgctgaacatgcaacctttaaaactttgaaatgctatgccaaatatttgtaattaatacagttatgtttttcaaggagtagagagtaataggaaggattgaagggaactataccagcacttcgaattcagaatttgtgatgcctgatgggtcgacatttatctttaggctgtctgcaaataaaggggttaattccataaacaaccaaatattagatattagagggcttattccttacagtgaccttaaaggctctgtatgatatggccccattccatccttatcttttgcggtattggccctctggtagttcctacaacaaaccaactgctttttattcctctgagctttttttcacttgtttgtcttccattaatatttatgacaagggccatatcagacttataatgtagtttcttccatgcctggcacataacagatgcttaacaaatatttatcaatgaatgttgaatgctttcgagcacttagaatgggggtccgcagacatttttgtaaagggccagatagtattttaggcagtcccttttgcagtttctcagctgtgccagctgtaacacaaaagcagtcagacaatatgtaaataaactagtgtcactgtgttccagtaaaactttatttgtgggcactgaaatttgaatttcatataatttcatgtgtcacagagtattattattttgattttttttcaaccatttaaaaatgtaaaaaccattgttcaggggctatatacagactggattttgacctgagggctgtagtttgccaatctcttggacattgtataggtggcatccctcccccaccttagaaatatgtttaaaaaactttgttcgggagcattttcttatagaattattgttatatatgtaggttaagttcctagactaatccacaatcctgttttacttccagtgttttagtctagcaatacaactttgttttacccccaagaataactctgtctctgagggaaaatagatttagtattccttcttggaccagaagcagcacatattctccccagcactctcacagtttccttcttccctgatctctcttctacctgctggggtttgcatcctaggaaatactcttctaggggctcctgtagggtggaatggtaacaaaactaaaaagagctttctgtgtgtgattagagaggagggcatgggaggagaaaggtggagagaagagtgcaaagtagtttcttttaaaactgcagattacagcccatttgaggcttataaaatcagtgtagagggtcaccacagacaaaaaaaaaaaaaagaaaatagaaaatattagaatgaatcacccatagcatagtattgttttgtgaaacttcagttgtgtgtgtgattgtatgtgtgtatgtactgggtcacagtgaaaaatgtgctatgtggtcagaaaagtttgagagcctgtgttccaagggtttggggtactgatcctgagtttttttgtttgtttgtttttgtttttttcccttactgtatatgaggcgcatgaaaagtgtaaaggcagtctcttgatttcttgctacagtacgtttttggtactcagctaccttatgaggtagttaactgttttacagatgagaaaacagggtcatacagataaaaagcttcacaactgagattgaaacagaagctcaccagaagctcaccttattttagaatatgttcttcttccattataccatgttgtttttcctgtaggaaaaggagctatgtacgacttcctttgtgttttagaggacaaaaattattccagttggccacagctcactgatttcttgagacaaagcattggctttagtgataggacagggccactgaaaggtgtgaagagaatggttaggaactcagtagaaaggatgacgtagtatgtaagaaaggagggatttcacctttattttcttctttgtcctctgtagtactatccctgctccttcattcctcaccaccagctgggctcttaactcatgctagaaatagcacagaattgaggatgaggtttagtgaggaagggtaatataatcatgtctttagctgaaaggggaatgaggagggaaacccaagtagcagggccacctggccacccagatgggttggctgttcccaggtggcaatttacaagtgggtgtaggtaaaacagggcctgctattaattgtgttacaagcagaagtcttggctgtggaaactggtagctttgatacgctaattgaaaatagttctttttaaagttatattaagggaaagcctgtcttaagcaacacttggttagtccagagtcagttacccattttaagtacttaaaaatcataatatatgtcttttaagaaatctctttttcttagtttctggtaaaaactaatttatccctgattctgatctctaccttaatttggaatggttttgggaagaaaaagattgatgggaaggctcttcttcactaggaaagtaacagaaccatagcagacaggttggttaattgaacagaaagatgagagatccttacagaatgtgttcatcttccccaggccgagttgggattcttgcttttacaatgggaattactgtttcatagggaatgagttttaactatgtagtagtatctgaagacttagtattttttagcccatcacttgcccctacagtattgcttaccattctgtattataatatcttgttaatgtgtcaggctcccagctgaccctaagttgttacagatttttcagtgtaaagttagtgtgttcagcttaggttaagagtattgaagccagatgcctggtcctcgtctggaaaatggagataataagggtaacctactttacacagttgttataaagtgtaaatgagttgatagatgcaaagtgctttgaatgatttctcacatgtagcattctaaataactaaataaatattaattgctgatgctgcttgatattacccaccagtgtcaagctctgaactatttattgaatacgaacaagttataatgtagtgaatgtattcacaatattgaggacattccagtatatttattgagaaactgtacctttgtagatggccatgctgttttgtttaggatgcaagtagtgtttatttataatatttgtatttatttgactctgatttaattctagaacatcatctggtgttcagggaagaatactaatattttcaattatgtagtttattggtatagttttatgtaaagattttggggaggatcttttcagaaaagtgtaaagtagcatgtcattcagtagtatacaggttgagcatgccagatctgaaaatccaaaatttgaaattcttcaaaattcggaacattttgtgtgacagcatgatgctcaaaggaaatgctcattggagcatttcagatttcagattttcagatttgggatgcttaactggtataccaccagtattttgaaatattgaaatatttgaaatccgaaaaaaaaatctgaaatccaaaacacttctgatcctaagcattttggataagggatattcagcctgtattcccgaatgagagcacctgaaaaccttctttccaaagtgagagaaagataaagtggtgtgaatgtgtgaggggaataactgaaatttctaaaagtgtatcttgttttgttttctcagcatctgaatattaacatttctgggtagtttccgtgttttatagttttttaagtgatttcatgtctgtttctgttgatcctatttgagcctgtttgaactaggttctgttttgttttaactcaaaccctgagataatgcaatttgcctgaagtcactaatcagtggagctagaactaaaaccctgattttcaagttcagtgttcttttgtagtagcaaaaaatgctttctggcttttagagagtccccttccactgtctcccatccttagtgtttgcagtgatttatagagttggttgctttgcagataatctttgtaccacactttcagaaacccatgtttagagtctggggagccagaagtagcaatatagcaataataagcaccaaagcgaactctaattctagggcagattttttttttttttggagtaggggtcttgcttggctagcttgatgttgtaactataaatccacatgttaattgttgcctgaagtaaatttgtaggtaaatcctgccattgattgctgcagatgtgcttttctcaatcacttttgcttttgattaagaacatttaaaattgttttcctgggcagggcaccatggcttcatgcctgtaatcccagcactttgggaggcagaggcgggcagatcacctgaagtcaggagtttgagaccagcctggccaacatggtgcaaccccgtctttactaaaaatatgaaaattagccgggtgtggtagcacacacctgtaatctcagctactggggaggctgaggcaggagaattgcttgaacccatgagacggatgttgcagtgagccgagattgcgccactgcactccagcctgggtgacagagcgagactctgtctcaaaaaaaaaaaaaattgtttttctaacagtccattgctagatcagtctcattacacatgtgccagaattttacattattttcacattactacattacttgggtcaaaattggaactggcaagttatgtcacagcacaaccattatgtataacaatagtattgctaatgattaccgtttgttaaaactgtcattattaaccaccacttatagcatgctccctgctaagtgctattaagttttcatgataatgtgcctgactagccctacaaggtaattgttaccccattttatagataaggaaactgagactcagtgacttgcctaaggctatgtaattaagtaagtagcagaacttaggtctgtaaggcttacatctattctttggtatctactatgctaaaataatgagttaccaattccaggactgtgtgatgttttttgaacctgttctgccaaggttctctatcctgctcaagttaacagcaactactgttgccagcaccccttgaaacctatgatgtggtaaaaactgctgacttaccaaattgaagtgaatgatggtctactatgtttcctgtggctgataatagcagagctttctccacctctgaaatgaaagtacactgcttgacccttgaacaacgtggggattaggggtattgacaccctgtgaggttgaaaatccagatataacttttgactccaccagaagttaactaataataccctgttattgactggaagccctactgataacataaacagttgattaacgcatgttttgtatgttatatgtgttacacatatacatactattttgtatgttttattgtattcttacaataaggaagctaaaggaaagaaaatgctattaagaaaaatcataagggagggaaaatatttttactcttcattaagtggaagtagattagtcttgctatctcagggatggcagaggtagaagaaagtctgcatacaggtggattcacacagttcaaacccatgtttgagggttgtttgagggtcagctgtaattgtccatagctgcttaaaaactgagtaacagaagttgttccttttggttatatagtgagccagaatcagaactaggtcagaattcatttgctctgatcaccacttgagtaattagagaatcaaatgttcaaagtaaatgcatcttcttaaaatgattataccttgactcagagaagttgaattaattgaaatttgctcatgtagaagaaaacaaatccatgttgcttttgactcatatttagaacataatttaatgttagtggtcattaattgctcattggtgcctgtttcctgtgttgggtgagtgagcaagaacatgctagataagtacgaatagttctggcattaggatttgtggttcccctcttcacattatttttaagacaaattgattaaatgatgtagcatactttgtttttcctaattgaaggacctcaactttctgttactataactttttgttttttttgagagggagtctaactgtgtcacccaggctggagtgcagtggcgcgatgtcggctcactgcaacctccacctcccagtttcaagcaattctcctgcctcagcctcctaagtagctgggattacatgcgcgctctacaacgccccgctaattttttttgtatttttttagaggtgaggtttcaccatcttggccaagctggtctgaaactcctgacctggtgatccgcctaccttggcctccctaagtgctgggattacaggtgtgagccaccgttcctggcctgttattgtaacttttaaagtatcaattagcttgcagaaactgagatatgaagagaataggaagaaagggaaatttcttatctgtgttttttaggctagggaatatgaataaaaggtggcaaaggagtagtgaagacaagtaaaaaattcctagggacttgatttgaatttaagggatggaatttatagaaaaccaaatatagccataatccgtttagttataatttccattataattaaacaataatccacttagttgttgaaatcaaccaacaattaaggggaccctactatgttcgtctcattgtgccaggtactatggagcttacaaaaagagtgtaaagtttttaattgtctaagaaaacagtcactttggaatgataatccatatgctctaaaaatacacattctgaaactaaaaatgcaatataaaaacatgagatacattgattactaaaattaatgatatctgacaccaagtgactttttttttttgggaggcttggcttatcttttaggacttcactaggttagggatgcatttcagattctactccacctagtcttagttcttggccttgtttctttctgaatttattgctgctaaaataaaaccaccacgaggatagggattgtggccctcgtgtttattaccacagtcctagtgtccagtgctcaataaatactgttgaataaattaatatgaaagtcttcctttttcctctcaccgtccagtttcttcaaatgattcctctgtatgtggctccacatccgtaccttttgttccctctttaaccaactgttaacctaaagtaagtgacataattctctcaaagattaaggattttttagtagcctaatctaaagcattcttattatatttgattatgaattgacttttctataagtttgacgctattgtctgcctgtttcttctcaaagttctcttgtcctgttacactcccaattctgtagccccttgctacctcagtattcattctgcccatcctttttgtgttgctgtttctcagagtttaatccttaatggaattttgctctacatacccttcctgttgaagtaatcccatctcatcttcactttttgactaagtgtaggagatgtccagagttaccttgctgattctgatctccctcctgagctccaaacttatttattagtcatctagtaaatgttaagtatatgtcacaactgggagaagagatgaataagacacaatctttaccctaggggattcatagcctagtgggaggagaatgattagtaaactagcatttatgcagcacatggaatctatgttagagtcccttgggatagcagaagcagcttttggaggggggtcaggtaatttttcctacagggacacttgaggtgatcttgaaggatggatgattaggagttcaccaggtaaatagagagggaggaatattttatgttttctctgtcaggcctggtgagttgctccctggtggtgagacagctcagtatggacaagttttccaaggcccgaggacagttagagagtaggcccaggggagccaatgtcatggccaacaaaatggtatcaagcattaaagccagagggttagaagtgactgagaaaacaggggagttaataacaaacgaaatacatgactactcattcaaagcagtgtatgtaagggaatgatttagactaagactctgaaagtggcatgcgctgggtttgtccttttcagtgatacctgttgtatattgccgtagccaccatgatagattaaagcagtgcttctccagctttaatatgcataggaaccgcatggagatattgttaaaatgtagattttgatttgttaaatctggagtggggcctgaggttccgcatttccaagaggctcccagtgatgccatgcttggttcagggaccgtactttcagaagaaagagattaaaggagccaagaatggccaaatgcagaggaaacaatttatacaggcacatgaataattgttatgtgtttcaggaactgagattagttcaggacactgagatcttaaggcatatatgggggatggagcagtaatgggagacgagtctgcagaggtgggtaggggtcaggttatgaggggctggatttgctagcgagtgttaacttcatgccaaggactgtggaagggccattttgagcagaagagtactattatcattcaatgctttagaatgaagagatgaattaggtttttatcaagttgagttcaaagtacttgtggcccattctgatagggatatcaaataagtagtagaggtagatctaagctgggcagagagatttgagtattcagccaatagatgtacagcatgaaatcaactaggcagaatgaggaatgaaaacagaccaaagatctaactctggggaatgctgtcattttcagagcagggagagaagttaaggaagagcttgtagagaagatcaaggtgtgtccagaaaggtagaaggaaaacaagtatcgtttcattgtaagaaatctagatggagacagtattaaaaaaatgtcagatctaataaggtagagcctgaaaagtcaccactagatttgtcaattaggagattatttgtaactttaccaagagacattttggtaaagtggtggagacaaaatccatgttgtaggagatgagtagtgaaatgtagatgaggaagtggtttcagctgtggtctattacttttcaagaaatgttggctaagaagggatgtaaagaggtggggaagaaagccagagtcgagatgtttctgtgcttaagagttgagttcaggagagagcttacagaaaggggaaaattaaaattgaaaccatttggagccagaaacttggctgccatcttcaacgtgttcttcataatgttcttcaaaatccaagcaattactaagttctgtcagtttgactttccatgtgtttcttgagtctatacctgcttcctttccattaccaatgtgttagttccatccttaccatctcgtatctggactctttaagtggacctattcctcccttactccagaaactaaacaaagcaaacaaaaatgcaccagggaaacagaaaacttcccttccacactctttgctagaaaccgtggagattacagaaactaagggatctatgaaaatgtacagatctgctcctgacagttaacttcttaaaaccccttacttcttgtcacttacaaatggtgaaagtcaagctttttaacaatacacgcagtacccccaagattattcttttccagcttcatttcctgccactcactgcctcccactttaatcttacaacactagaagacttctgatctttactacccttgtgccttgtgcctctacactccgctgattttgtacttcctgcaattactgtgggacacctctatctcacctcttccctagcaagttgttaggtgcttctttctgtgttcccatagcaccttacttatttactgattgttacactttctacattattattttctctacttctctctcttcacgttagaacttaacaagtttttctcattcatctctgtattctccgtgagtggctcaatgctggtggaatcggcgcccagttcacgttcactgaaatgtgaagagtaatacaaggaggtagtggcatttgtctggaccttggaagaatgataggatgtcaccaagttccctttgatggggaagaggattctgtacagagtggctagcatacgcaagagctttgaggcagtcaagatgataatatttatagataatgctgaaaactccctttagacaggagagaagaagtggaaaatgtaatggcagataacgttagaaaaataagttgggcacagatgaaatggagcctgggatgccatgttttaagatttttctttccttttttccactgtagcagtgggcaacctttgtgtattgttaaaaagtagaaaataacaccaactcttgaattttgaagaaaggttctgtattttctggaagtatctgatgtggataatctgttccccgccccccccaaggttttagtcatttctgtttctgttatattttattttattttatttatttatttatttatttatttagagacagggtctccttctgtagcccaggctggagtgcagtgacgggaacatggcttactacagcctccacctcccaggcccaagcgatcctgtcacctcagcctcctgagaagctaggaccacaggcatgccaccacacctggctaattttttaattttttttgtagaaatagggatcttgccatgttgcccaggctggtctccacctccagggctcaagcagttctcctgtcttggtccctcaaagtgctgggattacagacgtgagccaccatgcccagcctttattttttttcagtttccttcctaaagataagatgttttgttttgttttttcagttctcttcctaaagattatagcatgtttgcccattttgggtataagtactttctgtcactgttctttcatatctttaaaagcagtccttgacgagttctagatttgttttctctcagagataattatttaataatataccttgcattatttttttctttaatattagaaaatattctgatacctactttcatattccttagaaaactttctacatttgtttccttttggctggtaacttgctgttcagaattgcttgttgaaattggtaaacctggaagtgttaatatacgtatgcttttccaggttatttgtaaaagtgttgaaattgattttgcatcattcataagggagactgactattcttccttgacgtttgcttattcccttaagccaataatctagtttatgattgcaagaccctcgcagttgtgtttgcgtgtgtttaaatgtggtgttgtcaagttgtggaaggaaatccagggattgaatgtgtttgggaaactgttagacaagattaggttaaataggggaataacatatagggtaacagccattgaaaagcagtgtgccttttattttgttgctgtggagaaaacagaaagctgtggcctatgcttatgctctagttgaagggagaattctatatttaaatcaacagtaaatgttacaatatagtttatatttaaatgcaaaattgcatgagaaaccagatgaataccagctgagtaactaagaaatccaggacaaagaaaaatcaagaggcaaagtaggctggaaagcttcatgaaggaaatgggacttcagtgaaccttgaaagatgagttaaaatctatatagctggaaaagtggttgtggttgagggggtgagaagttgcggggaaggcaagggaaggggcatgaactaagatggggtgggacagtgagaacagtatgtttgcagtgtagggtttagaactgggttgggagggtcaattattgccaggttatttatgtaggtccttgaatgtcagagtaaaagagttggaaaggtgtttggggctgtatgaaggggtataggtgggtgtaggggtatatgggaggacgtatgaggaggggggatgtgaggtatgtgggggatgtgaaggtgttgtcaggtgtgtgagaaggtcttaatgtggtgtattctctaaagcaaaataaaaaaattagtagagtgaaaaatgtctgacctataagaaaaccttctataatcgtaaatgcctgttagtcattgtgattagcataacattacagtaagtattggcctattttttcctctctttaatattctacttgatcatctttgttattaatttaataaaaaatgctacttataatctgaaataactctatgtatctgcccttttttgatttagtctttgggtgaagtataccttgccacaatgctgaatttaacatgccacttctgatttttcttgttagagtgtttgagtcttgagagcagatgtcacatttcgtacaattctttggcctgtctagtaccctgtgggctgcccggtatggagttggcactaaatattggagatctatgcattaacccttacgtcttcaggcttggtaacctataaagtcagtatgcagtaactctgaatatcatagataattgtcgtgagtcttttagttgcaagaactgtttaccctgatttatctcatttcattctcctgtttaatccactgactatatcgtgaagacaaccccatttttccttcttcccttttaatgagtttcctttttcattacttctcagtacagactgctttctgcatatgtgccattcttttccctgagtaccctcttccttctttatatacttctttttatactttccaaatatagctagaatctttttcatatactgcttctatgaagccttttttaattaatcttttttattccttttagtctttattcacattcctcatgtattttgtttgccaataagctataaattattttcaataaatttctaaatttttgatatgtttgatattcagaatgaattgcagattccccaagggcagaaaaagactcttctatttcttttggtgtgtttccataatgttttgcatatactgagcatttagatacggttattgttacaagctcagtctcctgtcctgtgcctagagctcatgtgtggaaaggtgcctcccctgctttattaaaagtcctctggttctcagacttgatttttttttttaaatatacatttgctaggaagaaattgtttttcctttgtctttgtcaatgttgagtaaatgccaatgagttaatatattaatactacttaaattagtggttgaatacgctttattgtgcatttagctcctgctaataattttctttgcattttaatacctaaattctaagaacctgaagggacatcaagaaataatttaatttgatctacttttaggtcatggttttattcaaataagaaaatttgcagaatatctagcctagatgtctctgcatttacgtaggtatgtataaaattataagtacatttttatatcagatatatcaatattttgtgaagaaaaagtaaaaagaaagaatatgctgtttgctgtatgttctagcaagcaaaagtgtagaatagctgctcttatgccttgcactgccttttcagtttcaatggaattgagcagatatatattgaaaaactcattgtgtaatattctgaggactaagcctcgttgttagccatctgttaagatttcattttaaagacaaacttgccttctactctttggggtcacctagagagctgcttaaattgccatcttcttgctcttcttttaatcgacatcttgttaatttttctgctcattctcttctcttgtttctttctcccatttgcattccttatgacttgatttcatttgttcattgatctttggcatgagtaggagaaaaataatttgttgaatgcctaccgtattacagatttttatttatgaagattgcttgttctctgatgcaagttcttttacccaacatagtgacaaacctgatcacgtattttccattttctcctttgagttagcattgaaaatatggagcccatggtttgatacgtatttattctaccacagcaaaattttaatgattgatagctcacttcttaagtgtgttccacctgccacttttgcatctaccaaaaaaagtcatacattatttttgcacattagccatagtatgtaaagcccaattaaaagtaagccatgcgttgatgcaaaaagcttattatgtcttaatggaaagttaatatcatggacattcaatgtgttgtgtaattgatttaaagcattgatagcttaccttatgttgtgcttcatattttcagaatacttttcaacagacatttctctctcttgccccttttcagtctggcagcaatagactgcagtgatttttttatttgatgttctggtttatcactgccacttgtgcaaattcaagaaagttgtcaatgatgtatttcttggcccatacaattaacgaagtgttggcttgatctcttcctttgacatacaggctactagatgaacatggtagaagtctgtggtccctgagtcattttgttgagcaggatttgttgtagatgtttaaatgcatcctttctgaaaattatgatgttttttttcttaataacacatcttttaactcccagcattttgtatgcatttagttttacatatagatattttacaagtagaagttatacttgtctttctatagtttccaggattttctttttcctttgttagaggtagccatcactttaccttcttggaggcacattttaagtacacaggagagaaagcagtaagaaaagttccagaaattacttgagagagtaatttccaagtacaagataggactgtttctagggtaggcaagaaggtggtttatgtgttcatttgtttgacagctgtgcctatttgtttgacacttgtattggagacattcatgttagcttattgttttccttgaaatgcccacatacattatttgtgatgagacatcattttagattttttaattggatgaactagttggtacaacattgaggaaatgattgaacagatagagtggctgtgttctaagaatgcctcatatggcatgggttataatgaggtcattgggacaatcaagtttagcactatggagtgtctagagtggtgctacaaaagaaatgcaatgccagcagcaaacatgagccaaaaaatgaaatttcagattttctagtagccacattaaatgtttttaaaataaaattaattttagtaatgtattttattcaacagtatattcagaatatcatttcaatgcataatcaatatgaacatgattaatgtgggtttttttggtgctaattttttgaaatccagtgtgtatcttgtacttacggcacatctcaattcatattagccacttttctaggactctaactatacatggctagtggctactgtattggacagctaaagtctagagcatttggtgaaattgtgaaattgtgatgatgccaggaaattggggaaagcataagaggagcaaatatgaatctctaaggtagaccttgtgcagggaattctataggaaattatatacttttgggagagagtcagaaactggtgtggaatgaaactttgatgatggtgaaaccatttggaaaatgagaatggcagagattcaatagaaaatgaaaataggaaacggcagaacttgacaatgcttaatattctatgacaaggccaaaatataatagttggttctttttaagaaaaacatctttttcatccaagggctttttagcctaggctgtgtctgtgtagcctggaggagagaagtagttattcatgaaacacaagagaagccattgagatcagcagataaaattgattgcagaggaataatgtggatagcagcgtggcatggaggatgaattatgctaatatagtagagaggaagagtctgaggtaaatgattgatttttgtaaagtaagaactggacaaagttcttggtgacttaagagcaaatgaaagattaggcagaatactatatcagaatttattgctttgacagtgaaataagataggacctagtgatagggactttggtcacagtatataagtggttaagagctcatgcacttaactttaatccagtcttgaccacttaactttgcatttctttgcaagttacaattatccaggtctcagttttttcatccataaaatgggcagaaacacctacttcatagaattacatggattaaatgagattatatatgtagcaactttgactagtatgacacatcttcctgttatttgtcttagtttgggatgtccagaggggaaaaaaagagttaccattgtgttttcttggaatacatgtttatatcacatcttctaagttgttaccccttaaagcagttttcagagttcagcttggtgaaatctcttgattatttctcaaactgtggtgtgaggacctccggcattagaatcactttggttgttagataaaaatatagattcttgagctgcacgttagggctgctcagtcagtctctgagagtagaaccaaggaagttttattcaacactcaaatatagctgttgcatatcacatccaattggagaaccactagaatggatgattctaagatctggtttggttcaagatgaatctactacgcactgtgttaatctagagtaggagttgggtaggaataataatacctattcctgtttacaacgtaggattgttgtgggggatgaaataagatatttttaagtttgtaaaagtaggtttaagttaaaagatatttgaagtttagactcctgtagattgtaacatctaaagggcagtgacttttctgtactaggtgagtctaggtggctcatagttgtcattaagtagtttttgatgacaaatttcctgtccaccaaattatgagcttatttttatctctttcatccacatttaattttttgcttattttacttgtgtagaggcgaagcgggattatagacgttcaaaccagatggatatataatttgaaatattaatatctgtttaaatttagaggtttagagtgtgtcagtattataaatttttttctcacaatctctgtaactcattaatcatttaaggtagattgttctgtttaaggattatctgtaatctacccataatactcttttccatcagttaacctcttctgctctcaattaatgataaaaccaacccagaacaaaaagccaccctaccgtgagtgtactttatggggataaaatacaatctcccattttctccatttccagagagatgtatatgctctcttattgagcagtgtaactactttgtgttcattacagtgtttcgtgctttaaaaatttttatttaatcctacacataactaatagaatctcttttttcccctgtggaaataaaaaaactgcttattaaaaatgcagagccccagacgaacagtacactttgagagaatttcagtgagtctggaataggcctgcaaatcagcattttgatgattttgatggaggttgtgcactgtgagaaacattgctctgtttcttattacctccagaggcataaatatgtaggtgctgtctacataaaataaattaggaatggtatgcttccagcttgaaaatgaacaaataaatgtacatcagaactccatgtatgttggtgtatgtttcacataggaactgaagatgatattagcacagatgtcagataaagggacaaacctaccatccacaggttacaagtgtttagtattacagaaaacatttttataaaaaggaagatcataggacatgtaacctctcaaagtttatacttctcagccttcccttttaggttagcttcagggatctagaaacattaccatccattacagaaaactgaaagattatgtggcaaaataaacagggaagcagaaatagaatagacagtgtacttctgttaagaaaaagtacttacattaagaaaaactattgagctttattagatactgagtactgtgctcttgcaagcatcttctacagcactagtgttcacctcttaaaagcattaaatgatactggcattgccttcattcccttcaatcctcagtttttggtcctctttcctcttcctaatttaaacagtctactcactgttattctattcttgtaatttgtctcacttttttggcttccatgacttcttgcttttcttttttattgtatagtataaatacaaaatgaataaaacagcttctaaaagaaaatttaaaatatgtatcaaaagtgagcaaaaaatttaaatttggtttaataaaacccattttctttatagcagtgttgctgttttttcttttaggtatttaccccaaaattatgccttgaggcatatgcctcaaggttgaggtatatgccataaattgcttatttatatttttaaaatgctaatattaaaggctaagatcttggactgtgtggcacctagggacataattctcatcagcctatcactgtcattcacttcatcagaattacaagggcttttaacacctgtagatatgtaagttcctcttgcgctttcattgcagttgtttcctcttcttaatttgtttttaaaaagcagaattgttcttcattagaaattggagcaggtggatgaaagtgataaacaaggagaggatacgtgagttccactaggaattggtcttaaaatttagtggaaggccagggattagaattggtgacccctgactcatctgccagccagttgcttaaattgagagcagttctgatagacacagttgttccttgtgtcctttcaactacattttgtcttctatatgttgctcctgtcccttcaccatgtcctcattgcacagatacgccactgagtttgaaaagggataactggtagccttattagtaaagctgctgtgtctctctattcttttactttcttctacacgtcttgatcgcaggattttatgctctgggtggacctgaacgtaaaagttggccagctgtggccttatttagtttttggtattccaaaagtagcttttaacatggagaaaagtgccctattatttgaacttttttgaatcttttggtatctttcagtggcccactagtaagaatttttttgtcttatgtttaaatgtttcactaatagaagactgggaacagttcccaataattattatggttctgtggatctttgttttttaagaaaatgatggatgtaaacatttctctgaggaaagaaatgggggaatgacattcaggataggttgacaaaagtcacaaagtttttttcaagacatttgttttattaaaacataagcaaggtgcttgctttggcagcacatatactaatatcggaataatagagaaaacattagcatggcccctggtcaaggatgccatacaaattcatgaagaacataagcaaagaaagatatatcaccttgttaatttaactcttccactgttgaatttaaagtaaggagttaaactttgtttattattctttagttctacttttcctgaacaaaaaattgcttttactctttgcttagtaaacagtttttcttattttattagttcacatagatagtaaaacttatcagtcattgattattgttgaagtaaacatgacctttcaagtgaaagttatattagtgaaattgataaaatttgtaaactaaatgtgagtaataggctttacagatgtttatatgaaagctttctgtttctgtagggggctagtctacactgtgttgtccatgttctgttgctgtgtcttatctatgttctgctgtaacttcgatccttgctttaaactttacatttatcatgctgctttttttactcttcgaaaactgtatttctcaattaccgactatacagagaaatgtgaatacttatagtagaagctgttgcctgtagtatgtgattttttttccattaaattatgagggcaaaatctatagagctactattaaaataattctttgtggtaattaacataggacagaactgtctttttgttagattttaggcagtgttaatatagcaagactataaaagtgtcagagaaaaattttttattttggtttacaagacagaattaagctggatttggaggaaatgtttttaattgtaaacgtgaaagatttaaattaaatatactttggaatattaaacaaaaacatgtgtgtgaatctgattttattattcctgctactcttcttttatagtacttacgtaagccagtatcgaaaacaactttggtgattgttgaaaggtgttgggttgagatttttacctttaaagtggacagacatgacttttacaaataagacttttacttttttttttttattaagaaagaggccaggaactatgaactagatttagatatttatctgatttagaatgtctatctgaaatttttggttgccttttctctgagtttgaggggaagactgcccttgttttgtgttacagtgacttagggatttttagagaaaggttattaaggtctttcctaggctgggcatggtggctcatgcctgtaattccagcacttcaggaggccgaggttggtggattgcttgagctcagaagtttgagactagcctgggcaacatggcaaaaccctgtctctacaaaaaaatacaaaaaaaagccggtgtggtggcagccacctgcagtcccagctatttgggaggctagggtgggaagatcaattgagcccagcaggttaaggctgcagtgaactgttaccatgccactgcactccagcctgggtgacagaaagagacctgtctttaaaaaaaaaatctttttttggaggaaaaggtaatggttatagaaaaatcatataagcttaactgattattttaattttttaagagtttagagaatagtatgatagtttcttgggagtagaccatatggtaaatgtatgtttttcaaacttactaaatgcaatcaaactgttttcagtggttcaagaagtatttgcaaattagagatgatattttgctttttttcatttcattttgtgaactggtgataactgtttttcaactttgttttactctgttttgtgttgctattacagaatacctgagaggaggtaacttataaagaacagaaatttcttctcttacagttctggagactccaagatcaaggcaaaggcatctggtgtgggtctgtttactgtgtcctcacagggcagagggcagaaggacaagagacagcccactcctaaaagccctttttataatggcattaatctgtgacctaaacgccaccattaggccccacctctcaatacattggcaattaaatttcaacataaattttggaaggggtgaacatttaaaccatagcaaactttttcaaacattttctcaatgttttagtccactccattatctcacctattaaaaggaagttagggatggggagaaagtggtagaaagaatgtatcaaggcctgagatagtttgatgttcaaagagtgtccacttgtctcatgtgagttgaggctaaagaagagccaaactgtggaaaggcctgtaagatttgttaaagattttgattttaaggccaagggtagtgggaagccattgaatggctttaagttggggtagtgacttgattttgtttgctttagtaaattgtctgacttgtgaatgaagaactgattagatgggataaaatggaagctgggagaccagttaaagaggctgttgctatagtccagggagagatgttggtgacttgcagtaataaccttccagtgatactcacattctttaaaaatctaacttagattttctaattctaatgcttatgccttaaacctcttccctgatgttcttttttgttgttgtttcaattctctataaattctcatttgacaagctagataacatggttttattgttttactgattaagagtgctagtataaatgggtgatatctttatgactagtatgaattcctttatagagggtttatttactttctaaggtatcattactacctaccatcaagaagctgttatggttgctgctctgtattatcaagcagtgatgactagtaagcattttttattttaaaaaaaattttttatagtaggttcttgctatgttgcttaggctggtgttgaactcctgggtgtaattctcacacctctgccttccaaagtattgggattacaggcatgagccactgtgcctggccccagtgacattttttaatgccaactcaggatacttcaatcatttttttatatttctttattaatctttttattttctaaagtcagttttaagacaaaaatctactctttccagaggtattaacatgattttaaaaataataaagtaccttgataaagatgtatacttgaaatcctctgtctttatgatcttctagttacttgtctatcattccttccttctgtcttaccttgcaggataaattagaataggccttagttgagtttcagaattattgaaagatttgtgagttcttttactttctacttgttgtgtcttttgaaaattgagcttctcatttttctcttcctttcaagaagttagctatttctcaaactttggaattacttttttactatttctgcttaatacctaggttgtcaaagtgcctgcaactagtatgacagcattagatatttgttgaatgcagaagatgctgtacctgtgtgaaagacctagtgtcctctaagatttcttgtagcatgtcaccagaatagatttcaaagtgtcctgcccaggggtggaagggctagaaagggtaaaattttctcattctgaaggggaaaacactgggctcctatttttccctctttgtttaatggaaatctatcccttttataatgttatgagaagcttacttatattggttaaaatgagaagaaagcaggtcttttcttaaaaccatttcccctaccccatttttaattattaaaaaggcacagggaagttgagatctggaacattttcaggctttcttggcctgtcctagcaaagcagtcctaaatgtggtcccaggtgttattcagttgaatgataaatccgaagttttgtgatttgctcttttcctggttcctgttgttctatatatactttttgtatttagggaagtgaagttttttgatagttgattttaaaatcagtgtctttattctgggctaccaaccaaataataacaatttgaagtatatttcttcccaaaaagatgtcaagtcatttcttaagagtgttagaacagttacctttaaagatgaaatgattcttggttctgatgccttcatattgtaatttttctgcctgtacatcagtgtgtctgtatctgtgacttgaattttttttttctttcctttaggtctttttggagaaaacattataatggatgtctagttatttagtaattgaatgcaggttagttagcatctttttttttctcctctcaagaagctgcttagtgtgtgtgtgtgtgtgtgtgtgtgtgtgtgtgtgtgtgtatgtgtgtgtgtgtgtgtggttttttttatattagattgacagggcctaaaatgttgcattgccaatatagaaattttatttgaaaatttattcttttttcatatatctaacttgtctatcattaagtttgtgagaggataggacaaaaagatgctaactaacctgcattcaattactaaactaagtaacaacaagccctatgtagagtatcttctgtatttagagaaaggtttaagaaatttaagtcctctaaaaattttgttaatacaaaaatgtaccgtttgtgttgaactggatctacaatttaagtgaattaagaaacaaactattaagaattattttaaaaggatggttgcttgtctcttttataaaaggaaattctaccattacaaatttgccactctctttgggactctaaaacttttatgttgaggcattttaagaaagagatttgagaaattgattgagttattcaaattttggtctgtatccaggtagatatatatttatttggagccatctatgtggggataattagtcatttaagtgttaacaatattgaaatacgttttggatgcttgcctttgtaatttgtcaggaattaacattagaagaccttaaataacgctggatgcagttgctcatgactgtaatcccagcactttgggaggcccagtggggcggatcacttgaggtcaggagttcgagaccagcctggccatcatggcgaaaccctgtctctaccaaaaatacaaaaattagctgggtgtggtggcgtgcgcctgtaattccagccacttgggagtttgaggcaggagaatcgcttgaacctgggaggcagaggttgtagtgagccgctaagattgggccactgcactccagcctgaacaacagagtgagactctgtctcaaaggaaaacagcaacaaaaagaagtccctaagtaactagtggttaaatgttgacttccaagtatttttactctccttacacatgccacatgcacattgtctagtgccacaacatataatgtttatatttttagtttattctgtgctagttgtgcttttagtttagtaatagaaatatattactttagttagatggatggaatcttgtaatgttttgtcagactgatagtaagtactaagtatggggtattacagacaagaggaaaaaaaatttctgggaagaaagccagacaatgtttgtgttttcctttagaagtgattgtttggtggtgggaaggggcttagtttaaaaaaaaaaaattagattgacagggcctaaaatgttgtatggccaatgcagaaattttatttgaaaatttattctctttcttcatatatctaacttgtctatcaaaagtcttttgggacagtgtggactttatgataacttttgaacagtgttacctttcataatgcttaaaagcaacccagggcagccaaataggaaaggtgactgcctctaggatgtgtatcaatatagaaaagaaaagatatcaaaagactcaatgtgtagtaaaatgagtttttttgtttttgtttttgtttctgttttttgagacggagttttgctcttgttgcccaggctggagtgcaatggcacgatctcagctcaccacaacctccatctctcaggttcaagcaattcttctacctcagcctcccgagtagctgggattataggcgcacgctaccacacccagctaatttttgtatttttggtagagacagcgttttgccatgttggccaggctggtctaaaactcctgacctcaggttatctgcccgccttggcttcccaaagtgctgggattacaggcatgagccactgtgcctggcaaaatgagttttcaagtaggaaagaaactacataatacacaaaagtaataaacaagacattgagatttttttttaatactcataatcttgcttcttaaaagttgaagcaacatagttatgaaaaaaactgttggtgattatggcctgttaagtgattctatatccattgttatttaaggtcattatgaattatcagcttaccatcttctactgtatttaaagctactctaatatatattgttaattttcttcattagctggttttaaatgaccaaatattgctttgatggaaatgtttgtgatgaggtttttgtgctttgttttatttttgtttttcaaatttctcactcttaacattgctggttcctcaaagatgatttcacattatcttcatagcaagcagaagtgatccatttttactctttctgtgacagattgatgttttattaaaaagagggcctgcatcttcctaagtaaaataaagcactaaacaaacccttaatgtaggtagtgtcttttcagtgtaattgacacttttaggttggtttttgcaggaactagtaggaactattgtgtgcatgtttgtttccttaatttttttagaagctctgttctgattttgagaatttaccttttatctcttattcttctaaatttatgcccgattttgtttttttgtgcatttaaaaaactagcctataaattctgttgcaagtattggcctctagctgcagtcaccattatcccttctccccgcaaagaagaacatctaatgttagaaatctgttttgcacagcctagttaaaacttgtatttacttgtacctgttttgatgtaattcatcttatgagttagggccagagaactgcatggaactattttaatcttaaaacccgggcatttgtagatactctacacattttgtggctgtaggcaaaaagaattttctgttgtgtgttaggtatttttgaagatgcctaacttattctgggcaatatacagtgtatctttcatgacagtaagactaaaatattaggaagataattagcagtgaagtgaagcataggataattatgtatagaagcaagctttgttttctcagaagtttataagataaaacatttagaaacagctaactacccaacccaataaaccaaatcatttttatcttttagtttcttatgcttagggaaaacaaataagggactgtggaaggcaaaagcttcatctctgtattctaatttgacaatgcatttgatacctgtggcctttcagcatagatattgtataccccttgtttttattgggtagttaatatagtgtcctgagttttgttctgttccaacagtttactcattgttttctgattaatctttaaaatactacctctattcttttgatgacttccaaacctctcctggctatacccaatactacagaatatagaatgctgtagtccaatgagggcagtcttgtcaaacactctggttattcacaaccctgtttatttggtcttcatcttcccaacctctgtttaacttacagttctgtgtctccttaatagccctgctttagtttcattttctctgcaaagccctcttttttcttactattctaggccttgtgaattgttgatttagtgcaaatgtaactgaattcctatactgtgctaggcactgatgatacttcatctgcatatgtccagtattaagcaaagttttctctaaaaaaaaatttctaaaaaaaagtcatcttatatttgagtccttaaaaagtttttcatattttgagctctctctcaattattttattttgaatagaagtatagtatttggagaatatagaagagcttgaaatgatgtcagtcagtacttgttttaaaagtctgtagaggtttcctgagggaatagataaaagggtatagtaaaaagtttaaacaaattagaaattatttgtgggcagggagttatactcttataagttgttgtgaaaaaagcctttacaatcacttttaaaagagatatgtaagcagttacattgtgaagatcatagtatgtacctgtagcacaattaaaaaaccaaccatcttagaatcatgtgaatggatatttgtggcttggaaaaacattttcaatgatggtattatgacttctaaaagtattgtttctcagaacaacttaaatggaagtaaagattattcccttcatgatacttacaggtcactcaaaaagaaagtaacgagatgatacttggtgaagatgtaggtaaagtttgaataaagttattttgtaaaatttatgtgctttgtgattttaaaacattcataagactaaattaataaaagtatatattggactgtatgatgtacatggaaaggtttgtatatttcaaattggtaaaaatttaaaaaaagaactttttattggggaaaattgggaaatcctttgtgttgagatttgcctggtactcatttatttatggtagcttgcaagtttctgggcagtaggatgattattaagcatagtcagagactgttaaataatacctactgaactaataaaattttgtatacatttactgattgatgccatgaaagattgtactataccagaattttccaagtacctaaaatcattcttttgtatagtattcttgatacttaaaaaaaactatactgtaagatgttttggattaaaaccatcattcaatttaatccatcttctatagctgattctttggacttgtggtttgtccccagagtggcaggagcaatgacacgtgaaagggaaacaagaattgctttttaagttggatttattacatttgaaacttcattaactcttcccagaggactaagttgcctgtggtaggcacaagtttaggaaagagattgtttcatacctctttatactgtttctcaatgactttttgatgatttcagacagcattagaatgtttttccagaaattcctcaaatttgtaagttcccgaaacagttcttatttttctgcttaacattggttgcatacataggagaattgtgataggtaagctagtcacaggactatgaaagatattgtcatcttaatcagaaaaaagtgtagtgaaattgataattgtaaaagatttacatttcatccacctgtttcaaagagtagagggaaatcagtagtagttgagtttttattcagttataatttgtttttgcattttatcattcattaagtactgtttgtgttaagaactcaagtaagatggatagtcttagaccctagtggcatcttttttttttttttttgggacgtttgttttacattgatttaattcaaagctgcagaccccaaaaactccttaatgccaatgataaaattgttaggtatttcatcatattgagaatgacacattctaagcaactataactgtactgtacaagaagacaaggctgagtgcttggctcacacctgtaatcccagcactttgggagtcagaggcaggaggatctcttgaggccaggagttcaagaccggtctgggcaaaatagcaagaccttatctatacaaaaaataaaaataactagcagtatgtggtggcacatacctgttgtcctagttacttaggaggctgaggcaggaggatcgcttgagcccaggagctcaagtctacagtaagctatgattgcaccactgcattccagcctaggctatagagcgagatcttgtctcaaaaaaaaaaaaaagtttaaagaagggaaactagtgaaaatgtgattaaagaatgtaatagatggaacagtttgggaaaaaaagaactctttaattttatattaagctacatccagatattttttgattgactacatctatttgtcaatttaccaaatattaattgaatgccttctgagtttcaagaattgtgctagatattagggattcagtcatgaaaatattacactatttgcttgcaagaagctgacagtctggtgaaggacattccattctatcaccaccttctatcttctttctaaataaagacgtgtcagtttaggccattctaactcatatatcttctctggtccttaaatcaggtatctatcattatttttataaaaattaattttttaattgacaaataattgcatatatttattatcaacatggtttgaaatatgtatatgttgtgggatggctaaatcaaacaaattaacatatctattacctcacatatgcagtacttattttttatggtgagaacacttaaaatctaaccccaatggaattctgacatgtagaagaacgtatatagacaactgatttaaaaatcagtgagtaaatataaaacaattacattggattgcaagaagtgtgcactttgggagaaggaggagtcctgattaaaagatttttaagattttattatgcataccttgagaaaacttggaaattgtcaccatatgagaggtttttctgggaggctttctacaagagctgggctttctggaactactgggataatagagtgaggacattcaaaatgtatttgcctgaaccatgtctgattgctccagctccatttgttggaaaagctattccttttccattgaattgcctttgcttatttgtcaaaaacgaattagacgtgtttgtatgtagatctctttctgggtcctatatctttttcactgatgtatgtttctgtccctctgtcagtaccttgctgtctttattattgcagttacattttaagccttaacgtcaggaaagcgggtggtgatttctcccactttattattatttttcaaaaaagtttagaatatacttgtttacagtgaaacttgctgagattttgatatgaattgcattacacctatccatcaatttagggagaattgacatctttatgttcaatcttccaatccatgaacagtttgtctttccaaatgtttaggttttatttgatttctttcatcagcattttaaaattttaatcatagggatcctatacatgttttgttaaattatacctaagtgttttatttttcttcagagcaaccgtaactggtgttgcatttttaattttagtttcacttgttcattgtcaccaaatagaaatgcaattgatttttgtgtttcgttcatctatcctgtgaccttacttaattcgcttattagttcgggggctgctgctgctgcttcttttttttttttttttaaagattccttcggaattcctccgtataccagcatgtcatctgcaaatagagggagttttatttcttcctttctagacagtatgcccttaagttcttttccttgccttattgcagtagttacaactttcagtactgtgtttcagtactgtgttagagtgttgagagtgaaattgttgacttgtttctgagctcagcaaaaacatttgttgtttcactgttaagtatgacatcaactgtaggttttttggtaggtgctttttatgacattgagtaagttcccttctattcctagtgtactgatagttttttttttattgtgaatagtattcaattttatctaatgctttttctgcaaccaccgatatgaccatatgatttttcacttttagtctgttgatttgttagattgtgtgattgatttttgaatcttgagacagccatgtatgtctggagcagatcccactttgctgtgatgtaatacttttaaaaaatatattgttggattctctttgctaaaattttgttgaggacttttgcacctaagttaatgagagataccggtctgtgtttttctttttgggctttgtttttgatatcgagatgatactggtctcataaaatgagttgggaagtctcttttgtttctggaagaggttgtataaaattggtgttgatatattaatcatgtttttaaaaaacaaaacttgaattgtcctcagatacagttgcttgaggtgaaaattttctcatagaagtagacttttggccgggcgcagtggctcacgcctgtaatcccagcactttgggaggctgaggcgggcagatcacaaggtcaggagattgagaccatcctgtctaacacggtgaaaccctgtttccactaaaaatacaaaaaaaaattagccaagcttggtggctgccgcctgtagtcccagctacttgggaggctgaggcaggagaatggcatggacccaggaggcggaggttgcagtgagccgagatcgcaccattgcactccagcctgggcgacagagtgagactccgtctcaaaaaaaaagaagtagacttttgcagagttatggtaaaacattttaccaaatttcagattctgtgtattgctattttttttttaatggtaggaagaatgaagcagtcagtactagtcagtaaaccataagcagtactttgaatatagaactattatataaattaactcatactagattatgtgattagacttactgatttactgtaaactgagtgtgaattatggttctggaaaagaatttggaaattgaatcaatctgcttgattttacagatgcggaaacaaggtagtgaggggtttggtaccttgtccaaggtcacagtttgtgaaacagattccagattcaggccaactctattaagccagtgggttttacatagggaggaacattagattaccagtgggtctttgcagaaaaacaaaaacaacaacaaaccccacacatgtgcatatactatattctgtatacattagaagtagcagcccttcttctatagaatacaggtgagacagattaccagaggagtttgcagtatgtcagttcatgctattttttcttccgtagttgagaggaagtccatggcaccattagtatagtgtgtgtgtgtgtgtgtgtgtgtgtgtgtgtatacacacatacatgtactctttatatatagtagcatgtatatatatagtgtatgtatgtgtatatttatatatattctcaaaataaacttttcagctccccattcccaggacctacatagtggcactcagacatatgaatgtgagaaaatatagaggggattctgatgcacatcattggttaagaactgctgtactaaaccctgcacgcaaaccttttatacttatttatttcttttgaaaatgtcagtagtaactatttagagttactttgatagaataaacctatgggtagagatttaaagtttcagaaaattttaaattgggagatgtcgttaaaacttaatatacataaataaccatgccatcctttttagaactacacctttaaagttgtaatgtaagcttaagaatataaaaatacatataatttacttatttttataatcatgatgttactatattgagtttttttagagacttgatgggatagagactgattgcagaatcagcttgaggaggggtgggaaaattgtcacagcattccctgtaagccattttctttctacttatgaaaaataccactctagtttagatctagaaaaccatccttaatcctatctaccttaaaaaatggtggaaatatctttttaataaataaaatggccctttgtttatcttttttctagactaggatggcaaatacaagacactaatgctgctccccttcccttccaatactatgaaatcctctctaaaaatatcctcaaaatctttcttggtatagtgccctaggcagccattactaacgctgattggaattgactccgaaggtaaaacctatttggcacttttgctctaggcagtgttcaatttttttgtcagttttgtttagtttttggggtgttcctatgcctgagtgggattcttcttttggaaattggaaatagttgcatagtggtttttaacatgaattaaataggtgataattcacagagccccctttcccaacaaaataaacaaaaggtaggttagacggactattgggattaggatgttgttttaagctaggaggtggcagaccgcacaacctatgggccaaatccatcttggagctaagaatgatttttatatttttagatggtagcaaaaaaaaaaaaatccaaaaaaagaatagtattttgtgagttgtaaaaactaccaaaaaaatccaaaaaaagaataatattttgtgagttgtaaaaactacatgaaatccaattttcagtgtccataaataaagttttaatgcaacataatcatgttcattcatgtattgtctatggatgcttttatgctacaagggcagagttaagtagttgtgacagaccacatggcctgtaaagcctgaaatatttactgtctgaatctttacataaaaaaattgccattcctgttttaagataacaatgggggcattgaatattgcttttgtattatttggtaaaggaggaaacttaccttgctcatattttcaacatgtttctgaaaataatttagaaagtgcctattgtttgcatacagataagtggtggtagcagcccttcttttttttgttttttttgttttgttttgtttttttgagacagagtctctttctgttgcccaggctggcgtgcagtggtacgatctcggctcactgcaacctccacctcctgggttcaagggattctcctgccttagcctcctgagtagctgggattacaggtgcgcgccactatgcccagctaatttttgtatttttaacagagaaggggtttcaccatgttggccaggctggtctcaaactcctgacctcatgatccgcctgcctcggcttcccaaagtgctggcattacagatgtgagccaccgtgctgggcccattcttttatacacggttgagatggagttaccagaacatagtttgcactgtcagttcatgctataatttcttccacagttgagaggaagtccatggcaccattactgcccacaaatactggcaacttataactacatctctgtgctagtatattgtagaaccactgttctcaaactttttagtctcaggacttctttagagctcttaaaaattaaagaccccaaaacttttttaaaatagtaatatatatcaatatttaccatatcaaaaattaaagaaaatgtttaaatattaacttatttaaaatagcaataataatccattatgtgttagtaaagaacaagtttttatgaaaaatattttccaaaacaaaaaattagtaaaattacagtctcttaatgattgttgtagtagaagaaaactggattattgtatctgtttctccgttcagtttttgtgatatgttattttgattgaagcatatgaaggaaatctggtcatacacagatacatagttagaaaaaaaggaatagtattttaataatttttttttttggtgtgactgtttttctttgatatcataccataactcaagatatggtagtttcttttctattgttttttttgaagtcaattttatttacatagaataaaatgtgcttttttagatatgcaattccataagttttgattagaatatatgaaccatacatattatacaatcataatacaccctagtcaaggcgtggtgttcctatttccttcatcccacaaagtttcctcatgcccttttgtaatcacctccttttccctcactcccagcttctggcaatctctgagctgatttctgtctgccttttccagaatattatgtaaatggaatcatacgggacagccttttgagtctgtctgctttcacttagcataatgtttgagattcatccattttgttgtaggtatcactagttcattccttttttattgtatggatatttgcttctccattcaccattgatggacataggagtgtttttagttttcagagattatcaataaagccactctgaacagtcatctacagatttttacatggacttatgtttttatctcacgtagatacctacacatgtgattgctgggtagtatggctggtgtatgttttaactttaagaagctgtaaagctgttttccaaagtgactgggccattttgctctaccaccatcaatatgtgaaagttctagttgctcacattttcagcaatacttgatattgtccgtttgtgtttttgttttgttttagccattctaattagtgttagtatttcattgtagttttagtttgcatttccctgatgattgataatattgggtagcttttttcaaaaaaaatttttattctttgctctttggcaaaggacctatttgaatcttttgcccatttaaataattggacagtgttttttcctatgattgacttgtaagaggccgttatattttctgagcatcagtccttttttagaaatgtgttttgcaagtattttcttccagtctgtgacttttttcatccccttagccttcaaagagtagaagttttcattttagtgaggttcagtttatcggttctgtcttttttgtaggtcatatgtgttgttctaagaaatctttcgtaattcagggtcacaaagatttttcatgttttcttttggaagtttaatagtttcaggtattattttaggtctatgatatgtttagaattaatttttgtatatggcgtgatatatgggttgaagttgtttgttttttctttttgtgtatggatattcaattgctccagcatctgtggttgctacgactatcgtttttctattgaattgccttgacatcttttctctacatcagttgaccatttatatgtgggtctatttctgggttctctgttctgtcccattgatacatgtttctgtcttttcactataaccatactgtttttattgctgaagttttatagtaagtcttaaaatcagttagtatgaattctcctttgtacttctttttcagaattattttgggtattccagtttccttgtttttcaaatagacaagacataattttgtaaatgctagttgcagtggggaagctgaaaccattgatgaactttttgtcttttgtaacattaaagtctgctttgtcatgcacattgagtggatttttttttaacccatgaatacttttgtaatatcacaattcatttggaaaatattggttctctgaattatgtagactttctaaatactgtcacatttcattattcaatatttaaaagtcacatttattgatatcaccactgatctcatcagaaaattcttttgactattggaaaggttgacaccatcacctattgctgatggtagtagataaaaattttcaaaatttttattttttgcttgaaaacttaaattttatcattggaaacgcatacttgttagttgcctttcttgaagtcacaggttcacttggtttacttttgagaacatgcctgtcagatacccaagtctaaatagccataggttgttagtttacaactcagtcatacgtgggctttttcttgaggcaaccattgtacagttgatccttgaataacaagggtcttaattgtgtcagtctacacatatgtggatttttttcaataagtatgttggaaaaggctttggagatttgggacaatttgaaaaaactcacaaatgaactttttagcctagaaatattgaaaaaattaagaaaagatatatgtcatgaatgcataaaatatatgtacaaaccagtcttttattatttgctaccataaaatatacgcacatctattataaaaagttaaaatttatcaaaacttacatacacacttacagaccatacatggcacagtttgcagttgagagaaatgtaaacaaatgtaaagatacagtattaaattataattgcataaaattaactatagtacatagtgcactactgtaataatttcatagccacctcctgttgctattgcggtgagctcaagtgttgcaaatatctacttacaacaccatatgatgctaatcatctcagcttgagcagtttgtctctccagtaaattgtatatcacagtaaaaagtgatctcttgtggttctagcatatttttcattgtgtttagtgcaatgccgtgaaccttgaataacaccttgggacccatacaaagtgccactcttggtactggaattgctcctgagaagagaaaagtcttgacattacaagaaaaagtggaattgtttgatacataccatagattgaggtctgccgttgtggttgccatttatgatttattttgtgaacagaaggtgtaaacttacagtatcgataaatacagttcagtactgtaaatgtattttctgttccttatttttaaaataatattgtcttttctttagcttactttagtgtaagaatttagtatataatatgtataacatagaaaatatgtgttaatcgactgttgatgctattggtaaagcttctggttaacagtagtctattgggaaagtttttggggagtcaaaagttacacactgatttttgtttgtgcaaagccagtgatccttacccctgagttgttaggggtcaactgtagtcactatgcagcagagttatgtttgcttagtttttgtcccacacaatattaaaaagtagtctactcaagggccaaggtttcataaaattaacaatttctgtggcttttcatcaaggacattctcaagtgaagtgaaactagtggtgttcagagaaatactgtgatatatatggttatttcctattataatggctatttttatatttaaagtacagggattaacctggaaacctaaacccaaagttataagtgggaagacggtgaattactgacactttaggaatacctaaagttgctatcttgggaaacagtcttttattttaacagataatgtggttatattattgtttttattatcttataggtgctatacttggtagatcagaaactcaggagtgtcttttctttaatgctaattgggaaaaagacagaaccaatcaaactggtgttgaaccgtgttatggtgacaaagataaacggcggcattgttttgctacctggaagaatatttctggttccattgaaatagtgaaacaaggttgttggctggatgatatcaactgctatgacaggtaagaacacatttaagattttatggtagtattgagtaattttcacacttcccctctttttgaaaggggaaagatcagtgcataaattttcacttaaatgtttcttgctttttaaaaaatgggattataaagaacattataacatgctgtaatgacagtatattttaaagtaataaacatggcatatatatgttttatctttgatatattttgaataatctacccagtagtgagaactctgaaataaaaaccattttccccaatattgttacgattataaacttttaaaatgccagttttaaggaaaacatttaaaaaattactttaaaagagtatatctgttgaaaatctgtcctcaagaagaataaaacttaatcatgtgtttaattttctttcagtttccttctttatgtatctggaagaaattgatcttactacattcccccctccccccgccccttttttttttcttgcaaagtaggcctttcgctctttacccgaagagactttttatttttgagacagatttcgctcttgttgcccaggctggagtgcaatgatgcaatcttggctcaccgcgacctccgcctcccgggttcaagcaattcttctgcctcagcctcccaagtagctgggattacaggcatgcaccaccatgcctggctagttttgtatttttagtagatacagggtttctccatgttggtcaagctggtctcgatctcccgacctcaggttatccgcctacctcagcctcccaaagtgctaggattacagatgtgagccaccatgcctggtctaccccaagagacattttaacttgacattcagaatttcatcagaactaacagtcctcaaactacatacttgttttaattgctttactctgtactggaagtaaaatacagtggtcatgttattgactgcctgtgatctttctgtatggagtcccatagctgttagggtgatcccttaactgcctgggccacaggatttctactgtgggtaggtgctgaagacaggcagaagctgtgaagtcctagataaacagacattttggagccaaaaagtactgctgtatacagtgaacactagatacttctggatcacttttgagagcctcagttgattacctggaatctgtgtttgattagctgtatgtgactaagagcaaaatgcattgaataggcccttgaaaattggattaactacactttttgtgagaaattacaacacagtcatttagatttagatatatatttcgtatttagaatgtacttctaagtatgtgaattttccagggattatttctatgtacttatatattttagctgcatttctgattatcagcctctgctaacagaagtggtcaagtgatatgtgctgttacgaaaggtacacaggaagaaattggggaaaaatgagtttgggaatcatctttatcccaaactatcttttatcatttagttggaatcagggattcctattcttttttgtagtagaaaactactttgctctttacctaaagacaatactccagctatgtgagactcggatagtgccaaaaagagtagtgagccattttcactggagtctgcaagtgtgttattcattgcaaatacttgctcttagaatggtaattactataccatctttgtgtctggaggttaaatgctaattttaaactataaaattttgtttttatactctaaatttgattgaaaacaaataggatagtaagagaagtaagaggaaaagaagattcaagaattgtcaaagtgtggaagaaaagaaaatgataaaagaagaatgaaattgaatggtgaaaagtaactttattgaattaattaggctaagtaatcatgttaatctgttgtaatttgagacatgattttaaatatgtttttaaatttatatatttctctttataaattgttaaaatttagctttcatttatctttaaaaacctcctgccaaatagatgttgatgttgagtatattttagtttgattttgttaaaactcctatctccctgaaatttcttcagcttttcacttaagaattaaattctaccttattattctgacaactatcaaaaaagttcagtttgttattaagatacatcttttaagttcatctgatgttgattttttttaatagttttagctgtttattagtggctgattaggatttgttctagaggctaaatccaggtcttttcatgacttaaggtcctatataaaaggctactttatttttatttttttggtttaattctaatccgtttgagttagtaggtgctatgtgattattgtttacgtgtttgttttctacttattgctgctcatctcaaccctgttcattgcattcagggaatttaaatctacactctaaaaaacagtgacagtattaatttctcagcctagtttgggtttctgatgttgaaatgtttcacccatgagatacgagcttttatcacttagcatgtgtgtatgtatttatatgtatacatacacacacatacacagttttatatatagttttcagtttttgtattcacagaatggaaatgccatatttcctgtgagcaaaagcactctttgaccaaattgcctcattgactttatgtcctcttcaagcttttctaataattaaaaaaataaaaaaagatgcttgccttaggttgctcattaaaaaccaaattacagcaatagtctctagtagtcagtgtgattgttataaaatcagttgttaatttttttttcttaagagatttagtaacaggaatccaggaacatttttggtttttaagaattattagatataaatacgaatcttgaagttgaatataaatgactaatttattattttattgcagaataaaaacacttgttgtagggtcagtataataatattgattttaattattttttctctgcttatttataggactgattgtgtagaaaaaaaagacagccctgaagtatatttttgttgctgtgagggcaatatgtgtaatgaaaagttttcttattttccggagatggaagtcacacagcgtaagttcacagggaaaatacgtaggtttgctcaactgtagattggaaacaaaatatatttgtgttgatggaataatttgcccctacctcttccccaaaatttgagactatgacagatatttattatagaattttgtagaccaaatctgagttatttttcccccccttttccacagccacttcaaatccagttacacctaagccaccctattacaacatcctgctctattccttggtgccacttatgttaattgcggggattgtcatttgtgcattttgggtgtacaggcatcacaagatggcctaccctcctgtacttgttccaactcaagtaagttattgtcctgtactttgtagtgttttaaattgtatatttttgagaaatattactgtggtgaaacccactaacttattacagattattttcctttggagttaatttttgaatgtttattgtcatgagaactctagctaactttgcaaacttattaatgtacctaccgtgtccttaacttttctcactttagggttgaggtcgagtagaatgaagggatattcccatttctattcctctttggagagttttactctcatgctaacactaacctgctttgcttcttgagaagtcatttatgatggagaagtgaaatcataaccctgtctttgccctctgtcccctcctccatttctagatttctgtgcctttttcaagaccacttggcaaaacattttatccatggggatagacttaggaaagtaaccaaaaaagtatagaaaagagaggtttcataaagccttcaggaagatacctccataaagatgtttttgtagggaagaggagcagaaaagtaacctttcttaccatatgttgttggtagatcaagtattttttttggttgcctcatatcaagtgtgtactgaagactaaacacttcttttaaggctcttgattgtcacacatcacaccccaaatatttctggaaatataggtgtggagagtaatcagattaaattcattaaattttctacattctcttatcatgtagacactttgtgcaggtctggtatttataaggacttttcatggaagtagttagtattctacaggtctacgaaaactgataacttttggttttacttgcttgagacatctctgaattgtagtttttactgtgtttcttttaactcttaagatcacattacctcagccttctgaatctcttggtgtaactttgcttctttaataccagaaggattaatggttaaaacttgatagaaaaaaatggcaaagtcctataatttaatgaccaaaacaactccttccctctaagctttatttatataacacatttatttctcagcgcttgcagcaatctgttagcattagatcatggattcccataatccttgtaagatgtgtatatagagaaataaacccaaaggtaaaataccatgttcggtaattaggtaaacattattttgtacaccttgagtattttaacttttaaacagtagtagctaagtttgtgttcattaagaatcatttctaaaaagtgttttaaaataaaaagttttagtacctagtctatgtagtttactccaaatggccataggatacactttaccttctgtcagtgataacttttaaaaaatttgttttagtatcaaaatttagaagagagagtattcagtattataatagtttcctcagtttaccagatctgtgatatgctaggaacaagctgggaaccacatttataaataaatttgttaaggtttttataggaggagttttaaaatgtaatcttatagataacactgatctgtatacagtattgttacaaaaatgtgcttaaagcttttcttaaagggctttatatcctatgtatgtggtcagttttttaagaaagactaaataatttaagggtttggacttttaaaaaggattgatgttatgcataaataagaaccagggattttctgtgagtatccgtacatctctgtgggttttagatatttgttatggttaaagttactgtacacatttatttagtacttacatgctctgtcatgagtttatatgaatttgtatgaatttctgaaaaataaggaagaaatgtaaagattttgtgataaagtcacctggtgtggtcaagctttggtatgaaaaatacaagacaggcctgactttatgctttccttctgtcataaactatgttgtggaaaaggggcattgtcatcagtgtggaacttcacttttgtcatcttttgcagtctctgaagcagtatggtttcgtgcttcaaatcttgtttttgctgagaggtttatgcaaactgttctgcaagaccacttcgtggccatcatgtaacaaaaggcttagttttatcttctatttcaaaataatgataattacatcaagcatttattgagcattttacagtgtactagggcactgttaagttatattatacataaagatataaattatatgggaacatataaaaagcataaaatattttttttcaatgatttccaagttgtgagactgattatcatctttggaatttgttaaaaaatacaaattttgggaccacactcctgaaagtatggaatggggcatgggatgttatgtttttaataagcttcccaggcgattctggtgaccagccaggtatggaaaatactaatttactttcatctcacagagttgtttatgtagtaaaatctccattttatagatagaaaaatctgacccaaggactctttgacactaaagctttgttcttattacttacgctgttctgcctcttttttcataaagcacatgccttttgtttcatataattcagtaaacttttctgccatctcaaaatcatcctgtaggctaatttattttccttttggatattgaataatttgtatgactactaaaatgaggaataacatcatcttatgtaaacattgtctcacataggacaaaaagagaagtaaagaagtcatagatacatagaagggcatattcatgtgttttccattaaaaatttccaaaaattctaaagtacattttggaatagggttgatgaccctttttagaatagggtttataaacatgtgattgggctgtagataaaaatatctgtgcttgagttgatactgccaattcctattaagactttttcgaagggtaggagaagtaggagagagatatttgaagtcttaaagtgacttctgtatttcaccccatattcacgtccccatatttcaactttacatcagttaggaaaagatcttacagtcttgctgcggatttttggaacattcttcctctggattctttaagtgcttttagacagtgccataacatttgtcattctttttcttagggagactttttctcaaagctttggctaaaggatggtttgtgaatgaactggtctgttgtaagacattgttctcattattagtaagctggttctggcagttaggtgagggattctttatgacatcaaattgtttagaatttttcctggttgtgttagtattttgttctgaagaagtgatgtaggggtataagtactttaaaatctggtctttcattatggttcctagtaaccaatacaaatacaaattctagaataaatttagcacagtcgaaggcatagaaaaaagcagttttctggtcgttttttttttttcataagtcctatatttctgtcattgtttcatggtatcactttattcttattcatcctggatgaaagccttggagacaactattcttggctctgtcatttaccaagtcctgttcattcaccttttcatcctgattgatcctattgtagttcaggacattattactcctaaggctaagattatttctataatctcaaagttggccttcttgcttccatttctctcccttcatctgtactattgccagaatagcattttacatgtttgattatgttacttatgtgcttaaaatatgtgtgggctctcagtgagccacagcaaagaatacaaagttggagcatgacatgtggtcttccatactctctttgtcttttggtactttcttcccattacaccccaaaacatctgtcatatgcatctaacattgtattagttgtaatcctccttgaaagatttgagaaaatagtgcttgggtcattctttcatttgtcattcatataaataaccccagttgagaagggctcataatgtgttttattctcccactagattgtaagcctcttgaagatgagatatgtattgtaattactgctgtgtcttacacagtatttgtatggaataatcattcagtaagtgctgaattgctaaattgagtttgttgcatttggaattatactgagatgataatgaagtatgtccagggattcctttaataaacattcaggtgctttagggctttgcgttgagagaaatcttgaggccatgattttgtggggggctgtaaaataagttgaagtatttcaggcatttataagagaatgacattattcagttctttctgtaatcacagactgaagcatcctatctgttttcgttacccagctcacttttcttttgcctgtgctgaaactatcttcccacatataggaagatgcttttataatatgcattgagtaaaccgaatgcaaactggtttttctagtgacagtgagtcatgaatatgagggaattgatggactctattattaagaagtcttattgtggttagagttaatgcagtttcagtaaaatggcgccgctttcataaccatatgtgagcttgtttcctgcttataagatctatatttgtgctgataaaataccacttgataagaaattgaattttaagggttagaaatgacctacctttaacaaggcacgaagttagcttcttgtttacttttaaaggctatataagtagcacttcagtattgaaaattaattctttcttaaataacatcagcctgttcaatctttatgatagtttgtctaggtgtgggtctgataaggactaaagctttgggatacctaaattaggcatacaaaataatcgttttgaccttagcattaaagtgataataggttgtcatttcatgctatgtcagagtgctattcactgagaaaccaagccatctgtgaaaatgctttgtaggattttcttcttgaacatgagtttatgtatttaaaattaataagaatctgaaagggtaggaaaacagttttcagccaagttaatttagaagagtatactgcttccttactgggggagggtgcaggagaaatttactaaatttattgagtatttaatatgctaataacaagttatacttacaaaatattacattcatagaaacatgtcttgaaataggttgactactgattggagtttatgaacacatctctttctcttctgctttttctctcttcatttaaaattctcttctaattaaaaagttaattataaatacatgcttgtggtatcaagacaaactgtacagaaagacgtatgaaaaaatagaatcattttctcctcttttccctttctctgtcactttcctgaaataatcaattttaacagattggtgtgtatcccttggcacctttctttagccttatttttttgagtatatatgttttcttttttataaactataaactattccacaactggcttattttaatttaacagtatatggacagcttttcagattgatatttttaatcttttgttttattatgtgtttttaagtgaaatgtaatagagttttattgtatgcttatgaaatagcaaaatttgattttttggtaaaaattttgtatatttaaggtgtacaatgtgattttttttttaagcttagagtttgtattaggtttctgcaaagacagaactcacatctcacaaatatttgcaactgtattgttttagtatgtttgaaatatgacataatgctgttgtcttaggcgtgagcattcttttgtgtgtgtgtgtgggtgtgtgtatgtgtatgtctaagaaatagtatagggctactatagatgttgttctgtgtcctaccttggtgtgtgattatttttgtattggtaacctaaattacaacttactttaaatatatacttctaattgtggggagaagtgtcataagttatctcgacatgcaggttgacaaaaaaaattactctcatcaggcatatataatttattccacttacaaatgctcagacaaggccagttggagattgtctaaaattctgtgtccaaaagcaaaaagggaggaaggggagaaagtagaaaatttaaacctttatcaatagcttaaaataaggtaaagttgcacattaaaattaattagtgcaccttatttctaaaagtgacttctgtttaaattttgaaatcttgagttcaggttttctttggcttgtacagggtctcgtctgtcagttgattggtgcatatggaccagactatataatttatcctccttctctggcaaggagatgtgtatttaggaggaagtgagtttgtttttttcctgtgttcttcatttcctggacctcatcctagaccttgttctttcattcctagttacttcattgctgtcaaatcttttttttttaaattaagataatagaaatgaaaaacgtcccattgttagctaaagctgcttgtagcacatgagctaggaattgttcagggttttcatttttgcttaaccgctcactcaatgcttgattgcctatggtgtgccaggcaccatgctgtgtgtatggtaaaagtggcacgaggacagtacttgcttcaccttctggggcctacagttaatatgtaggtgaagtaacacaggatgattgtttgactgtagcctggaaatgaagggtaaagagtgtaagaagtgagttgcttcaacaattttaggcaaagactggaggaagggaggaaaaatgtctatttccagatctgtactgattgggagaggagccacatgtgggtgcctagctaatgctaagtgctcagtaagtattcactgttattggtgttagagtaacagcttcaaaattgaactcaaacagaatcatttttactgaaattattgttgatatatgttaatactttgaaattaacttggtgtaataaaagattcattttgagtattatatcaggcactatacagatcactttacacatattaactcatttaatttgttagtaccatggggttctgtcctgtttatcaagtccatttttttttttttttttttttaactttaaattctgggatacatgtgcagaacatgcaggtttgttacataggtatatctgtgccatggtggtatgctgcacctatcaacccgtcagctaggttttaagccccacatgcattaactatttgtcctgatgctccccttcccttgttcccctgccccttgacaggccccagtgtacgttgttcacctccctgtgtccatgtgttctcattgttctactcccacttatgagtgagaacatgtggtgtttgggtttctgttcctgggttagtttgctgaggattatggcttccagcttcatccatgtccctgcaaaggacatgatctcattcctttttatggctgcatagtattccatggtatacatgtaccacattttctttatccagtctatcattgatgggcatttgggttggttccatgtctttgctgttgtgaatagtgctgcagtaaatatacgtgtgcatgtgtctttataatagaatgatttatattcctttgggtatatacccagtaatgggattgctgggtcaaatggtatttctggttctagatccttgaggaatcaccacactgtcttctactatggttgaactaatttacattcccaccaacaatgtgaaagtgttcccatttctccacagcctcgccagcacctgttgtttcttgactttttaataatcagccattctgactgttgtgagatgctatctcattgtagttttgaagtccgttttatagataagaaaattgaggcattcatagatgaagtgacttggcttagagtcaccctagtgggtggcaaagcctgggcatttatatccaaggattattgcccattgattgaatggcttatttcagtaaataattaagtggagtccataaaaaaaccaaagcaggggctgggtgtggtggctcagacctgtaatcccagcactttaggaggccgaggtgggtggatcacctgaggtcaggagtttgagaccagcctggccaacatgggaaaacaacatggggaaaccccatctctactaaaaatacaaaaattagccaggcatggtggtgcacacctgtaatcccagctacttcggaggctgaggtgggagaattgcttgaacctgggaggcggagcttgcagtgagccgagaccatgctactgcactctagcctgggtgacagagcaagactctgtttcaaaaaaaaaaaaaaaagaaaaaaaagaaaaaaaaagcaaagtaggataaagagatcaaagtatataaactacatttaaaatagttttcatagtgactatatgtggccttgtagataaccattttaccatctcacaatttattcatgtgtaacatggtttattttctggttttttcagctacacttgcagaatacagatatgaaaataaatcaaaataaacttctgtagccagtcataaaacctgattcttttaagcatcaaccccaaaaagagaatgggcatacctacgtttttttcagacttttaactccagtgctggctaccttgaggtgctctacttcttagggaacatatccagaatcttcatttcacctgccttggcctttctttgctttcctttcaagaggagtaagatgagagaaactgtaggaagtaggaattatcacagaggaattttgacgatctaattggctggaatcattgctgtgcaattgacatgtcaatactgttgaatctcttaatgtatgtcttgctttccttagttcagaaacattgtcctcgcatatactgtattatttataaattctgtttctattctgcttggcaggatagtctttttaaaatttaaaatggtaaaatttcttagaatgtaaaataattagttgatattaagaggaaacaaattcagaatttgtcagttttcatatagtttggataggaggaccttaattcgtcttggtagtcctaaaaagttgttgagtgaggtatctccactcccagaaaaaaatcagtctctctctctctagatacagagatacagatatttcttggaatggtttgaatagtaaataaaagaaatcttataacacatatcatatatacatatttatagtatataaacaaaaatctctattttctggaaagattttttgtattccagatctgtgtatgtgtttactaaatatctccatttatatgtctccaagcacttaccattcacaggtagtgattgtctctcacaaacctggttctcagtaaatggaaccactgtccatttggttgcataagccaggaaactaggatgtctcaactctgtttttcaccttaactgcttccccctagtacttactccatttctcaagggtgttctccatagggaaatcttctcagactttacctgtcattataagtcaggtttctctttacagatgttgaaggtactgaattcctttttattagtgtgaattgttgattagtccttctgtcctgcactgctgcaagcttcatgagagcctggctagtcagtgcctggcacagactagttactcagtaaaatttgttggatgaatgaatgaatgaatgaatgaactattcttcattcttttctgatatttggcagtagttttttttccacctcagggagaagcaacaaatctttttctcacctacaaacctaatagcttgatattaatgtgcagattcgattttcaccgttacctacagttatagtatataatagtcaagctacattttctatgttgtgaatccagagttttgtttgctttttgcttagttgtatattttagtgcattttattttgctttatttttatttttggagatgaggtatcactctgtcacccaggcgggaatgcagtggcatgatcacagcccactgcagcctcaatctcccaggctcaagatgtcttccctcctcagacatccgagtagctgggaccacaggcatatgcaaccacgcccagctaatttttaaaaaatttttttgtagagaagggatctccctgtgttgcctaggctggtctcgaactcctgagctcaaagatcctcctgccttggcctcccaaaatgcagagattataggtatgagctatcacacctggcctttaaaaaaattttgctttaccgctcttattttgtcatgtagtttatacattgaggactgttgctggtgtctcttgtttgtttattctaatcctcatttattgagaagtgtattaagcaaacatatgtggttattttgtatttattcatgtacttaagtgaatgtatttttttgttccgtttttacccttcatattttgttgcatagttgatattttgaggcttgttcttggtgtcagtttgggttattttatagcttatcctaatgttcatttcttgggaaatgtattgggcagagacatactttttggtaagatgtatggatagcacctacttgcacagtgctagtatagtgtcatctttatagtgtcatctttatctctgaaaacacctgtatttaaacaagatctgagagatccttgagcctttggaaaccatagtctacttattcagttggcatgtatttctttcaagggattaattttactctggagtactggataagatgttttgatagtaggattatctcagccttttggatgaattataaatactcttgaatcattatcacaggaagaaaatctagaaggaagaaaactagttaagcaactggtacagataaatgagttgtccattctgttttgtcagtgctattgttctctatagaaatattggaaactggggaacatagccatcatccattggaggaattctcagccttccctaccactggtgatcatatttcttttaattttaaatttagacccttacctattttgggatgactggaaaaatgaaaatcctgttctctatcagtgtctgagtgtctttagaatgtgagatgtgtgattacttgttcccagggccacctctgcttaactgcttcaccttgatgtgctgggcaagtaggtttgataatattctgtcactatgttttacttaattctgatgatcttgttttcctgtcttagtttcttgccatggtgtattatggtgcacgtacatagccaccagaaacatttttctgtctcaccattatgattctgtcttccatgaaagggaagtgaggcagttcaggaaataggaaattctagaggttcttaagacaactatcagaaagtctgagaaactgatttctagctatatataaatttgttagggctgctagctcgtttttgctaaaggcaatactgccctctagtgtcgagaaggcaattccaatttgtaaattccttgttttataatttagactctagaggctcttagaaaaataaataatcattatttaagacttgatttagtttgtttgcaggcatgaagtcattggatcagttaacttgggattaaactggagtcaagaatttgtttaccacctatctctcatatctaaggggttctttttgatattactttcctctgtttgtaaggaaagtgttccctatctttatttaaacaatgtaaaactttggatcattgccaacttttaaaatactaaaccattattctctttccttcacttttgtaactgatgtgtcatttttcatttcattctggatatgaatcgtaatttcttttgcctgtgttttttcttcacaagcacgcctttcatataatgatagaggtaagatgcattgatgtttgttttatggttgtggaactttctgtggatgcatactaaacattttgttcttagatttttgttgttgttactgctttactgtgcatcctctataatttatatatttatgtcataaagggttctccctcacccagcttttataattaaaatgtgattgatttgacttaggaatggcttttagttttaagagactgagagtatttatatttatttaaggtaggatgtagaaaaaaccgttttacttgattagaagttaacaccttaacggctccattcgcctcaaaaaccttgtattggttaatttttatatgtcattagcttaaatgtcagcatgtgttcatttttaacaggggtcgattttctaatccagcccattgtatttaaatgtgaaatagatatttttagatagcttcatctttggcatctttagcaaatgaactagctacaggagtataacttttgatgatattttgctatctgaggtttaagcgtttaattagattaaaattcacccttcaaatggagaactcagaataagtaaaatgatcagagatgactttgtagcttcccacctctaataatttattccactgttggttatagtaatgatattgggtagtggtttgggggcaggagattactttttaccaggttatcatttcagtatgtgttctgaagctgatgtcttctgataccataatttttacatataaatgagtaaagaagaaatgtaatcagaactgtgtttgaatgcatatctttttagttttgcaaaatagcatggatgttgtaagagaactggaaatttagggaagtttttaggaattctgaaatccttctaggtgcctctcagctccccattggtttctctatgtagccaggtaaagccatattttgtgtatgacatcagaaattgcttgtcattttgaaatttatgtctacatttgtcttcccaggggctcatatattttaaaggtatacatttttatttttagaatcaagtattgatttttttgtgaataaattactataatgatgccaattaattgaaaatcatttctactattataggatgagtgaaacttacagatgaatttaaagtttcattctagtaattttttatttaaaaaggattagagattttataatctgtcctacagttatcatttttgaacccaatcctttgtgtattaaagaatattatttaaaattccatttttgaaaagctcatgtcattgctaaaggttttgagattctacaggaagaccttgtagacctttttgtcaccctttcgaaattgaccagtattctttctaattgaagcttttaccttttaagtaattttgacaacaatatttgttctggctgttactatacaatattgaataaattatagtaggagggtgatctaagattatttctttctgaaataatgatagcttagaaacttgttaaacagagccttgggaatgtatgggaacttgaagtatatgcatttggaaaacatttaatgaacttttttttttaatgtagatattaaaaattattttttctaaaattaatgttatactaaaatcatagtttgaattgctgacatattaattgtggattaaataatctatatcttacagactgaatcatattcatgttgttgatgtcctttagaacagagaatgggtaatgtgtagattaactatagagacattaccagtgtacataaaagctattaaaaatcttaatattgtaatttagcactgtattccctctacctagttatttttcctcttcagctttcagccattttctgtatactttagtttttagtttttggcatcccctctggtttgaaacctatctctctacctttctaacattttctatttagtttaaatatgtctttatgcagttatacaataactctttgcccttgaggactgaatggtttcctttcctgtagaagagttgttttcaagctttttttctcttgtctccacattcatataagcagtctgctctgatcagtagaatttctcggatagaggtgatcacttgaagaatgagggagggagggtgtagtttttaataaaaactctctagaggttcttgtgtcccctccactgagaatcacacttgagagcccatccttcctataagatttatatctgacctccttgacccgtcactctgctaaacagaaacgttctttcatgttttgaatgtgggaaggacaagcaacttgtagacaaaaaaaaaaaaaaaaaaaaaaaaaaaaagtctgagtttgaaatgagtcacaagaagtcttttgttttatcttactgtttaaacaggaattctaaagccattttataaagatggtttcatttagaagaagaaattgcatgtttttcctacataacaccttgcaatgtttctgttgctgaggttctttctagtacacagtaaacttttaaaactcctgagtggcaccagtgagctgagtgatgcctaaagaaagcactaactgtctttgaggcattagaagaagagagaaaaagaaaggcagagaggatgcattgatctgggatcacataccatttccaagtgtctgaggtgccacccagtgtcatcatatcagttgcttttgccacagaaattttagttcctcctcaaaatactcattatgcagccctccaaacccttctgttgcttttctctggaagctttccaaaaggcttcctgcatcttgctttagttgcagatagggaactgagagaatgctttcaatggagggttgcattctgctttgataggatttccttgtgatttgtagatgctgtattcctatttatatattatgtttgctctatttttaaaaaactatagcagtgcatgtttctttcatttaccatatcctgttatctactatgatgaccacttcttttctggatttttattcgtacttctttgccagtcagtcagttccagaacacaaatgattttttatctcagatcaaagggatgaattgttaatatgtttaaaattagaatgaaccagtttggttaaagaaatatttacttacatatttcctgtatgtgctttgtatttgatatacctatctgcaatgtgtttaagaatgactgccggtatctctgagattaatgaagaaaaaatttaaacagtcactggagaaagtaatagatcttcaggagaggtttttgctgatatatagtcataatttgctgtttctggcacttttcaaatcatcctcctcgaagtacacactggatgaaacaaatgaaatattgttaggagtatttcgtagttcacagaaaatcttagtggggaatattactgagactgatcagaaagattttagatcttctctcctgtggtacatatatagcaataatgctgaacattattatgaaactctgaattcaggttgcctgccttgtgatcactatagataattagtaatctaattatggcaacattgaagttaatgtcattcatatgtgtttactgtttctgtcagttgacttttcagtatactcactttttttctcattttcagagttggtgtgtgtcatgttctgcttatttatagtattattattatttatctgtaggacccaggaccacccccaccttctccattactaggtttgaaaccactgcagttattagaagtgaaagcaaggggaagatttggttgtgtctggaaagcccagttgcttaacgaatatgtggctgtcaaaatatttccaatacaggtatgtttattgcagttttgtcatcttacatacatgttttatggctaggtcatcataactcagaaatagtctcaaaacagaagccatatgtaccaaggtggttctttgtgatactggggaaagcagttagctcttttaatgcctgcctttgcatctgagaaatggaattgttaatataacaatcattatgtttgtctggagtggtggaattaaatgaatgcatagtagatcttttgccagtgaaaattctaatagaaatgttaaataaagataaagattccaataaacaagtctaattgagtggttaaattttaatatccccctacgttgtcagagaaagcaaacaaaaaaacaaaagagcagtatactttgttttagaattggtatttagaggtatatcaccagacttgacttactttcattctactttgagtgtttaattatttcagtttttgtttgatgcattttcagaggcaatcgagacttcaaataattggtttactgttgaattgtttttaaggttggctggacttctcataaaactctgatctaatgtacctctgagctattcttgtgttttgttttgttccgttggtggtatagatttatgatgattctgtcttccccatctcttgcttatataccctggcagctcatgatatccttggtactgacgtcttggctggatttggtgttgcaggctctaccaccatacttagagagtggatgtttctttttccaaagttatcatataagcagtttctttgtcttaatatacctagattttaacctttttacctcctctgttcaatcttacctcctctgttcagtctataaactgtttacatagagtttatgaactgtattacatttttttttggtagctgtaaaccacagtttagttttcagagagaaagtgtattctgttgtgccaagattcataaataagataagggaagaaattatttccatgtgtaaggaagcataaagctcagagaaaggcatttggatgatattaacaagcccgacaacagcaacaacagtagctaacattttattgtatgcttttattgggtcaggtaggggtgttttacatatatgagtactcactaatatgtgtacgtatattacccacatgtacataaaatgcaacatataatacaacaattctataagacagacactacaatgccttttctacttaatgaggacactgaaggattatgtaacttgccagaggttagtgggagagccaggatttaagtttggacagtttggatgcagagagtttctaagggtttctaaccattatgccatagtgcctcttactattattgtcttttagtagtgaaaagaagctaatcttttataagtagatacttagtagacatggattgcttgcaggcacaagtgaatatatggtgtcttaaattattgcattgcatatctttgccccttgctttctcatagaccttgtagggtatgctaaacattttttgaaggatgtttgatattatgttagtttttgaaaagaagaagttttctatttagaggaagtcattctgccggaatttcatctttcaaggagattattctgaatagtaccacaagtaacttcacaccatgatgaaattacagtgtaatacttgcagtaacttacgtgttgccattgtaagacacagaatgcagcatttccgatcaccttctgtgtttgtaaactagaaacacagaaaagtacgttttgagggaatgaaaagggcaggcatttagtataaatttgttaacctattgtcagagctttttcttattacaaaacagaacaaaaaattttttaagacttttttgttttgttttgttttactttggaacttatttgagtaatctcttatgcatcgtttattaaacctgtattccttgtgttcttactattctttctttttgactctaggacaaacagtcatggcaaaatgaatacgaagtctacagtttgcctggaatgaagcatgagaacatattacagttcattggtgcagaaaaacgaggcaccagtgttgatgtggatctttggctgatcacagcatttcatgaaaaggtaaaactacttaacgttttactttagtaaagtctgagttggcctgcctacctaatgctggctataaatccctcagagttatttttcgagacatcttatagttgattaatatttaacctgaaaataaaaatcattcttgaataaaaatgttttaaaaggtagtttattttaataaaagagcaaagatggcaactttttaacctaaaactctactcatataaaccacccttttgttccttatttcttgtgctgtaattactcttacaaacatttattttagtgtaggtaatgcttagtaattttcatttaccatttacaattcattttgattacgtgaaccatttttttaagttttaatcagtcttgcttgtgacaaaaccagagtcaggaaatttatctgatctttgatctgtcactaacttgcagggtaattatcaccaaaatgtaattgctagttttcctcaatttttctacttttagagtcagtgtgaaagtaccattaatgaagtaggaaattatgtttttggtaattggtttcatcattgtgaaatgtaagtggttcttttacttctcttatcttgacctaaaggacaacaataatctagaggaatattctacatattagttgttattttatgttgttattttgtgttctgctagtcccatgatataacaactctatagtcaggatattttaacttttaaaatattttctagaaccttagattttcaactagtctttaaaaaaaaaaaaaaacaaacttgtcttatagattggtggaaattgactattcttgtaacaaaagtttaaagctctggtatttccttctggtcaaatgtttattaatgtgaaatggaaggaaatttgaaccatttgaaccattccagaaagattgtttcttggatattatttttccctgaaagggaaactcacaacctcttataggtaaaaagaaaagtctccttatacatatggcctttgtcaagaacataagtttctttttttccctctttttttagggttcactatcagactttcttaaggctaatgtggtctcttggaatgaactgtgtcatattgcagaaaccatggctagaggattggcatatttacatgaggatatacctggcctaaaagatggccacaaacctgccatatctcacaggtagactaaatttatattgttttcccagataattgagtatatatttactaaacttttaagcccctgggtaaattttaatttttcctttgttatgcaatcatgctttacaagacagtcagttttcatttgttttttaaaattagctttgagattggccaggaagtattttggataatgtatatgttaacattattggtaaagtttaatgatctacttcatctcatttctgaaagcatgattgaaaataaactatattttctcgatctcaaaggaaaaagacatttgttttacctcaaaacatgatttatcaatagggattattatccaagggcatgtaatgaaggagagactttgaatgtcttccttgcttgttttttgaatgaccttatctgtaccctgagccaagtcttaaagggaggcatcacttaaaacagttgtccagtgaagaaatagtacttagacccaacagttgtcatgcccgcaaaaggaaaaatgattgtgtcttaaacatggaattcagtttgccatgtatttaattttcttgaacgtgggattcaatttgttgtcttgtgttccatttaaagatggttgtttgaaaagtaggcattaactgattcacagaacagatacttagctgagtgccaccaggcgatgttttaggttgctgggaggcattattgtaagtcagcctctaatttaggttctgattttgcaaactttaaatgacgtctacctcagaaataactcttctcactttcttacatgcagtctattggcctcgtcttcgattttcccttgccctacctggtcacatagggaattaatccttaaggacccccaaagttattaagggcctgaaagtcttttgaaactaagatcgattagcttttatagcatttgggagtgtctacttgtgctttcagtatcccattattggtctatatgtctgcacataaatttaaccactagtcattggcatagatgtatttaactagggtatagtaatctctaggatgagccagttgagacaggtgtgtagaagaggatatcttactgccttaaaactgttacccttttcagaacaccaggatctagctagagcagtgtatgtttatggtaaaaagtttctgttattcattccataagatgcttttctacaaccaggtggaagaatataagaacctctataataagggattattctaaaatgtaggtctctaccaataagcagaaggccccaattcagctattttttaaaagtttcttcattttggtttaaaatttctgtttctatgggagtttgcaaatcagaactctgagatattaacagtagttttatgattggtaggtgggtgacatagataacatatctttttggtatggcagatttttatataactgctttataggtaggattccttcttattgtccatgttatgaataggggtttgtcaccgtgctcttgtgtttaaggctgcatggggctctgagctttgtttgtctcactttctctgcatttcataattttaagtaactattttttcatagtgtacatattcccccttttctgctttcaataaaaaatttaaaaaggtaactagtttaaacttaatttgaatactctttttatttgcaagggacatcaaaagtaaaaatgtgctgttgaaaaacaacctgacagcttgcattgctgactttgggttggccttaaaatttgaggctggcaagtctgcaggcgatacccatggacaggtaaggatgatgattataaaatgtaagaaaaaataaacttgttccatattttcttagaatggcatgtcaggactgaattagtctaaaattgttgtggtgtttaaatcagcatctaatagagttatcaaagtttctgaggaagacattttcatatgatggtagaggactcaggtggtttagatcaagcacttcgtaaagcaacccttagacacacgtcataggattctttttgaaaaattgatcaaagaataatccaccaccttttaacagacctcattcttagggaattcttcgtatgaactccgtagttttagtctgttagttctttcaccatcttaagaagagtggaagaataattagtcactgtccttactacagtgtattaagatttcctgtccattttcccatgcaataatagtttattgcttcttgttgtttattgcttcattaatttctttaatcaacttgatggcttttctccaaattctctccagagttcagagcacttgtaaacccctgaattaggtaactcttcacacctctgtatatatccatatgcacagaaatcttagtaatgggaacctctaggaaggccaaaagggaaaagaacattatccatacagtttattctcagaaactttgaggctggaaaagatgttttcattcctgcaagatcaccttttatttttatttatttatttatttttgagacagagtctcgctctgtcacccaggctggagtgcagtggcatgatcttggctcactgcagcctctgccttccaagttcaagtgattctcctggctcagcttcctgagtagctgggattacacacatgcaccaccatgcccagcctaatgtttgtatttttaatggagatggggtttcaccaagttggccaggcttgtatcgagctcctgacctcaagtgatcctcccacctcggcctcccaaagtgctgggattataggcgtgagccaccacgcccagccaagatcaccttttaatcagggaaaccagttcaacctaaaaggtgacattttctacaaagctaaatggttcaggccttcgacattatcatttcttcatctttcatatcatgtaaattatttggccaactaattcttaggtttcttttccccagcatatcctattggttcctgaggacacgtttttaatgtcatggcaccaccaattttggcagtattgactaactatttaagaatgtagtttggggtaatggtcagtagccatatagctctagaaaagttgactgcaaatgtgtatgggaatggaggcaattttgtggagaatactaccaagattgtgtaggaagcctgaggacaaacttctaagctaattgaatgatagactatcataagactaaattctgggaacatattcttaatttggtacctcataagccctccctcattttttgagaaaaaaaatttctgactcattcatgtcatatttttaactccttcacaactgggttttatgattagttaaaaattattggcttacagtaatgactccttgactttagatttcatggaccagaaaatttcagaaatatttggagggacttgcatgttattgcacattttatatagtacaaagaacacatataaaagagggaacattttatgtcaacatggtaaataaaccataatcttacaataaaagaggtaggtaccttggatggcatacatttacctgtaagagaaaagtaggctttagggaaacattcactgatagcacaattaaaataattattctgagtagtaaattttttaaaagtagagccacttttccctttaatgtgttctccttgaactttagtcttagtgatctgtctttattcttaaaaaaaatctttacatgtatatttgcataaattgcccaacttttagtctagagtagagattatagccacctaaggatggagcgttatggacgtaccaatatctagactactctctagttcgaatacatcgcaagtatgttgtgatgtacccagctatctcacaaatatttttaagcattcatatatgaatgttgtcaagcaccaaccaaagctagctgtactagcttagtaaccatagttacagtactaagaaataccaaattgttggggacagttataaataaaggactccaagacagaagaatttatgaataaacaaatacatagattttgtacagatagaactttttaacatcagtctgtcctttacttagctaattctttttataacattttattagtttttttaatacagagaaaagacctcaaaaaaagttttttttttaaagctacatttcaaacagtatgcaaaggtacaattgaaaagtatgcagcatccttctcccagctgacaattggttcagtttcttgtgattacatccagaaaggggaacataaaaacttctaagtctgtaccagcataatgtctgttgatatattttttaagtatacgcagaaaggatctttctatttatacgctatagtctgtataccttaccctggtaatagaccacatttggttttgattcatcttacaaaatcatatgttagttcataaagttaatgaatgagtactctttgcttttaacatctttttcaggttggtacccggaggtacatggctccagaggtattagagggtgctataaacttccaaagggatgcatttttgaggatagatatgtatgccatgggattagtcctatgggaactggcttctcgctgtactgctgcagatggtaagggaaaaaaatatttttaaaaaagatatatatgcctaccacacatatatgaaaagggatgatacactccaaggtaatattttaaagtacagtttttttttaattgactccaagagatggtagagaattcaggaggcaggggagcagtgggtggggtaggagaggaaaggaattgctatgtattgatcctttaccattactagctatgttgctggacacttcacataccttaaggttatttcctaaaacggtttcagaggtagttattatgctttacatatgaggaaattgagatgcagagaaattaagtagtttgcctactttagcctcaaactggtgaatgatgaaacctagatttgaaactctgatccagacatagggagaggtctgctttaaggtcatatgggtcctgccccccaggttaaagggtttctattacttgttcttgttattgaagtccatgttcaagtcttatagatatttgcttttatttatttatttttctgggtaaattttcagacgatatttccagtgtgacagaactattttagtgtttcaagcactgtctttagtactccttcataaggtctttactctgtcttcaagtatgttgcagcattttttgttttgaataatataaggcaaacttgccgactgctaaactcctaaacagatgtaaatgagcttgatctgtttcttaagttctaatttataattgcctaaaaacttcctgtgattgtcaaagaccatagaagaaattgtgaatattttaagttataaccaatgtaacctatgttactaacaatattttattttctgagtactgtaataggctctcgttgtaggacagactgccactggaatatgaaattcaatatagggtactattaaagggaatttaatagagtgttcagaaatgggcattcttccaggattgagggattggcttgggagtcaatgccaaacctaagaaaagttgaagcaattttggaataatttcagaagtctttaggaagaagcgttaagaacgcagagtgttttgactctaagaggaatgacatttatgatgtgcatttatggaagcagaagtaggttagatggcagatgttataggaaaatatattttataagaactttattaatatgaactctccataacaaatcattggattaagtaatttaggagacacaagaccttattctcaagtaatatacagtttagttagggcaataaaatatatcctggacaattaactctagagtaagttaagtgtgagttgtctggcccattccccagtacataggtattcaataaatgtttctgggttagtgcaatacttaagaaatacaagcatgtgttttaggagtttaggggagaaattgctttgtttatggggaagagaggtttcagagaagttcttttggaaaaagaaaaggctagatactgacttttcttaaatgccatgaaataatttcagagtcaggcatttctgactcttaagtcagaacccaattgttaagtcagaaattggggtagagaggatagtgtgagcattgattgctaaagtaggtgctttcacgtgtgttgatggttacttgtttgttaaatgaagtaattctcaaactttaatgtgtcataccagattcttaggaatcttgttaaaatttagattctgactcagtaggtctgggttgaagcctgagagtctacatttcttaaaagctaagctaccagttgacggcagtgttgctggcctgtacaccacataagtgttgaatagacaccttagaatgtcggtactttgtcactggaagtactcaagcagagaccaactgtccagccatagataattcttatatttgaagagggttaagttagatgacccctttatgattcattgtattctacccaggagtatttagtgcatttcaagagcttcacaaaatttgtgtttatgcacacatacatctatctggtcactgatactgctcagtggtgacctgtgtctgtcaaaggaaggcaatccagtgattaaaaccagacttcagagttatttagagagttgggttcaattccagctctaccgtttaacagctgtatgtctttgtgcaaattatgtaacttttctgagcttcttatcagtaaatagaggtactgccatcttaaccctgtgaagtaagtaatatatgtaaagtttctgatcaggataggtgcttactggatgttagttattattaactcctaaatacaattttctatttatctgagtaggcctaagaaaaaaggaattatttatgttgtttaatgttgtctatgaaggcacatcctgacttgttgggacccctagttggagagcctgtttgtgattttctaaaaaataaacatgtactttttggcagctgttgtgagggagtgtagagaagaggtatgactctgaggtgcataattcctcatgtggggcatgcagggggtttggatatgccatagaataaacatggttataatagattgaacctagagcctccagagctggaagcaccactgttaacattctgatctgaattgtaaggaatgggtaccttaaagggatattatataacgttaatttacaaatactgattgttccttatgtcctctgtgcagatggaaataggcatcctttatacctagataagaaagccccttatgcaatctttaagggaattacatgccaaattataggccttttcatttcccatacattagtttggtcacactgtggtataagtacagttgagagtctgtttctcttctgtcctcatagcatgtaaacagttgggaataggtgacagagtatattttagaaagtttgtaccagtttgaaagtcaggaggattttaatgaaaatgatttattttacttttcttacttttcaggacctgtagatgaatacatgttgccatttgaggaggaaattggccagcatccatctcttgaagacatgcaggaagttgttgtgcataaaaaaaagaggcctgttttaagagattattggcagaaacatgctgtaagttatccagttagcttttcatttgaaattccaataaaacacttttcagaggaattatttatctctgcacatttctctttcttctgcaagtattttctggaaggtgatcttcacacaggatattctagagttctagaggcagaattagggctatgtctgtatacccctgaaggtgattgtaaagttatagagctttagagggcttttgtctcaatggtcctgtgcagaagattgtgtcatctatttagaaagtttcccagggaaaaggcatgccagactcggaaactgtggatagttgggtaactttgctgatgaccacttccaatatgacaacattttaaaaagtttatgaagcaccatgttttctcctctccatgggagtttgttgtagccttttaatttcggcttagactttcaagtcttaatagtgctttaaaactatagagaccaggcacataacagtattgccctggttatttcagtctaaatataactagaaacctggctaaaaccaggtagagaaatcccaagggtggctttctgatcttctgtttaattgtaagatagaaatgctgatattaactaagaaaacaataaaaattggtaggtcccctttatccttgatttttgagtccatttgaagggttagcattgaaatgacctgggttatgaacaagggatagagattttttttttggagttaaaaaaattcctcttgtgatagtctcatgcttaaaaaaaaagttctgtttgtgcttttctttatgattctgcacatggtagtcaataaaagtgaatgttgacagaaacttctttgacccagaaaaatagccatttcttcatgaaaattttattgtttcctaatagaaaacaaaaactgctgtggcgtttgagtatatgtttttctccttttagggaatggcaatgctctgtgaaaccattgaagaatgttgggatcacgacgcagaagccaggttatcagctggatgtgtaggtgaaagaattacccagatgcagagactaacaaatattattaccacagaggacattgtaacagtggtcacaatggtgacaaatgttgactttcctcccaaagaatctagtctatgatggttgcgccatctgtgcacactaagaaatgggactctgaactggagctgctaagctaaagaaactgcttacagtttattttctgtgtaaaatgagtaggatgtctcttggaaatgttaagaaagaagaccctttgttgaaaaatgttgctctgggagacttactgcattgccgacagcacagatgtgaaggacatgagactaagagaaaccttgcaaactctataaagaaacttttgaaaaagtgtacatgaagaatgtagccctctccaaatcaaggatcttttggacctggctaatggagtgtttgaaaactgacatcagatttcttaatgtctgtcagaagacactaattccttaaatgaactactgctattttttttaaatcaaaaacttttcatttcagattttaaaaagggtaacttgtttttattgcatttgctgttgtttctataaatgactattgtaatgccaatatgacacagcttgtgaatgtttagtgtgctgctgttctgtgtacataaagtcatcaaagtggggtacagtaaagaggcttccaagcattactttaacctccctcaacaaggtatacctcagttccacggttgctaaattataaaattgaaaacactaacaaaatttgaataataaatcgatccatgttttgtaacaaattcactgtgttatttaaggaaaaaaaggtaagctatgcttagtgccaacaataagtggccattcgtaaagcagtgttttagcatttcttgtgctggcttgtaatgtagggaaaaaaagtgctgttttttgaaaagatggtgtcatttcccccttcttcccatgttttaaagccccatcttatatccagttcccaaaatttgcatacttacctaagtattttttttaggtgtgctgtgtttggggaatatttgaaaatttaaagcatgatttaaaattttttaaagtgagctgtgacactggaaagctcttcattttatcttttaaaatagagttttttctatttatatatgtaaaattgtagtgtatttcttttcaccaaacagtgtgtgggacattctttatcactgttttaggatcacctcaggaagtgtcgttacccagaattccccactgtctgctatgagacttgtaactttatcactatacttctgcttggtgccatcttgtcagagtaatatttgatgtctgtgatatgtaaagaattatcctaggataaagatattaaactttaagcagatttcagatgttactgctttaaaacaaatcagggataacaaattaaacgtataacttaaaatatgcaatgacatttagaggtaaccaatgttgatataggtagcatagcctagcctcctccccaaaattgcttttacaactaacactgatactaatttaggatagttcatgccttatccttgctaagaaaatggaattgatggtaggcaggtgctaaagtgcttttcaaaacaatattacgttagaatacaattggattcttcctcaaatttatacaggccaaaaagtaaaacattaattttctgaatttccagattaccaatcaattaatcaacaaatagccagtattatgctgtgtatttctgtcaggtcattttaaaatccatgttaattttataaaagaattttttacatgtcactgtcaggagctcactgtgaatgtgttgtcttcaaatggttatttaaccacacagtacactacattttacatatatgtacgtaatctctgggaatagtaaattaattatgttatttataaacaatacataggtcaacagactttaagcagggaggaaaagaagagtaatagcgtctgtgtgctgcagaccattcagaactgtcacgtgtgtccccatggtctcattcattgtattcctagcaattcccttttcaatgttgagttcacctctttatttcacaaagtacttggtctctcaatttcttgatctggttttgcttccatttaaaaactaatcaagaagggaaaatattgagaatgtgcatacaagaaaatcattaatttcctgaagatgaatttctacctgttgtgaacatttaactttctttttaaaagttaaacaaaaataaacaagggatattatgatgaatgtttggcttatgtgagtactagagataaaatttttaaacccagttattcacaatataaaatgttttcaagttagaaaaaatttttagaaatcctgggtattgtatttaactgtagctaaccaattttaaaacttgtattcttttgagaactattattaatagaaaaactttttataagcagtaaaataagaatgttccagtgactacctgtccttatacctagtcttgttaaaactttcttttgcagggtatttagtgtttggtttacagtcagtgcagagtgggcaagttaacagaaagtttgagctagagatactggaaaaaaaaaagatcaaagaatgagaaaaatggtgatccattttggggcaaactgagaccccccaaataactctttcctcatgtgtatggtgctcctcatgactcgtcttgtattttgcctttctgatacccatcagaactgctgctgctctaacttatactctttaccttgcccagatctccgcgtaaggaatgctttatgatcaacttgccatag

SEQ ID NO: 12995 - DNA, 26355 bp, Human
agttagaggcgcctattaagagggagctcccttctactgaaatggaccgaggctgcagttctccactcaatacagggtgcatcaactcatgaattagctggtttcgaagttgtgtctagcataaaataaaaacaaaaataaaaaagaaacacaagggaaagaaatttcagcaggactgtttcattagagatatacacagatgagctacattcattggaaaccttccttctatttccataatggttctagatccatggccagaagttagaaaccttcccctgcacactttgtcttaccccgtgagacaagcagtccagtgggttctagaaaaagctttctttccccagcttccaaatgaaacgggtggttagccagatccacttgcagactcataacttcacttccctagaagcccatttcagcagcttacgattgggatattaagtataggaaaaaattctgccacttcatcacacctctgtggactgttggagaatataaccaaaatattcaacaacaggggactgctatatacattacaaaaatatccaaagataagcctgttgccactgaaaatgaagatttcaaaaaacttttaaggaaacagggaaatgctcaccatataatttaaattaaaaaaggatacatacacaggatatagctacatattttaaacgtaaaatatgcttttgaaatgcatatttcaatgaaaacacgttgagctaatcctactcctggctgttaatccaaatataaagcatactaataggtattttctgcccaaactaaacattcatacatttcaatatagtttaaagataaaatttttcatttcccaaactattattaagcagtacactagtattttctatatggtgtcaatgtccttcatccaaatgtattacaaacccacttattaatttaggaacctataagccatatttataaaacaagcctaatcttactgtgttcattatacaaatatttccttctcctatcttattgtcagttcaattaattatttgaatatgctcctttaagacgactcaaactcaacattttctcaaacattttcaagagactgtaatgtttcaggatacagagttattcgggaatataaaaatgtaattcaccaatacaatctatgtatcatacgattattaaaacctaaaccttgattgaatttgaactacctgttacaggttacacttgtaaaagctgacacagatacgcctaaatccgataccttgagtgtatccagtataccccgatccttaaacgtctggtatagctttttgcgcagttcatcttgactcaacacatcagccacggtaaacatgttggactaaaagacaaaatggttataggttacctgcggggcagagggaacgtgaacgtctgaaaacagaccagtggcctccggggaagccataagaggcctagcggcgaaagtttaacgaacacaaaacaagactttatttccgcccgagaaggggcaggtgtgtctacctgcgccatcatcaggcgtcagctccctccggagcccgcctcgctcgccccgccgcggcccgagtttagtgcccagcccgggcggtggggccaagacgagggggaatccctgccctcagaaccctgcctctgtcccgagggttcgggaggaacaaaggtgctgaacgttctctgcctcgcactcccaactaggttttctagcaaacacgcgagcttcctttcttcgcggttctgaggcaagggcgaggacccaggcacgactcaaaggcggctggagggcggggacccagacactagggactgaaggcagcgaggcaggaccgcctcacagccagtccggcaacttccggaaacctgctaaatatagccttcccgagctgaagagctacggcgcatgagcttggttgcccagcaccggccggaagctccgcctacgtatcgcgagagcacatcccagggtatcgcgagaactgcttcggcgttctggctacaggttcggggcgcgggtctcttccgcggaaactgacattgcgtttccgttgtcggcctcccactgcaggtagggaatggagcaagtgcggcggggggcgggtgttttgagtccctggaggacttcgtagcccctgcgtgacgcggatgttggtcctgtacctccacccctccccggggtggccgggccggacctgccagccctccgctggctcatccgcgcagcccttccacctgcagacgtccgccctctcgggggctgtggtttcgcggttcactgggtcattcagctaacccagggtttcttaacggctgcactgttgccttttggagccggaagattctttgttttgggaggctgtcctgtgcattgtaggtttagctgtatccttgctctctattttgtcagtatcaccttctcccccaagtgtgacaaccaaagatgtctccagatattgccagatgtcctcttggaagcaagatcgctccgggttgagatccacagagctaaacgttttagagtaccaaccattgtgtgctgtgaggtaaaggtgagccagtcctcatgatgcttaaatgtaattagaaaggaaaggaaccaaacctctcagaagcgataatgaaaatgttacagccagagaattgaacaagaactaagatacattgtagactggataaagagtttaaaggggaggtggttgaagatggaagtgatccagatcatctctgtggaaaaagtgtgtctttatcggggccttgatgggtaggattcgggtggtgagcaaaaaggagaacatcacaggaaggggaaaaatgagcaaaggaatcattaaaagaaaaaaaaaagccacgaccttcttgggagcagtgaggaatctagcctgactccagagttgtgtgctgggaatataagccttatatggtatctaagtcctgtgaggacagaattggatgtcagctttgtgtacagcattgaagatgagtacgatgagttttgatctctggctgtgaaaaacttaaagtatttaagaggcagtaagagtgacaggacttcataggaggtggagaacctgtaagtttttgttggaaacaatggaaaaggaggagaggcttagttggattttaaaggatgggtagtggttgcagacagaataaaggagaacattccaggcatgaagagagaaatgatagtagctctgaactcgatatagtcaaagtgaatttgggagaaaaaataagtaaacgagtcaacgctagcagaggtggaacaatagggctgagaaaagacacgtggagcaatgtgggaatcttgaatactagtacatgatcctgtagctgagatgcatcaaaggcttttgagtggaatgatgaaaacagtgttctaaaaagatgttgatatgttgtaaatgttgttaagtagaatcacttgtccactgtttaaaaaaaaaaaatgttcctgaagacccccttactcccacctccacctttggtcccacagttgaatacatgaatataattagataaaatgttctccaaaaactagcataacttctaggggagggagaattgcttataatattaatagaaaaatgtcacattaaagacctatcagtagtattcctactgcccctcctcattgtaatagacatgtcccatgccataccagtttagtctcatgaccccaggtttatggaacaactgaaatcactgctctcgcgagcacagggcagtttttctagaagctcttctatagaggttgtaaagaggcatgctacaaaaatggatgtctttggaactggagtccatgagttttatcttgcatttgtctacaacttaagagacttccaagttcactgagcatcctcccactctggcactgttggtgttccacccaccccttagtttctagtttcccagtgacttcaaatgagcagccctgggcttggcctatggaacggtttggaataagtctgtgtagtccagagtcagcaaatacttggccctcctgtaggtactgcacttccccaaattcatagcagacatggataattgatcacagcattctttcctggtgaccacatttagtctcagaatctttctcagcgccagttcctggcagtcactaccagttgattagaattcgcttatgaaaggaaactcatttgccatccctagccaagtccctttttcattagatagcttatcgtatttaaagatagtactgtgctgtaccccactccctttccaccccaaaaaggtctcccctactccgtttaaacatcctctgttacttcagttgctcttgtctggtttccagagcatttcctagcctagatcctgccctcccttcccctgtaacacacagagttattgatccttttacaatatgattcccagaactgagtaccttccccaaagatgataatattattgaagaggacatcagcattctccctgaccttgctcttaatgccacctagaattgattagcttttttgacaaacctatcagacttttgcctcttactgagcttgcagaacttttgggttgatgtagatgaactgttcttaatctaggtttcccttgtccttttgtacagttgatttttaagcccaagtacagggcttgctttcttatcctcttaacttctatcttgttaatttcaccttactctcctagccatggagatcttttttaatcctaacttctgccttctaataagttagctgcccttggtgttatctttgaatgtgataagttatcttcattcaagttattgattcaaatactgagctagactaggttaaggtcaacctcaaagccttactagagaccctgtgccataaattgacacggagcacccaatgttctccgagtattgacactcaagtcggctatgagccatccctcattcagcaaataatgagtgctttctgggtccctggcactgttgtagctctaggtataccatagtgaatgagacgaatggtgtatctgctctcatggagggcaacattctagcaagactgtattttcactcaggctccaggactccagtttgttcttaggtagataccaaaatatttcgtaaaatgactttctgtttacctaccgtatctcccttcagaaacaaaaaatgtaaatttggtatgacttgttctagtacaaccaggagtatatgaatgaataatctgtttttatctagggattcacattaaatgagttaatgtataataaaagtgcctggcatggcatctgactgaaaataaacatttaatacacgtttctgttggtgttctagtcgctctgaatgtaccctgttatagactaggagataagcctttttcctgtttctgaaaataggaatagcatttaacctagcggatgatatggcatttttcttgcaatttctcaaatgtcactgatcagcagttatgcaatcacatttgttaatccaaggtatataatttgtcaggacctgatgacttggatttattgaaatgtctagatgttttcttttttctttagttatacttttaagttctagggtacatgtgcacaacatgcaggtttgatacataggtatacatgtgccatgttggtttgctgcacccattaactcatcatttacattaggtattcctcctaatgctatccctcccccagccccccaccccctgacaggccccagtgtgtgatattccctgccctgtgtccaagtgatctcattgttcaattcccacctatgagtgagaacatgcagtgtttgcttttctgtccttgtgatagtttgctcagaatgatggtttccagcttcatccatgtccctacaaaggacatgaactcatccttttttatggctgcatagtattccatggtgtatatgtgccacattttcctaatccagtctatcattgatggacatttgggttcattccaagtctttgctattgtgaatagtgccacaataaacatacgtgtgcttgtgtctttatagtagcatgatttgtaatcctttgggtatatacccagcaataagtttgctgggtcaaatggtatttctacctctagatccttgaggaatcgccacactgtcttccacaatgattgaactaatttacactcccaccaacagtgtaaaagtgttcctatttctccacatcctctccagcatctgttatttcctgactttttaatgattgccattctaactggcgtgagatggtatctctttgtggttttgatttgcatttctctaatgaccagtgatgagcatttttttcatgtgtctgttggctgcatagatgtcttcttttgagaagtctctgttcatatcttttgcccactttttgatggggtttttttttttcttataaatttgtttgagttctttgtagattctggatattagcccttcgtcagatgggtagattgcaaacattttctcccattctgtaggttgcctgttcactctgatggtagtttcttttgccgtgcagaagctctttagtttaattagatcccatctgtctattttggcttttgttgtcattgcttttggtgttttagtcatgaagtccttgcccatgcctgtgtcctgaatggtattgcctaggttttcctctagagtttttatggttttaggtctaacatttaagtcttttttttgtttgttttttgttttttgagacgaagtttcactcttgttgcccaggctggagtgcaatggtgcaatcttgactcactgcaacctccacctcttggattcaagcaattcttctgcttctgcctcccgagtagcagggattacaggcatgtgccaccacgcccggctaagtttgtatttttagtagagacggggtttctccatgttggtcaggctgatcttgaactccctacctcaggtgatatgaccacctcagcctcccaaagtgccgggattacaggcttgagccaccgtgcccagccctaacatttaagtctttaatccatcttgaattaatttttgtataaggtgtaaggaagggatccagtttcaggtttctacatatggctagccagttttcccagcaccatttattaaatagggaatcctttccccatttcttgtttttgtcaggtttgtcaaagatcagatggttgtagatgtgtggtgttatttctgaggcctctgttctgttccattggtctatatatctgtttcggtaccagtaccatgctgttttggttactgtagccttgtagtatagtttgaagtcaggtagcatgatgcctccacctttcttcttttggctgaggattgtcttggcaatgtgggctcttttttggttccatatgaactttaaagtagtttttttcaattctgtgaagaaagtcattggtagcttgatggggatggcagtgaatctataaattacccttgggcagtatggccattttcatgatattgattcttcctatccatgagcatggaatgttcttccatttgtttgtatcctcttttatttcactgagcagtggtttgtagttctccttgaagaggtccttcacgtcccttgtaagttggattcctaggtattttattctctttgtagcaattgtgaatgggagttcacccatgctttggctctctgtctattattggtgtataggaatgcttgtgatttttgcatattgattttgtatcctgcgactttgctgaagctgcttatcagcttaaggagattttggactgagaccatggggttttctaaatttacaatcatgtcatctgcaaacagggacaacttgacttcctcttttcctaattgaataccctttagttctttctcttgcctgattgccctggccagaacttccaacactatgttgaataggagtggtgagagagggcatccttgtcttgtgccagttttgaaagggaatgcttccagtttttgcccattcagtatgatattggctgtgggtttgtcataaatagctcttattattttgagatatgttctatcaattcctagtttattgagagtttttaacatgaagggctgttgaattttgtcaaaggccttttctgcatctattgagataatcatgtggattttgtcgttggttctgtttatgtgatggattatgtttatcgatttgcgtatgttgaaccagccttgcatcccaggggtgaagctgacctgatcatggtggataagctttttgatgtactactggattcggtttgccagtattttattgaggattttcgcatcaatgttcatcggggatattggtctaaaattctctttttttattgtgtctctgctaggctttggtatcaggatgatgttggcttcataaaatgagttagggaggattccctctttttctgttgattggaatagtttcagaaggaatggtaccagctcctctttgtacctctggtagaattcggatgtgaatccatctggtcctggactttttttggttggtaagctattaattattgcctcgatttcagaacctgttattggtctatttagggattcaacttcttcctggtttagccttgggagagtgtatgtgtccaggaatttatccatttcttctagattttccagtttatttgcgtagaggtgtttatagtattctctgatggtagtttgtatttctgtgggatcggtggtgatatcccctttatcattttttattgcatctatctgattcttctctgttttcttctttattagtcttgctagtggtctatcaattttgttgatcttttgaaaaaaccagctcctggattcattgattttttaaagggtttttcgtgtgtttatctctttcagttctgctctgatcttagttatttcttgtcttctgctagcttttgaatttgtttgctcttgcttctctagttcttttaattgcaatgttagggtgtagattttaaatctttcctgctttctgttgtgggcatttagtgctataaatttccctctacacactgctttaaatgtgtcccagagattctgatactttgtgtctttgttttctttggtttcagagaacatctttatttctgccttcatttcgttatttacccagtagtcattcaggagcaagttgttcaatttccatttagttgagcagttttgagtgagtttttaaatcctgagttctaatttgattgcactgtggtctgagagacagttttttgtgatttgtgttcttttacatttgctggagtgctttacttccaattatgtagtcaattttagaataagtgcaatgtggtgctgagaagaatgtatattctgttgatttggggtggagagttctgtagatgtctattaggtccacttggtgcagagctgagttcaagtcctggatatccttgttaacctgtcttgttgatctgatattgacagtggggtgttaaaagtctcccattattattgtgtgggagtctaagtctctttgtaggtctctaaggacttgctttatgaatctaggtgctcctgtattgggtgcatatatatttaggatagttagctcttcttgttgaattgatccctttaccattatgtaatggccttctttgtctcttttgatctttgttggtttaaagtctgttttatcagaaaccaggattgcaacccctgcttttttgtgctttccatttgcttggtagatcttcctccatccctttattttgagcctatgtgtgtctttgcacatcagatgggtttcctgaatacagcacactgatgggtcttgattctttatccagtttgccagtctgtgtcttttaattggagcatttagtccatttacatttaaggttaatatttttatgtgtgaatttgatcctgtcattatgatgctagctggttattttgcccattagttgatgcagtttcttcatagtgtcaacagtctttacaatttggtatgtttttgcagtggctagtactgatttttcctttctatatttagtgcttccttcaggaactcttctaaggcaggcctggtggtgacaaaatctctcagcatttgcttgtctggaaaggattttatttctcctttgcttatgaagcttagtttggctggatatgaaattctgggttgaaaattcttttctttaagaatgttgaatattggcccccactctcttctggcttgtagggtttatgccaagagatccactgttagtctgatgggcttccctttgtgggtaacctgacctttctctctggctgcccttaacatttttttccttcatttcaaccttggcaaatctgacaattatgtaccttggggttgctctcctcaaggagtatctttgtggtattctctgtatttcctgaatttgaatgttggcctgtcttgctaggttgaggaagttctcctggataatatcctgaagagtgttttccaacttggttccattctccccatcactttcaggtacaccagtcaaacgtagatttggtcttttcacatagtcccatatttcttggaggctttgttcgtttctttttattcttttttctctaaccttgttttctcgctttatttcattaatttgatcttcaatcactgataccctttcttctacttgatcaaatcagttattgaagcttgtgtatgcatcatgaagttcttgtgccatggtttttagctccctcaggtcatttaaggtcttctctacactgtttattctagttagccattcgtctaatcttttttcaaggtttttagcttccttgagatgggttcaaacatgctcctttagctcagagaagtttgttattaccgaccttttgaagcctcattctgtcaactcatcaaagtcattctccgtccagctttgttccattgctggcgaggagctgcaatcctttggaggagaagaggcactctcatttttagaattttcagcttttctgttttggttcctccccatctttgtggttttatctgcctttggtctttgatgttggtgacctacagatggggttttggtgtagatgttgtttttgttgatgatgatgctattcctttctgtttgttagttttccttctaacagtcaggtccctcagctgcaggtctgttggagtttgctggaggtccactccagaccccgtttgcctgggtatcaccagcagaggctgcagaacagcaaatattgctgcctgatccttcctctggaagcttcatcccagaggggcacccgcctatatgaggtgtctgtcggcccctactgggaggtgtctcccaattaggccatacgggggtcagggacccccttgaggaggcagtctgtccgttctcagagctcaagcaccacgttgggggagccactgctctcttcagagctgtcagacagggatgtttaagtctgcagaagttgtctgctgccttttgttcagctaagccctgcccagagaggtggagtctagaggcagtaggctttgctgagctgcagcgggctctgcccagttcgagcttcctggccacttgtttacctactgaagcctcagcaatggcggacacccctcccccagccaggctgctgcctcacagttcaatctcagactgctgcgctagcagtgagcaaggctccgtgggcgtgggacctgccgagccaggcatgggagagaatctccttgtctgccggttgctaagaccttgggaaaagcacagtatttgggtgggagtatcccatttttccaggtacagtctgtcatggcttcccttggctaggagagggaaatcccccgaccccttgcactttctgggtgaggcgacgccctgccctgcttcagctcgccctccatgggctgcacccactgtccaaccagtcccaatgagatgaaccaggtacctcagttggaaatgcagaaatcacccatcttctgcgttgatcacgctgggagctgcagaccggaggtgttcctatttggccatcttggaacggatccctagacgttttcttaatatacctatcttgaggttcgcagcctgcctaaccttgtttcttccatgcttgctatttgaaaagtcatttaacagagaaaatggaagttaaacaggtcagcatccaccattatttcagtgtgtagcaagcgcttgaagcagttgacccttctcccttgctttttcctgatcgtagcctaaaaagcctctttttttttttttttttttaaatatatattacacacttcaactcattgtaggcctttgcccttctgatgctagcctcactgatttctggtcccgtttttatgttcattactagttagtgtcctacttcttacatcttccatgtggcctctttaaatttaaggtagtcagagagctctttgtatcaccaagtttatttctttagtcttctccttctcaaaagcccaggtttccctagccactgaagacagctgctgtttccaccacaagtgagagttctggctctcacttgagagccaaacaagaatctgtttccttgtactttccagcttctgggggcctcctgcattccttggctgtggccccttccttcattttcaaagctgtcaagatcacattgctgtgaccattcttctgtcacttccccctgactttcctcttttgcttccctattctacttttaaggcccttgtcatgacattgggtccacctggatgatccaggacaatgttcctatcttaaggtcagctgatgagcaaccttaattcctctttgccgtgggccctaacatactcacaagttgcagagattaggatgtggatgtcttaggagaggggccactgttctgcttgttcacctcagctagacatatggaaaccatcctagattctcctcttgtcctcaatttcccagtttaatctattcccaaattctgtgtagctacctcctcaacacctctgggccaagcctctcttggagatgcttcaaaggcccctatttaaggcgatgggaaaatcgagcagaccatacatacacagtcatgtcaacgcaggtaattcagtaatggcagttgctttatctgtattatatattggaattctaagtaatacttgtttttgttggtgaagggaaggtggaggaagtcacagaacttttataaaacgtttggaatcaggccgggcatggtggctcatgcctgtaatcccagcactttgggaggccaaggtgggcagatcacttgaggccaggagtgtgagaccagcctggccaacacggtgaatccccgtctctactaaaaatacaaaaattagccgggcatggtggcacatgcctatactcctggctactcaagaggctgaggcaggagaatctcctgaacctgggaggcggaggttgcagtgcgctaagattgtgccactagtttggaatcattgatctagagctgtgctgtctagtactgtggccactagccacatatggctatttatgtttaattaaaattcagttctacattctcactagccacatttttttttttttttttttgagatggagtcttgctctgtcaccaggctggagtgtgcagtggcacgatcttggctcactgcaagctccgcctcccgggttcacaccattcttctggctccgcctcccaggttcacaccattcttctgcctcagcctcccgagtagctgggactacaggtgcccaccaccacactcggctaattttttgtatttttagtagagatggggtttcaccatgttagccaggatggtctcgatctcctgacctcgtgatccgcccaccttggcctcccaaagtgctgggattacaggcgtgagccaccgcgcctggcctacactagccacatttctaatgcacactagctcacatattggacagcacaggtgtagaacatttctgtcctcgcagaaagttccatagattggacagcgcagaatcctagcgtgtgtcttacctttgctccataccctcaagtatttgctaagtgtttgcagctgttcccctcccgagacaatgaggtcattttctcccagggttttcagttcttccacttcacctgtcagtttttccttggcagaactgaatgaaaagctacagcccttcttgcttcttcagctgtttacaaaatcaaataattggcagctgaagtcaagcatggaatgtatataaagaaagctctgtctcatcttttgcgcagctgggtagttggtaacagcatcctcatgcagtcggtctttgagttccctttctgtcttcctgctgacttagcgccatgctgcttgcccattcgtggctttccatataggggtgagtgtggggatgcatgttatcttgcttatacatatgtgtacatatatttccttctgctgctgcttttgcttttttttttttttttttttttttttgctgctgcttaaatgtactgaagaaagtaagaagcccttcccttggcaaactccagctctgaaatctagtccagcaagaattcatgatatcattgtttacttggttcaaatttcaactccctgtccttcccttcactttggagaattattgccagttcttctagttttgcatagcttttttatcattccagctcgtctttgttatccactttttctgtttggacctttttcttatctttcccctaaaacaggggcaaacattttctttaaagggccagatagtaaatattgttggctttgtgggacagctggtctgtgtcacaggtgcttaactctgccattgaagcgtgagagcagccttagatggtcgcaaaatgatgggcaaggctagatttggcctgcagtctatagtcccccacccctccacccctgccccaaatagcattttaaatcttacgtcatcatgccaggagttctgatctgccttttcttccatagtcatggccttccaattctagagttaaaagtgccagctgtgccttgatttcctttataaaatgtgtcattcattagcaagtacatatcagatttcttctgatttcattgtgtgttctgtgtgaatcagcagaaggcccaatgaggcttgctaagtcttggcttctaacacacctcagatgtatgttctaggagactgactgtaactcccggtttacttgatttccactccgtgttgagaagttactagtcaccacatcccagtgtgcatacggtctcccatgttattccactaacattaattgagcatgtactgtgggtcagacactgtactgggtactttacatgcattagattgtgtgatcctcataagtgcaccataaggtgctacagtgttagcactatttaacagatgagaaaacggacattaggaagttaaggactgcctgtggtcacactgccagtaagtagcagagctagacctgaacctaactttgactccaaagtccttgtgttaaaaatacacaccgtggggttaccttggggtaaatccatccatgcccccacccatccatcattcatctagatttcaattatctgtgctaaaagccatggaatcacttatatttttccccccagtttctcgtagtttcatctcttctgccaatctgttttttttttttttttgagacagggtctcattttgtcacttagactggagtgcagtggtgcgatcttggttcactgcagccctgacctccctgggctcaggtgatcctcctgcgtcagcctcctgagtagctgggactacaggcacataccaccatgcctggctactttttgtatttcatgtagagatggagtttcaccatgttgcccaggctggtctcgaagtcctgggctgaagcaatctgcccatctcagccctccaaagtgctgggattacaggcgtgagccactgcaccgggcccaacatgttaaacttagttccaagatctttcagtgcctcagaatgtcttcctttatggattatttcttccatcttttctagaatacaaaactcttcctttcttataaattggtatataaagaggcatatcataggctcttagatttgcaaagacttacatttatagcacacatacttcaagtagaaagaagacaaatacagcacacgcagtctgcgaatcagtgatacagtgtctgtcctttctaggtaagtgacatgaggtagagttggttttagcttcccccgacggatgcctcctggaaatttctaaggcaaggtaattacttccttggtcttcccactactctgtattgtccttgacttaccaccaccttctgttaatccttctaggtgtccgtgctgctactaactggtccagtccaaatgaagcccagcttactctaccagacacttagggccccttgagctgaatgagccatattttcagatcatgagaatgttgtctttgtgatttcatgttagaggtcttccagtttacttaagaaaatacattagattcacagattcatatcatagatacataatttgtttattccagaagctacgtatcttcgctagtatactggaaactgccaagcttagtagcatcttcctctacaatgtcaggtttaaatttaaaaaagaattctacacttcccattagtcattttttaatttgaagattgactactaaaaatatgtactatttttcacttaattaggagccatatattgaagaccatgtctgggagcttctactttgtaattgttggccaccatgataatccagtttttgaaatggagtttttgccagctgggaaggcagaatccaaagtacgtaagaatttttatgctattgtaatgatatggtataatatgattttagaactggaagatctggacagataaggtaactgaaatccaccacaattaaatgaggcttgctcaggagcccacagactgatagaagccagccagggtatgtccttggagatgtttattcatcctttagttcagcacagactagcatgacgctctggcattcccatcatactcagttcactatgtcacccaccatgaattgctgttgcttaagcacataaagacatagttcacctgtagtggattgccgccttgaaataccatgaaagtccaggctgttttcatgaatcatgtttttcatcaggacctactgggttagaaaagacccttacttccctgtcttcctgctgccactgggtctgcagcacctcacttcaggggccttctgcagcacttcctggctgggttgagcctgtatgctcccctccccagtgacaccttggccatacacaggaagctcaaaagcagcaccagaggtgataccacccaacttgcttgtcaagaatggttccaaaaaccaagcttagctcgaggacatattgccattcagacccatagagtattttttttttttgagacaaggaaatggaccatatattttaagaaagattaccatcccaaatgcttaaaataaaaccatttggatcttatttatttattctttttgagacagagtcttgctctgtcgcccagactggagtgcagtgacacgatctcagctcactgcaacttctgcctcctgggttcaagcaattctcctgtattagcctcccaggtagctgggattataggtgcgcaccactgtgccaggctaatttttgtatttttagtagagacagggtttcgccatgttgcccaggctggtctcgaactcctgacctcaggtggtctgcctgccctcggcctcccaaagtgctgggattgcagacatgagccactacacctggcccagacctgtagagttttgacacgagaagagcccagttctttccaatttctgtttctaataaattgctgacaagtttgctatgtttctcccaacctccaaaaattggctttaatgtcctttaaggaattgatgttttaagttaattgtaatgcataatatatggtatttttcaactattcaggccttgccaccaaaataagataggcatttgtttacgggattctctatgaggtggagttgtgacattattttctcatattatgagaacactactcattaaaacttgtttttgaggtatctctgtaccagtactgctttgtgggatgcagctacttgtatgtaatttctgtgcactccactgcccttgtgttggacaaagcacacataaaaatactttgttgcataacttgattttagttctttctcctgctaccactcactttcttaaagcgttttcagtttgctcctaattcttcaggattgatcatcattgtaaaagaaaacactgctgtgagccagacacaaaaacatccatttctctaaggattcacttagctttgtcatggcaacatgagtgaagtaaaacatgctttaactatgcatgggattccacggcaacgggccgccctcctccagcccaggcatgagaacagcctccttggcaaggaagccgtctcagtttcctatggctgttgtaacaaagtacgaaaaactgagtggcttgggacagcagaaatttattgtctcagttctgagggccaccatctgaaatcaaggtgtcagtggggccatgctccctatgaaggcacaaagacaagggtctgtccaggcctctctcccagcttctgggagttccttggcttgtggcagcataactccagtcttcatgtggcatttttctccctgtgtgcatctctaaatgttccctttttctaaatacaccagtccattggattaggggcccaccctactccagtgtgacctcatcttagctaaccacatctgcaacaaccctctttccatataaggccacattctgaggtactgttgcttaggacttcaacaaaggaattttagagaggaaacacttcaacccataacaggtattctttgaaaaatggcttgggtttttttgagacggagttttgctcttgtcccccaggctggagtgcaatggcgtgatctcggctcactgcagcctccgcctcccaggttcaagcaattctcctgcctcagcctcccgagtagctgggattacaggcatgcaccaccacagccggccaatttttgtattagtagagatgggatttcaccatattggacaggctggtcttgaactcctgacctcaggtgatccacctgcctcagcctcccaaagtgctaggattacaagcataagccaccgcgcctggccaaaaaatgtattttcaaagaactacattggagtaagactgcattccaagttctgaattccgtcttcacattatggtcagacagtcccaccttctgttcacttaagccatttcagcccaggaaaaggacactcccagctctgacaggactgtgtcctgctattgacacaggcgactgctcacagctggggctgagcatcacctcccactactcctaggtcccgctgtcatgtaagctccatgcactggaaagaggcctctggcaggccgttataagcgccatttcaactgtctctactgcttacctggtgccactgtgcaggaagccccgccctctcagtttcctcccagaccttgaggcctagtgtgaatggcacctcttctccacaggatcttgttttttttttttttttttttttttttttttaacatagtatcctttttttacatgtttagatggttacagaattcggtaacttccttcttgaaacatgaaaaaaaatttatatgaaaaagattttcaataaatgattttgtataaatcctctatatacacatttcatttattaattggctgtttctgttgagatgtagatatcaaatttaaaaatagaatataatatgaaaacagatcttttataagtctcatgacaataacaaagtataaaagcaaactgttttttccccacaagaaaaccatctatagaatttacagaatgaaatgtcagcattctcgatgccatatgcaaatgttaatctgtggttgctcacactgtcatctaggacgaccatcgtcatctgaaccagttcatagctcatgctgctctcgacctcgtagatgagaacatgtggctatcgaacaacatgtacttgaaaactgtggacaagttcaacgagtggtttgtgtcggcatttgtcactgcggggcatatccttaccttcttagtaaaggtaactaactaaagtttgggctcacaaaccagaagaacatggaacatagatgccaggctctgagtctgtagacttcacagtcaggtgaaaatgtaagtttccatttatggggctacttttctttttttaggggggaaaaacattttgtttaatagctaattttaaaactaagtctcatacacaaaaagagtttatctggaccctatcaagggtgattttactttattttacagttattttctaactttgaaagcttatgttctctttatgataaaactaagctaattttaaacccagtttatatattcaacttttccatcacaaatacactgcatgtgactaatttgaagaatactgtatcaacgaactggttgctttttgtttttcatttctaagaaagattatgccttaattatttcacatatgaggtttattatgcttcatgacataagacaagaagatggaataaagaacttctttactgatgtttatgatttatatataaaggtatggtatgttctataatttttaaattctgatgagaaaggattcgacctttgtcaggaaactggcctattgaagtaactcccttaggctgcagtttacctttcagactagctttcccccatcagaactatctctggcaactccctccgcaggtaagtcttcacagccaggtgaatatgtatttaggaacacaacttcatggtagttacctttagatgattgtgaaggtaaattggtttcattcttcaccttgttgtcctcatagctgattttattagggatccctaaagacagcaagaaagcagcctatataagggaaaattacttcataatttaatctaaaatgtttccatctactttacaaataagttacagtgcaatagagatcataaactggcaggaagtgatttttatatgatcaaatagccactcaagaagaatggcgccacttgcatttcttgattttgaaaaataaaataataataggacgtcatggttacactgcagtgataacaatagtatgttttgttttggagacagtcttgctctgtcacccaggctggagtgcagtggcgtgatctcagctcactgcaacctctgccttccaggttcaagcgattctcctgcctcagcctcccaagtagctgggaccacaagtgtgcaccaccacacccagctaatttttgtattttcagtagagacgaggttttgccatgttggccaggctggtctcaaactcctgacctcaagtgatccacccgccttggcctcccaaagtgctgggattacaggcgtgagccaccatgcctggcccatatgtttttaataatttaaataagttctgtatttggacagaatttcttgcatatcagcacagtaatacaatttaacagtattcctagtcagaggtagtaagtaatatttagccctcttataaagatgaacaatgtcaagtgattaaggtataaaaatcagcaatgcctttcctcattagtgattccatttaatgattttctgtcatgcgttatgatacactaatttgagaagctgatcatttagcagtcttgtgttaaaggagagtattaaaaacctgattgttaaaagattaccacacaagaatagctttttctgaactctgagcacatggcagatttttttgttttatgtagccaaagggccatagagattaatccatttatttataatgaatatgagtatttcacacacacggtaaattctgaaagttaactgacacaggcaacatttatcatactgccattagttttgccacagatacttctcaaaaccaaaacaccaaaataaaaatttccttaagaggatgttattaacaatgcagcattttcaataaaacttaaaaatgtggtctttagactttggaatgtctttggtttttaatttaaaactttaaaatgatttcctttcagaaacttaagatttgtcagcttttttgcttcactaatactttcttctttcctagttttcaatgaatccattttatgaacccaattctcctattcgatcaagtgcatttgacagaaaagttcagtttcttgggaagaaacaccttttaagctgaatgcagaaaattccaaaataaatgatgtcaccacaatggtgtatactcaggaatgtgtacattgtaagttacttgattaaatagcctggaaaacttttgtgtattctcagcttatctaaacctaatgaaattccttttatatttaaaaatagtacattctgtctcatgtcacgtatcaatagatcaattggtatttccttgtgaacagtgttatttataaagagttcattatcaataatcatgttttttttttttttttttttctgatacagagtctcactctgttgccaggctggagtgcagtggcgcaatcttggctcactgcaacctccgcctcccaggttcaggcgattctcctgcctcagcctccaagtagctgggactacaggcgcgtgccaccacgcccggctaatttttgtatttttagtagagacagggtttcaccatattggtcaggctggtcttgaactcctgacctcgtgatctgcccgccttggcctcccaaagtactgggattacaggcgtgagccaccgtgcccaaccatgaaatatttttacttaaaaattgggaataagctcgctttttttttttttgagatggagtcttgctcctgttgtgcaggctgtagtgcagtggcacgatcttggctcactgcaacctccacctcccgggttcaagcaattctccttcttcagcctcccgagtagctgagattataggcgtgcaccaccacacctggctaatttttgtatttttagtagagacagggtttcaccatattggtcaggctggtcttgaactcctgacctcgtgatccacccacctcaggaagtgctgggattacaggcgtgtgagccaccacgcccggccatgaaatatttttacttaaaaattgggaataagctttttggttttttgtgggtttttgtttttgttttttgttttttgtttttttgagatggagtcttgctcctgttgtgcaggctggagtgcagtggcacagtcttggctcactgcaacctccacctcctgggttcaagcaattctccttcttcagcctcccgagtagctgggattacaggcatgcaccaccacacctggctaatttttgtgtttttagtagagacggggtttcgctattttggccgggctggtttcaaactcctgacctcagttgatccacccgcctcagcctcccaaagtgctaggattacaggcatgaaccaccgtgcccggccaggaataagcttttgacttacccaattcagataggttgatctttggggttttttttttttttttgagatggagtttcgctctgttgtccaggctggagtgcaatggcagttgtttcaccgtaacctctgcctcctgacttcaagcaattctcctgcctcagcctcccaaagtgctgggattacaggtgtgagccaccgtgcccggcccagataggttgatcttaatgtaacaacccaaaaataaatgtcatagtcaagatttggtagataaatttaaaattaaaatattctgcagttgggagtgaaatgtgatagcacatacgttgacattatgcatttagagatgttataaaaatgtataggcagtatacacagcactactcaagaagccaaagaaacacttgtgcagtgctaagtgtcacatgtctgcttccaccagaggctaggaatagtgatcctgctataatgtgagaacccaaatcatgtttataaaataggacgctgggagcagttgcaggccacagtgaagtgtgttgcttctgtcactttatattcttatatttcctttccctcagacagtaaactgttgatactcgtacttgtaaaaaattgtaaggcaatttttagtattgttgtcaaagaaaagcttggattacattaacatttgtattcagtcttttaggtgatacaccagagggggctgggaattgtctctttgttcctataagtagatcttaatgtaaaatagtaaatgtccattgaaaagcaagtaatacagcctgtgctaattgggagcacttgaacaattttgttccattctgagtaacttttgagcaagtaattctaagctttgtcttgtatccttgtgtgaaattgcataatttttaccctatttgatttcttaaataaagatgtttgctcaagatcgtggtagtttaatatccatttttaaagtgctgctttcgtcctatttctcctattgatagtctagtctgcaaactaatatgatgtcttcacctgttatagagctcagattgactcaaactagatgccagagctttgggagcagaaaaatttacatactcatctagaaatctaggagtaatttcagcaaacgtgtatttttttgtatatagttggcccctccctcaatgagcatatcatccagagggctgtgatgcagggcagccaagagcagcagggtgattgattgagagcaggaagacttggctcagctgcacaacagtggtaccctgaaaatagccttttctccaggctggtgaaggtgaggtaggcactagtaacacacttgtgagtatattactaaagttaaatgccaaatttcatgtgtgactgagtcttcaaaggagctggaagggaagtggagcattgagtgggacctccaaggtaggctgcacaggaaagcattgcaggtgtgaaggtgtgaagagcacttgggcacatgggtggaactgacagctgattgattgatagatagataggagctgatcatgaggaaagctaagctggcaaagcttggatctggtaggtgatgttccttgaaggttctggaacacaagagcaatggggtgaagtcagtcttaaaatcaggctctcctgagcacatgtatgttagcacaaagttggttatctgctttagtgctccaaaagtgatccagataaaacgtacaccgagttttgtcatcttgccatagccagaaacttactaggatgcttcctttggcatggacatagatcgtctcagtctctgctctgcccatgctattacccatgcgctttaatttttcagtcacttcaacacttcctggttgacagtccagagttccagaaaccactgactctccagacaccacctttcactgggtaccacactggtgtgtttttctacttaacaaacacttcactactctacaagacacggatattgtgtgagaacttgcatggtggtgtcacaatattaaaatgaaaagtttgtacagaaatataaaaaggttttcttctaagacaagtaatagtaggaatgttttaacttcaactaggaaactttccccaagggtgaaaaataaaaacatttagtccattaatgaattgtaattttgtatcttccacacagcacattgtaattgttacatcagttaacaaatgcaggtttgtctgttctccagttcagtagtttgcttttttttttttttttttttttttgaggtggagtctcactgtcaccaggctggagtgcagtgatgtgatctcggctcactgcaacctccaccttccgggttcaagtgattctcctgcgtcagccttccgagaagctgggactacaggcacgatgcccaactaatttttgtatttttagtagagaccgggttcaccatgttgtcaaggatggtgtcgacctcttgacctccaaaagtgttgggattgcaggcgtgagccaccgcgcctggccttgccttttttcttaaaaccgaactgtatctctgctgggggcagtggttcactccctacatgacagtcagctcctctcacccagcatgtcctttgatatccccatcactccccagttgagggtctcatccacactcagtctaggctttggttagcctccatagaatcagatagtcaccaaccacacagcatatgaacttcatccacaaaagaccacaatttgctttatcaagtctgatcactgcaacaagtctttttctaacaaaaaatctccttgagagcaaatcactaaatgttcagtaatagagaagacactaagtaaatacattgccgaataaagatgtcttcgtttaccctctcacaaagtacaatccttcttagtatttcttctgagagtgataaagtcagcttgtgtcttgtgttataaaggaatgttttaacttcaattaagaaactt

SEQ ID NO: 12996 - DNA, 36242 bp, Human
gcaagtcaaacggatttatttattgtatctcaaacagtcctcttatattttcctttctgtattttttgataattttcttgtgcctggaatattctctgcttttatttaagtctcaccatctttcaagacacaaaatatgtgtgatctctgaggcctttgtgaactgcctccagcatttactaagcaattaattctgtctctgaacttttatagcacaaacccattcgttcacttgatatttaacaaatatcaacctctatcacttatctcttttttttttttttttcttctgagatggagtcttgctctgtcacccaggctggactgcagtggcgcgatctccgctcactgcaacctctgcctcccgagatcaagcgattcttctgcctcagcctcccaagtggctaggattacaggcgcccgccacggggcccggctaatttttgtatttttagtagagacaaggtttcaccatcttggccaggctggtctcgaactcctaacctcgtgatccacccacctcagcctcccaaagtgctgggattacaagcgtgagccaccgtgcgcagcctatcacttatcttttcatgcttacattttctcactgcttgagattttctttcatccagggtcaagcactgagtctattagaaaccccactgtatatgatctgatgaagatgagattatctttttaaaagccacatattaaatctcttaagttaataatattggcaatcaacttaaatcaactgagtgaccactatgtttaaggaagtttcctttctggtaggctgggaagcgggagaagggaaggatataactttataaaaaaaaaaaagctgcagaagggaaggatataactttataaaaaaaggtccttgttcacaaggagctaatcacttactggccagagaagaaacgtgttccttctttgcaatggctgtgtttttgggtttagctaactcaattctttatgtcctcaatttatgagaccgcatcaaaaacgtttttgccacatctctgtgggaaagtaggtgagtcagaatgagtgcataatatataagtatatattttaatgataatgaatgtgtagattaacaaacccaaactttgtttttgtttttttgagagtcttgccctgtcgcccaggctggagtgcaatggcatgatcttggctcactgcagcctctgcctcccgggttcacaggattgtcctgcctcagcctccggagtagagtagctgggattacaggtgaccgccaccacgcccgactaatttttgtagtttttagtagagacggcgtttcccatgttggccaggttggtcttgaactcctgacctcaagtgatccacccgcctcggcctacccaaagtgatgggattacaagcgtgagccaccgcgcccagccaaacccaaacattctaaaagcgcagagtaaccgctcccctccccgccaacggtaaccagcatcttcgttctccaaccagaacagctgtatgcaccggtgtataagcctgccttaagtgctatttttaatcttttttaaaaacaggccttaaaataactcatttgggtacaactccagcggctggtggagtgggcttaatatattaaacagctgttaattttggtttctttttggtaacagcgacacggagatccgcatttgtcgcagtttccaccgcgggcgggaagtgtaaacacaagaaatacaaacatagcgcaacggctaaaggagtgtcacagcgccaaaccttgctggctccgcgccaggccgagccccaccctctcagctcgcggccaacacccccaccccgcctcacagcccgccgcgcccgcggggcgacaccccccactccatcatcccggaggtggtgcggccgagccccggacccaattggcggaagcggggccggttgtgtgcgcgcgcacaaatgcccggatgcgccgcgacgacccgcgcgctcccctcgggcggtagggggcgcgcaccgaggcaccgcggcgagcttggctgcttctggggcctgtgtggccctgtgtgtcggaaagatggagcaagaagccgagcccgaggggcggccgcgacccctctgaccgagatcctgctgctttcgcagccaggagcaccgtccctccccggattagtgcgtacgagcgcccagtgccctggcccggagagtggaatgatccccgaggcccagggcgtcgtgcttccgcgcgccccgtgaaggaaactggggagtcttgagggacccccgactccaagcgcgaaaaccccggatggtgaggagcaggtactggcccggcagcgagcggtcacttttgggtctgggctctgacggtgtcccctctatcgctggttcccagcctctgcccgttcgcagcctttgtgcggttcgtggctgggggctcggggcgcggggcgcggggcatggggcacgtggctttgcggaggttttgttggactggggctaggcagtcgccgccagggaggagggcgggatttcggacggctctcgcggcggtgggggtgggggtggttcggaggtctccgcgggagttcagggtaaaggtcacgggggccgggggctgcggggccgcttcggcgcgggaggtccggatgatcgcaggtgcctgtcgggtcactagtgtgaacgctgcgcgtagtctgggcgggattgggccggttcagtgggcaggttgactcagcttttcctcttgagctggtcaagttcagacacgttccgaaactgcagtaaaaggagttaagtcctgacttgtctccagctggggctatttaaaccatgcattttcccagctgtgttcagtggcgattggagggtagacctgtgggcacggacgcacgccactttttctctgctgatccaggtaagcaccgacttgcttgtagctttagttttaactgttgtttatgttctttatatatgatgtattttccacagatgtttcatgatttccagttttcatcgtgtcttttttttccttgtaggcaaatgtgcaataccaacatgtctgtacctactgatggtgctgtaaccacctcacagattccagcttcggaacaagagaccctggttagtatttttgtctcgtgtaacttttaagaataatttattttatgaagtgataaactaaatttcgtatacctcaattgtagcatggctctgtaaataaaattgtatgtgcatagcttaaagtgtgctacctctggcgtaactgcgtggagttaaaaactgttaagaactggtcagtatttttttagccatttgccacatttgctttaaaaattagttccattacattgttaagcgtggttgaagttacgtttgttacgtgactgatttttttttcctttttgacctcccagtatttaatttttaaaaatggtttctaaaagtcaaaaaaattattcgtgcttgttttaaagatttttgtcattagagaaattttaaagtaaaacctgaaaattccaggctttttgctccatgtttccttttagattttttgtgtgcgtacccacatatatttacatttgaatttaaatctatgttattgtcctgtttgttgtactaacaagatgaaactgtagttgttctgtgacttgcatccttgtcaataaataaagtctacagaattctttttaatggctgcatagtattccacagcatgagtataccattttaaaaattatttatgcctttactgataggtttttaaaaattgcctcctgtttttgagtattacagatagtgccgctttgtacatgcatcccgtgtgactatttctgtaagaaagattttatagaattataggctggcctcggtggctcacccctgtaatcccatcactttgggaggccaaggcggaccgatcacctgagatgaggagttcaagactagcctggccaacatggtgaaaacctgtctctactaaaaatacaaaaattagtcgggcatggtggcgcgcgcctataatcccctgctgaggaggctggggcaggagaatcgcttgaacccaggaggcagaggttgcggtgagccaagattgcgccatttcactccagcctgggcgataagagcgaaactccgtctaaaaaaaaaaaaaagaaaagaaaaagattttagagaattagaactcctgagttctcaattttactatttgattgctactggtaacttgctcaccaaaaggctctaacagtttcactcctgccaatactgaatatcaccaatctttaattattattattatttttttttttgaggcggagtcttgctctgtctcccaggctggagtgcagtggcacaatctcggctcactgcaatctccgttccccgggttcacgccattcccctgcctcagcctcccgagtagctgggactacaggcgcccaccaccacgcccggctaattttttgtatttttagtagagacggggtttcaccatgttagccaggatgatcttgatcccctgacctggtgatccgcccgcctcggcctcccaaagtgctgggattacaggcgtgagtcactgcgcctggcctcttttattattattactatttttttgataaaaggtactgtaccattgtttaaattcatttttctctagtttcttggtgaggctgggcacctttcctttttgtttttgtttttgttttttttgagacagagtttcactcctgttgcccaggctggagtgcaatggcgagatcttgtctcattgcaacctctgcctcacgggttcaagcgattctcttgcctcagcctctggagtagctgggattacaggcatgcgccaccacgctcagctaattttgtatttttagtagagatggggtttttccatgttggtcaggctggtcttgaactcccaacttcaggtgatctgcctgcctcggcctcccaaagtgctgggattacaggcgtgaatcactgcaccaggcctccattttgttaagtcatttatttcttctgggacttgcctagtcttatctgtccattttccttttagttttttaaaatttttcttagtaattggagtagctctatgtgtttcaagtatatttaacttttgttgtttactaatgtagcatttaattttatgttgtcttttccccattgagaacaattctgtgaagtaaaatttgttggcttttgaatttcatatcatgctttggaagaactctcctgtcccaagatcttgcaaatatattcctatattttcttctagatttaaattttttaaatatttagatcttcacctgtaatttaccttcttgttcttcaatgtaagattacaaatgctattatcttttatagctgttttctcattaatacatgtcttttaagtcactaatatactgatggctttccattacagatttttttttttttttttttttgagactgagtcttggtctgttgcccaggctggagtgcagtggcatgatctcggctcactgcaacctctgcttcctgggttcaagcaattctgccgcagcctcccgagtagctgggattacaggcacccacctccacacccggataatttttgtacttttagtagagatagggtttcaccatgttgtccaggctggtcttgaacttctgacctcctgatctgcctgtcttggcctcccaaagtgctgggattaaaggcatgagccactgcgcctggcccacacctgggtaatttttgtatatttaatagagacggagtttcactgtgttggccaggctggtctcacactcctgacctcaggtgatctgcctgcctcggcctcccaaagtgctgggattacagacctgagccactgcacctggcttccattacagatttttactttgaattattttatctaatttgaagctaatatagcatataataaaaattcaggagaaaaaaggttatttttaaatcttttttgagagagtccattctttagcctgaaagtaaagtgcatatgtaagcacagttaaaaaaaaaaaagtgatcagaaaaattaataattcaattctatatgtattttaaatttttcaattgttaaataatatttgttttattgattagctggaaataggcaatttttaaaaatctgtttttaaggcatccccaatgggggtgctgtcagattttaaagttagacagaggaccggggcatattaaagagaggtgcagaggtaccagtttgtgtggtagtggcaagctgtaaagatacttgagttttgcagattttgataaaccaaaaggaagggagaaagtgcatagtatattacattcccctcccccatgacaattatttttctcaagaccatttgtaaaacctctagataaggggcaggcaaatgttagcctgtcagccaactttggcctgttacctgtttttgttttagtttttaaattttttttgtagaggtggagtctctcagtgtggcccaggctggtcttgaacacctagcctcaagcaaacctctagcactgtctcccaaagtgctggggttataggcaagagccacctctcccagccagctgcctttctttctgtaaggaaaattttactggaatgcaaccatgcccgttggtttacatagtagccatgctttttacttggatagaaccatttgtatgaaaagcttaaaatacttacagtctggctctttacagaaaaaaattgacccctaatctagttggcaggctccttgcatacaggtcatatgtcttatttgtaatttcttttgcagtacctaccactgtccagtgcatagtagaagctcaataaatgtttgtcaagtagatatttgaaatgtagactaactaagaggcagcatgatatagtaggaagaaaatgctgagttgtagttgagggacctgggttgttatctctgatctgttcttaattacccttgtcagcttgggttagttagttaggttctctagccttcaggaacctaatctttagaaagagaagattgataacaggacccactctaaagatttattcatttctctttgattctctaagttagcttgcaataagctcgttggatcagtacggtaagctcattggatctcagtaatttatggttgtttgtaaggcagtaagcaggtaatataaatagctgaaggaaaaagtaatctttgctcttttggattggatactatctgtgatcacaactgatacttgatgattccatgatacttgcataatgattagatcctccccagcattttttccaaatcccctttattgaacttgatggatatgtttgctgcagggcctatagttctgggataattttggaagtataatagcagttcttttctctttataggttagaccaaagccattgcttttgaagttattaaagtctgttggtgcacaaaaagacacttatactatgaaagaggtaagctgaatcaagagataagtagtatctcactagttacatgtagccatacttaaagttttcaagaccatgtggagaaattggccatatagaaggatttttcattaagcagcaacatttaattttgtggtcgtttggactatattttaaagctgaaaattctaattatactcgagtttcatttctcagctaggaactcagataaatggaagccccgtaagggtgcttgaccattttatgctgtcaaccctttggtagactccttcccagaatcatgtttttaaatgtatgaaataaaatgtatagaattacaaaggaaacatactaaaatacggttaccaaaatagtaaactagtttgtgatatgtgtgcttttgttattaacataataaatactaagatttagaagaagatataataaatataatgtttttttgttttttgagacgaagtctcgctctgtcacccaagctggagtgcagtggcacgatctcagctcactgcaacctccgcctcctagattcaagcccttcttctgccttacccttccaagtagctgggattataggcacctgccaccacgcctggctaattttttgtctttttagtagagatggggtttctccatgttggccaggctggtcttgaactcctagtctcaggtgatccacttgccttggcctcccaaaatgctgggattataggcatgagccaccatgcctggccaataaatattatcttgatatagtgaggaatataagtcatattttgaaatgtttgccataagtacagtatgataggaaaacacctctgatttttgttggtgatgaaatcacaggtattaatactgttgtgatttgttgcctacatttataatcgaaggaaaagctaaattctagttagaagtttgtgaaaataagaatagaattttttttttcccatccaaattaatggaccccctgaattctatccaaggacttcttgggcatccctggatcccaggttaagaacttctgcactagagatacatgagtacagtatactgatctttctgggatagaggtgagctgattcatgaccatatattctatctaatggttccagcattttaatgcattccccacctttaaatttgtgcacagaagcatgattttcagtgacagattgagccaccttaggcagaatttcagtgtgattgaaatatgcctgttctctgtctctcccacttagtttatgggactcagattacttaaaacatttaagtttctttcttacaacggtatagtggggcaggaagagcttccatttttctttttcctctccagctatacttttagaaacttccttaaaggatgtttggtagaataaatctaagttctcttcctttttcctttcccactgctggacagcaatctgtccaatccacagtcacataagaatattcctttaaggccgatgcctgcttagccagttaaatccaaagacagtgtttgtaggaaagggccaggttaaatggtatttttaaggctaatttgggattgaccttattatcattggataatcagttaaggaaacaaaaaagtatggatttagcagtagatagaaatgagaaaattggccaaggccatcataaagacttagaatgcttatgctaaactatgtaacagtagtgtatgtattgtctgatatagttctcagttataggatctttgttctggggcacacaggaaggtagtgaaagctagtatgggtagtaaaaagagcgttggattaagagtcagaagagctggggccagtttcttcttcttttttttttttttttttttttttatgtgacagtttctcactctcttgcccaggctggagtgcagtggcatgatcactgctcgctgcagcctggacctcgtgggctcaggtgatcctcccacctcagtgtctgcagtagctaggactacaggcttgtaccactatgcctggctaatttttgtatttttttgtagagatggagtttcactatgttgcccaggctggtctggaactcctgggctcaagggatctgcttacctcggcctcctaaagtgctagatttacaggtgtgagccactgtgcccaacgcaatttcttcatttctaatacagtgataataatcttatgaaatatcagaatgagataatacttataaaagtacattgtaaactgtaaaatgccatatgtatttaggtagttgttaataggtttatatctggatatcttaaaaatgtattgccaacttcttgtcttaatgcagcacagggaatataatttaacttttattaatggttcaaagtcattattttgattatttatcataatatggagtaaattgataccttagagggtttatttcattctcagaattctctcaaactgttttgtagctgtcattgattgattgtttttctgtcttcctcctctggtgacctcagaggctattgaggtttatagtatttatgactatttactaagtggctccagaccactgccatattttagttgatttttgtttctgcaacttttttggctatcagttttttattttgctgccttttcccttcctaatatgttagtatctaagtatctgggcagagttaaagtctacaaggaaaaaaacctcacattttaaggtttgcttaagtaaatagagaagcagttatttctgcttctgtcaaattaaatggaaaaggcttaaaagtagctttttttttttttttttttttttttttgagatgaagtctcactctgttgcttaagccggagtgcagtggcgcaatctcggctcactgcagcctccacctcctgggttcaagcaattctcctgcctcagcctccctaatagctgggattacaggtgtctgccaccatgcctggctaacttttgtatttttagtagagatgggaccaggatggtctttatctcctgacctcgtgatccatccgcttcggcctcccgaagtactgggattacaggtgtgagccactgcgcccagccaaaagtagcttctaagtacaaaatggttgttctacatagttgtggatatggttcctggttgtttacccctattcagataaataggatattattaaatgtatttacaactaacatttagttttctttaatgctcagaaatcatatttgtatttcaggttcttttttatcttggccagtatattatgactaaacgattatatgatgagaagcaacaacatattgtatattgttcaaatgatcttctaggagatttgtttggcgtgccaagcttctctgtgaaagagcacaggtaattcttcagtttagtccattgtaaaaagccatctgggctaacatttcagttcacctctaccctcattcacttttgtcagagaaaaactgttgaaacatattaaagacatgctgaaacttaattttttagctctgcggcatattatttgagaacctgagctctggcatcttataaaccagtgtttgaaacctagcccaatcatttactagttttgtgactagataaattaacctttttaaacctgcttccccatttataaaatagggataattaaatacttcatgtggaggttaaagctcttgaagagagacgttgtataaaaaagcatagttttgggcacatacaaagcattcaagtattagctgtagctattataactttttattccagaaacagtataccaccacgtggtaaaggcttacatttgagccttagttattttggagatcattttcattgtcacctatcattatggcacttaaccagcagaatttaacccaggtaatatttctagaaataggcctggtgcggtggctcacacctgtaatcccagcactttgagaggccaaggcgggtggatcacctgaggttgggagttggagaccagcctgaccaacatggagaaaccctgtctctactaaaaatacaaaattagctgggtgtggtggtgcatgcctgtaattccagctactcgggaggctgaggcagtagaatcacttgaaccaggcaggtggaggttgtggttgaggtgagccgagattgcgccactgcactccagcctgggcaacgagcaaaactgcatctgaaaaaaaaatttttttaatatatatttttctaaaattattcttttttttgtttgtttgttttgagagggagtcttgctctatggcccaggctggagtgcagtggcatgatcttggctcactgcaacctccgtctcctgggttcaagtgattctcctgcctcggcttcccgagtagctgggattacaggtgcctgctgccatgcctaatttttgtatttttagtagagacagggtttcacgatgttgaccaggctggtcttgagctcctaaccttcggtaatccacctgccatggcctcccaaagtgctgggattacagatgtgagcaaccacacccggcctacatttggaattctttgtcacatttggtttagcacaggcaatccgtgttgagccttagcattcattacattaataaatggaatgaatacgttcacctgagacaattaactagcttctgctagtatttaatgctcagtagtatagctgaaaagatgataattaaatgggattttattttattaaaaaacataacttcctcagctgagcaagggattttataactttaaaacaaccttattattgtaaacatagtatatattattattgaacattaggagatgacagaaaactaagaaaagtaaaggaaaaaaaaggactgtagtttgttaacaaaaggtatttttaccagtcatttgtgtattatgtgcaactgtgtgttttaacctagttatgaatatagtactatatttaaatttcatctagcttcttaatttgtattataatttgtatattatatattataatatacatataatataattatatatattacaaatatatgtataattattattttttattgatgagtcacttctgtttaatatccatatatgttgtcattttatacgtggccttggtatatatggtttaattttataaattttaaaaataactatattggtatattggtgatttctttacctattgaatattgaatcttctattttttttcttttttttttgagatgaagtcttgctctgttgcccaggctgcaacctctgcctcctgggttcaagcgattctcttgcctcagcctcctgagtagctgggattacaggtgcacactactatgagcagctaattttttgtatttttagtagagatggggttttgccatgttggccaggctggtctcgaactcctgacttcaagtgatctgcctgtcttggcctcccaaagtgctgggattacagacgtgagccactgtgcctggtctgaatattgaatcttcggataatgtttggaagtatgatttccttggacttgaattctaaatgttgagagataagaaataggagaaattactgacttgaaaaggatatgaattaaaaatattgtgggtttaggttgctgtatccttattcccaaggatgaaaaaagatagttgggattcatatttcctcttaatattgagtgagaaacaatattttgtgacaaacactctcttaaatccttagtttaaaaacaaaaggaaaaatccattgtgacatcaacgaatactggggtaaatgaattatcctcctgttaggatataaacttcatgagggcatatacatttctgtttcattctttgttttcccccgtgtctggtacatagtaccagtgactggtacgtggtaggttttcagtctgtatttattgaatgaatgagtactgctttatctgttaataagtttcttttttttcttccctgagtcggagttttgctcttgttgcccaggctggagtgcaatggcgtgatcttggctcaccgcaacctctgcctcccgggtttaagtgattatcccgcctcagtctcctgagtagctgggattacaggcatgcgccaccatgcccagctaattttatatttttagtagagatggggtttctccatgttggtcaggctggtcttgagctccaggcctcgggtgatctgccggactcggccttccgaagtgctgggattacaggtgtctgtgagccactgcgcccggcctctgttaatacgttttaagatcaagaaaggaagttgaagcttgatgaaagtcaagattataatcaaattcctatttaatggattttgcgtaactcaatagtttttttggcagtttgtatttaatggattttgcataactcaatgcttttttttggcagtttgctactaagcacagagctaaaaacattcctgtttgaaaataagtatgttcaacctcttcctgcttgcatactcattttttgggggtcttctggtaaagtccaaacaaagcacatttcaggaattggtagtgtgaaatctttcagctagagagactttagtaattattaaaagtagctgtacataatcattgtgctactaattattgtgcttttaagtgcctacaagcttgccaatgataaatttggttttgaatgtgtgcagtagttcatactaagtatgtatgtagaagtctggttagatccagcttaatacaaatttttattctaaaatgtacatctcttgttattttttttttttctgtctacaaggaaaatatataccatgatctacaggaacttggtagtagtcaatcagcagggtaagttaattttgagcatcatggataaataccataaaaacgttttaaagacatttttgtttatgtgcatatgttttataattgtgattctctttaaaagttgctttaattaaatattgtaataaaagtatgataaatttattagaagtacatatgaactaaaaccacatactgaggttctaatgtaaagttaaatatcctgttagatcaatttagacttgggatatcagagttaggatttattttgaaaggtctgtaatttcaaaagctcctgtttaggagtgatctaccttgaaaatgtattgaaaggctttgggaaataatattgttacctaggtaggaccatgtgtaaggatgaaggatgagtctttttctttggttatagacaaaattttgtttaccaatttgtggaagtggaattttatgttcctacttccgtttcttaactggttatttttgggtcacatctctctttaataagctgataaaagcattgggttcttgttccagaaagatgcacatgtatatatacatgggtaagtcaataagtgttttacaacctactttccatgagaaaagccctgatttatgtgcttgctgacttccatagtataatactctcatttgaaggctaaaaacatggagttgggaagagatgtacacagtttgctttttttttttttttttttttgagaaggaatcttgctctgtcactcaggctggagtgtagtggcatgatctcgactcactgcaacctccgcctcccaggttcaagcaattcttctgcctcagcctcccgagtagatgggactacaggcgtatgccaccacgcccggctaatttttgtatttttagtagagagggggtttcagcatgttggccaggctggtctcgaactcctgaccttgtgatctgcctgcctcggccttccaaagtcctgggattacaggtatgagccactgcacccggtctcacagtttgcttttgagtgctgcttagagctgtctctaatacactacactgctcctaaagcccatcctcgaactacagttaagaaatgctcttaggccaggtgtgatggctcatgcctataattccagcactttaggaggctaaggcaggaggatcacttgagccgaggagttcaagaccagcctgggcagcatggcaaaatcctaactctgcaaaaactacaaaaatcagcttggtatagtggtgcatgcctgtagtcctagctactcaggaggctgaggcaggaggattttttgaggctgggaggtcaggactgtagtgaactgtgatcatgccatccagtccaggtgacagagcaagacctcatctcttaaaaaagacaaaaacaaaacaaaacaaaaaaacacctctcaggagcttgtttagttcctagaatgaattgaccactcccttgtacttcctctattccatattcagattttattgtaaaattgctttgttttacttgtgggtttttttgtttgtttttgagatgggctctcactctgtcaccctgcttgaagtgcagtggtaatcttggctcactgcatcctccacctccagggctcaaatgatcctccccctcagcctcccaagttgctgggactacagatgtgctccaccacgcctggctaatttttctgtatgtttggtagagacggtgttgctatgttgcccaggctagtcttgacctgagctcaagagatattctcacctcggcctcccaaagtttaggggttacaggcatgagccactgcgtctggctgttgcacttgtttatatttttgttacctgtgtcctattcaggtttgcattgtgcatcacacactatagtgttttattaatatggtatttaataaatgtgttgaattgaatacttattcttccaaagttaggatttaaagcccagaaaagtatctccattttatcccaaaataaaagtagttattaggctgatgatttggcattttattgttttaaagctctttttttttttgagctttagattgtatcctttttatttcctttttttttaattattatactttaagttttagggtacatgtgtacaatgtgcaggttggttacatatgtatacctgttgttttaaagctctttaagaaattgtgtgatagctaaatatacaattgtagtatttgtagtagtagtttgagttttctgaagtatgtaaccctgatgtattcattccttcatttgtttaaataaactttggcacattactagaaaaattgtattattgagatggaaacttacaaattacttatttgcagtctgagtttggtttagatatcagtagaattaacttcagaactcctattccatgttctcaactttgtcacttttttttttttgagatggagtctcactctgtcacccaggctggagtgcagtggtgcgatctcggatcactgcaacctctgcttcccgggtttaagtgattctccttcctcagcctcccgagtaggtgggattacaggtgcctgccaccacgtccggttaatttttgtatttttagtagagaaagggtttcaccatgttgaccaggctggtctcaaactcctgacctcaggtgatcctcccaccttggcctcccaaagtgctgggattacaagtgtgagccactgcacccacccagcctagggcttcctttttattacatcttttttgtagcatctgtttatactaatccaaaattcctggacaatataacctattatgtacaacttaagaaaattagtgtaatgccttacccatagtataaagagaaaattaatctatgataatgcataatttcaaaatgttaatgtccaggcatgagttcactgttaagatgaaaatgtttccaaggggggtagtaaagggtatttgatgataattgtctgtatatcccaactctgaaactttgacttttgagctcaaagtctgtatatccaactacaaatgaaacctatgtgcctgaataactcagtttgttatcttcccatccaatctgtttatctttctaaagtttctcttttagtgaatggtaccactcatttattcacccaagttggaatcttggaatcatcttaactcctttcttccttgccttctatatcaaataccaggtcttgttggtttttacctatttaatttctctggaatttgttttccatgccttagtttaggctttaatagtttttagtttgtattattgcaattgtctaatactggttttcctgcctctgccctctttttcttatgttttgctagagtgatttgtcactcttctgcttaaaattaccatttaggggttcattattgctctctggatgtaatattttctgtgagctagaaatcagtttcatttcttggacaaaaatcctttttaatggtgagtggctgcaacatcgcattaaggaagattctgaagtatctgcggggaagaatgcagtgataagggaatgacagcatgagtcctgctttggctagaccacaggatcctttacagtctgaacctgcctacattccagtaataatgaactgcttgtggtgtcctgcaacaggaactgttgttagtttgcttttggatactttttcacatggcgttttcttggtctggaatggcctttcctagccctattttcatattgtcctacaaaatatttcctgattctttgtttctcagacactccctgtccctaccaaaataatgactctcctgtctctctgctaatttatctaacagtcttttaatgtcttgattatactttactcttctacattaaagttgaattattttatttacatctgcaacatttagtatgaggatgccacctggaaaatacatgtttaatgtttattgaaaggttaaattgcataagggtttgtgttagactgatagcatatctactgagtagcgccccgccgccccccgcccaccaccaagtttctgatcctttttcttttctctcagaatcatcggactcaggtacatctgtgagtgagaacaggtgtcaccttgaaggtgggagtgatcaaaaggtaatctaagtaaatttctcattctaatgtaatattatttgcaaattggaaaggttatttacaacaagttagcttactggttatgttaagtttgttgtattttatttttttcctaaatgcttaggaccttgtacaagagcttcaggaagagaaaccttcatcttcacatttggtttctagaccatctacctcatctagaaggagagcaattagtgagacaggtatatatgaatatttatttgacgcattcacacagctttttgatattctttctctaatgaaattagtgcttttagacttaattaaattgttccctttttttggttgagatgaattaacctctgagtttttttcattcgtgattttatttgatttacaaattgcttatttagcaatatttttctggctgactacagcaggcacagtttactgtgccccactggagtttatagttagccaactctctgttaagatagtaggaggtggctggggtgtggtggctcacgcctggctcacgcctgtaatcccggcactttgggaggccgaggctggcggatcacgaggtcaggagttcgagaccagcctgaccaacgtggtgaaaccccatctctactaaaaaaaatacaaaaagtagctgggcctggtggcgcacacttgtaatccagctactcaggaggttgaggaaggagaatcacttcaacccgggaggtagaagttacagtgagccgaaattgcgccactgcactccagcctgggtaaccgtgtgagacttcgtctaaaaagaaagataataggagacaggcatataaactctattttcaccattattcttagtcaccttaacagttaaatttttaaattgttatttttaataaatggtagtacatacctatgagttttaaaacagaaagtaaatagcattttagaaatgaagagataagggccgggcgcagtggctcacgcctgtaatcccagcactttgggaggccgaggcgggtggatcatgaggtcaggagatcgagaccatcctgtctaacatggtgaaaccccatctctactaaaaatacaaaaaattagctggatgtggtggcgggtgcctgtagtcccagctactcgggaggctgaggcaggagaatggcatgaactggggaggcagagcttacagtgagccgagatcacgccactgcactccgcctgggcgacacagtgagactgtctaaaaaaaagagagagagagaaaatagttgacagagagaaaatagttgagaacagttagtagacgtagtagacgagaaggctgttgcctgaggaagtcgcagtaactaagaccgtatgattcagatgaaagagaatgtcagatcagtgaaacagaataaatgaacccagaccagaatctcgtacatgcgggcagaagacaggaagggcagaggtgtctagggcagaggtggaactagaacaaatggtagttacttggggaaaaggtgaagttagatctgtaccttatgccaaaatgaatttcaaatgagtttaaaagttaaatgaaaaatagaatacaacatatttgaaagatagtcactttaaatttgactgttaatatctgtattacataaaaagtcttcccaaatcaataaggaaaacattaaaacttcaaatagcaaaaagggcagacagttcacaaaaatttctcacagtaaatacgaatgactaataaatatggggagagggtgaattttggtgatttttagctttacagatagtaaaaaatgccaaaagggtgtccttttgatctatcaaattagtaaaaataaaatttttactcatccttactcatcagtgctaataacttgtgtattagcactgataaactgttggtctgtaaattggtaaaagtgggtaaaaattgattaaatttttcggattataaaaaagcttagatggcctggtgcggtggctcacacctgtaatcccagcactttggaaggccgaagcgggtggatctcttgaggttaagagttcgagaccaacctggccaacatggtgaaaccccatctctattaaaaatacaaaaattagccaggtgtggtggcaggcgcctgtaatcccagctacttgggaggctgaggcaggagaatcgcttgaacctgggatgtggaggttgcagtgaaccaaggtcgcaccactgcactccagcctggggtacagagtgagactccatctcaaaaaaaaaaaaaaaagaaaagaaaaaaaagtcttagagttcttaacattatcctagtaactccatttctagtaatctatcctaaggatgtaataaaaaattcaaagatttatatgtagagatactaattacagcattatttataattgcagcccggccaagatcacctttttaaaaatagggaacacaaacatgattaagaactcacgtgcagaacttgtgatctcgataaaacgtaaaaatcccggccaggtccagtggctcacgcctgtaatcccagcaccttgggaggccgaggagggaggatcacgaggtcaggagattgagaccatcctggctaacacggtgaaaccccgtctctactaaaaatacaaaaaaaattagccgggcacagtggtgggcacctgtagtcccagctattcaggaggctgaggcaggagaattgcttgaacccaggaggtggaggttgcagtgtgccgagattgtgccattatactccagcctgggggacaagagtgagactttgtctcaagaaaatgataaaaaaagtcctttcagaaatctgtgatactatctcattttaatttttgtcattctcatgggtgaaaaatgatatcatttcactttgcatttctttgatccctaggaggtaagagtttttttttctattactcaagtacatgactcaagatttttcatatgtttattagtcatttgtatttcttctgtgacttgctttttcctgtttccttaaaagaaaatacagtctatcttgatttggtaggactttgtataatatgtatactatgggtaatttttactatatatgttgcagatattatcttcgaatttgacctttgccttttaacttttgtttggtattttattttgtcatgtaaaccttgacatggtctaatcttgatagtctttttattgaggactttgcagtattatgaaatacttctccaccccagcattataagaatattttgttataggtacttgaatggttttgttctttatatttagatctttaatccacctggaattcatttttatgtctagtataaggtagtattctcatttatgtctaacggatttgtctaacattctgacccattcagagataatttattatttaaaatgaaatggaaactttttactggttttgatttctgtttaaaatatagggtactgaagagccgggcttagtggcttaggcctgtaatcccagcactttgggaggctgaggcaggaggatcacttaaggccaggagtttgagaccagtgtggccaacatggtgaaaccctgtctctaccaaaaatacaaaaattatccaggcatggtggtgtgcacctttaatcccagctacttggaagctgaagtcacaagaatcacttgaacctgggaggcagaggttgcaatgagctgagaatgtaccactgcactccagcctgggtggtcgagtgtgactctgtctcaaaagaaaaagtgtagggtactgaagaaattgaaacattaagaataccatatgagtaaattaaacactttggctcttttcggaaaaaaacagatgagctcttatattttaaagtttggttttgacagaaaaaaattcctagattttttggttaataaaaactttattagatagattaaattgtgatgtatggagataaagttctgaaagaagaatagaaagctttttaaaaatagtattctcagcctaggcaacatggtgaaaccctgtctatgcaaaaaatacaaaatggtgcattcctatggtaccgttcctatggtaccagctactcgggaggctgaggttgaggtgggaggatcacttgagcccatgaggcagaggttgcagtgagccgagattgtgcctctgtactccagcctgggtgacagagcaagaccctttctcagacaataaataaataaacaaataaataaatacacacagatagtgttctgctgtaacagttggacagattcaataaaacagtgttaacttttgaactaattttattgaaactaagtttctgtacaaataggtactcaaaacagctcaattttctaaatcacagtacagcaatttattttttttccttacatatccagaagaaaattcagatgaattatctggtgaacgacaaagaaaacgccacaaatctgatagtatttccctttcctttgatgaaagcctggctctgtgtgtaataagggagatatgttgtgaaagaagcagtagcagtgaatctacagggacgccatcgaatccggtaatgttctcattttaagtaaggcaagactcttactgttcaaagtctagtcctggcagtcctaataaggatacggatagaatgtacatgtgtcttacgagattgatagaaaacacagtgctaaattttactttaaaataaaactactatattgatctccaccttcaacccaaggtattgtgagaaatgtggaaaatagtggagtaacaccggtattggtaaaattagtagtagtattagtaattatcaatgtcactgtatgtattagagaatatttgtggaccactgcaccaatagtacagtcaaataaattggagtatagagttgtttgagaatttgagagttacactttttaaaaaaggaacaaaaccaaaaatttggttcagttaaatattttagcattttaaggcaaatttgactatttagagtaaaaatatattttattacagccatcagcaaaaaagtcagcatagtctgaacttaacatttgccaaataggtctagacatcaggtaagttctatttacttatgctgtaaaatacaggtttatactgggctgggtgcggtggctcatgcctgtaatcagtactttcggaggctgaggcgggtggatcacctgaggtcaggagttcaagaccagcatggccaacaagatgaaaccatgtctttactgaaaatacaaaaattagccaggcgtggtggcgcatgcttgcagtcccagctacttgggggcctgaggcaggagaatcgctcgaacccaggagttggaggttgcagtgagctgagattgtgccactgcactctagcctgggtgacagagcgagactccatctcaaaaaaaaaaaaaaaaaatgcaggtttattattgcatggatgacgggagagtatcagtactttctcattactaatacagacttccaaaatattagtgagcagcatttcttaagagatgtcactgaaagaagtttggtaaaaaatttttttgttaacaagaatgcttgacaaatggaatattttgttttgtatgtctttaatcaagcttgtccaacccatgccctgtgggccatatgccaggatggctttgaatgtggcccaacacaaattcataaactttcttaaaatattatgatttttttttttacaattttttttctgctcatcagctattgttagtgtattttatgtgtggcccaagacaattcttccaatgtcgcccacggaaaccaaaggattggatacattttttggtaatatggcagtgtctcatggccattattctgggtattagtaatcattgtatagtactctagaagatgtaggaagtggaaccaattgtgatagtaatcctagtcttttacctattcttgttacttcctgtattatctttttttctcttccaaagcagtgattgtatgaacgcatacctgccctctagagttactgtacctaacggagctgttacttatgtagaccgctagatggcatgatgagctcctgctcagtctgagagcaggttcttcatttgtagatatttaagtttataccaaattccatacagttgagatggcactgcagatacagtggtagtcaaggtagatatggttcttgccttcattgggagatagatcattaatgacaaaaatgaaaacatttaataaatccagtggaaaaaataggctcttgagcggaaatatatgtgataaaattgaatccaattaaaacttgatgagtatccaacctacaagtttggttaaaaagagaattattataccctatttatttatttattgagattgagtctctctgtctcccaggctggagtgcagtggtgcaatcttggctcactgcaacctccacctccccggttcaggcgattctcatgtctcagcctcctgagtagctgggattacaggctcccatcaccacacctggctaatttttgtatttttagtagagatggggtttcactatgttggccaggctggtcttgagctcctgacctcaagtgatctgcctgccttggcctcccaaagtgttgggattacagatgtgagccacctgcccggacccctatttaatgtatagtttttgttaaagttatatcagaattctagctgaatgatatttagagtccttgttcctgctttgtacctgggacactgccttgttactgatatggctttgaggagtagaggaacaccaggttttttgttttgagttgaattagataaaacgacacggacacacgtggagtggttttaaggagcagagcgtttaataggcaagaagggagaaggcagaaggaagaagctcccccttacacagacagagggaggggggctctaaagctgaaagaggagaccttacattctgacaatactagccagttttatgtgacggctggagggggtggtgtcttatttgcatagggctcagaggattggtttgaccaggcatgtcatttagccctcaagaaaactggccctcccaccccagtcctttaatacacaaatgcaggatgccatgacattttacacacggggttatgtgggggcggccatgctgttaggtacctgatggagcaagggcaagaggacaacggtgggaatcgccatgttgggtggaccctcttgcatttgcatcttaaaggttgccagcctttaagagccagggcttttatgctagacaagaaatttttctggagctacgaaaaaccttccaaggaccacttttcctctccatttgcctaaaataatttcttaataactcgtgtggagtagaggggtatttctttttttctttttgttagtcctgtcctgcattctcttaaaaaatcctatctataaaaaatctcagccgggcgtggtggctcatgcctgtaatcccagcactttggaaggcccaggcgggcggatcacctgaggtcaggagttcaggaccagcctcgccaacatgttgtgaaaacccatctctactaaaaataccaaaaattagctgggcatagtggcgggcacctgtaatctagctactcaggaggctgagacaggagaatcgcttgaacccgggaggcggaggttgcagtgagctgagatcacgccattgcactgcagcctgggcaacgagaacgaaattccatctcaaacaacaacaacaaaatctcgtttttcaggttaagtccctagttgtgaaagcttttggtagggccagtttttttttcttcttcgttttaatttccctcatttgagaatgttgtagtcatcattgggtgtcatcattcaccagtttgtgaagggagttaaaggaaagtgcattcctctcccatcttttctttctttggggtttaataaattgtgggaaactaagactgtgttctagactgtacaccatgcagtttatattatgatcttctgtcatctttgcagcctcagattccatttttagctaagactggggttttaaataacttgtttaaggttcctacaactaattgtcacaattggaattcaaacaattctaggtatttttgactacaaagatctaagatctttgcagagcaagcctatctgatgcttaaaaaaatatatattttttaaatttttgagacagtctctcactccgttgcccaggcgggagtgcagcgcatgatcatggcttactgcaacctcaacctcctgggttcaagcaatccttcctcctcagccttgagagttagctgggactacaggtgtgcaccaccacacctggctaattttttttactttttttttttcagagatgagatcttggcctgttgcccaggctggtctcaaaccgctgggcttatgtgattctcctgctttggctcccagagtattgggattacaggcatgagccaccacctccagcctgatgctttttaaatatatagtatttaggtctggtgcagtggctcatgcttgtaatcccagcactttgggaggctgaggcgggcggatcacaaggtcaggagatcgagaccatcctggctaacacggcgaaaccccgtctctactaaaaatacaaaaaattagccgggcgtggtggcgggcacctatagtcccagccactggggaggctgaggcaggagaatggcgtgaacccaggaggtggagcttgcagtgagccgagatggtgccactgcactccagcctgggtgacagagcgagactctgtctccaaaaaaaaaaaaaaaaaaaaaaaatatatatatatatatatttatatttaaataatgtataaatatataatatataattataaatctattatatattaatgtatattatatattacattgttatatatatttatataattatatatttatataaatataaatatatatatttatataaatataaaaatataattatataaatataaaaatatatatttatgtaaatataaatgggcaggcacctgtatatattatatatattactatttatataaatataaatatatattttaaatatttattttatatattttaaaaatatatatatagagagataatttaatagtttctggggcattcttttgcgaacattagccaaaactttaaaaaccactcccaatattgcattttttcatggtattttttatagtatttttatagtatcctaggacaggagttggcaaactttctgtaaagagccacatagttaattatttgggctctgccgggccatggtttctgtcacagctactcagccccgctcttgtaatgcaggagcaactgtagacaacaagtcaacaaataggcatggctgtgttcaataaaactttatttataaaagtcgatgggtgatgggccacagtttgcagacccctaccgtagagtatgttttctgagatttaatgtttcttgtgatttacccccttattctaaaattagtgcactaaagactttagttagttgaagtatttggtttgttgggttactttgttagtgttaattgtatcctaacttgacttgtgattctaatctgattggtagtagagcccttgttaggaatttgagctgcaacttgatgaatgttgcttttactctccttcctaacattactctaaaaaagtcttttgatgtcagaggctgtaaaataatatactttgtttctgtttttaaaactgatacagatatggaaatcatttaatctaagctccttttctagatgaagtagctacagcctttagaagttaaatgatatgggctgggcgaggtggctcacaggtgtaatcccagcattttgggaggccgaggtggcggatcactagaggtcaggatttcgagaccagcccagccaacatgacgaaaccccgtctccactaaaaacataaaaattagccgggtgtggtagtggacacctgtaatctcagctacttgggaggctgaggcaggagaatagcttgaaccccggaggcggaggttgcagtgagctgagatcatgccactgcatttcatcttgggtgacagagcaagactcttgtctcaaaaaaaaaaagggccgggcatggtggctcacacctgtaatcctaacactttgggaggccaaggcggttgaattgcttgaggtcaggagttcaagaccagcctggccaacatggtgaagccctgcctctactaaaaatacaaaaattagccaggcatggtggcatgcgcctgtagtcccagctacttgggaggctgaggcaggagaattgcttgaacttgggaggtgtaggttgcagtgagctgagatcaggccactgcactccagcctgggtgatggagcaagattccatctcaaaataaataaaataagttaaatgatgttgtttaaggttaaattagctacttagtggcaagtgtagaataagccatatcccgacttctagactttttccaattgtagccttctgcttatatatgctcctacccttagccactgacagcaaatattattgccctgaaggtcttactaggttcttatacaatttattgaagtcctgaaacgaagaatcagatgagcagctacagaattttttttaattgtctaaaggctctttaaaagaaaatctcaaagtttattaaaaaacataagtatctatgactcgagacatttttctaagaaaaaaaacccataagtattacaagtgttgtgtcttgttacgtgtattctaccaatttggacatagaaagatgagtgacaggttttagctcaaagtatatataattcagatgagaaacatgcctgcaaaattatgttttgcataatttatgtgtgagactatataattcattattatacaagtagtaaggataattaaaggtggaagagccttttcagttatggtattgacaaaggcttagtcaaagaaggatgaataggattttgaaactgaaattattctagttagagggggaaagtgtggaagttgaaatgccaagattagttgaggaagcaatctagatctggcgggattatccatatttagtaagggaggaggggtgtctagttgaagacagacgaagatgttaatacagtcacactgtaggtactttcgatgccaagaggctttggtgtttttcctttatgcagtggggttttgaacagggaaaataatgtagtaataaccttgaaaccttaatctagtttcagtatgcaggatggatctgaggaggaaatgtgcgtggcaaccggctccgggatggctggctggggggcctagtcttctgcccgccgatctccctcgggaagtcccggatcagagcagcaggcccatcccccaactgttacaccctgctggcagcagcagaggcacagggatgagttaggaaacagatacagaggtcaagaggtgatgtttattaagttatatatttttttcttgttttaggatcttgatgctggtgtaagtgaacattcaggtgattggttggatcaggattcagtttcagatcagtttagtgtagaatttgaagttgaatctctcgactcagaagattatagccttagtgaagaaggacaagaactctcagatgaagatgatgaggtagtattttttttcccctctaattatattggaaaattattaaatattttctatgttcattgactttgagattgaaataatattattcagatttcacttgaaatctttacctcttgatttgtttaaactaacacattggtttgtggacttgaggatttcatagttctttatcatctgatttatattattatattactactaattgccaagaagtcaatagacctcaatgaacatgcttattataatggtctgttcacttttaaaaacatataattcaactactgttttaatattaacttactttctataaaagtaaaacatgcatacagttaaagtcaagtagtacccttagagatctgtttcccagaagtgactgcctttaacatttctagctatttccctattatttaatatctccatattatttatttatgaagtaaaaccacctagctgaatgttttgttttattcatcctaaacatcctttgtattgacttttaccattgtgggtaaggatttctctctcctccattttttccccctttacactcacttactctatttgatattgtctaaggctttctcatatattgtagtacatgatatttgtttaggacttattactaggaagccttctgattgaaggaaatagggcgatgaattgatgctaatgaatgtgttttattaggtatatcaagttactgtgtatcaggcaggggagagtgatacagattcatttgaagaagatcctgaaatttccttagctgtaagtatacatctacttttttaagaaataaaaatttcattaaggtcaagattaggagactatatctagcttctttctgaaatgaactgatttttataaagttaaaatgtttttgtaaagtctgaataatttaaagcatttttcttttatttgttgtgatgagacctgtagctataatttttatttttaggtgctggaatttgaacttttttttttttttttttaaacagggtcttacccttctcccaagctggagtgcagtggtgcaatctcagtgcactgcagcctccacctcccaggttcaagtgattctcgtgcctcagtctcctgagtagctggaattacaggcatgcaccactataccccactaatttttttatttttagtagagatggggtttcaccatgttggccaggctggtcatgaactcctgacctcaagtgatctgcccaccttggtctctcaaagtgctgggattacaagcatgagtcactgcccagctgaatttgtacattttgatgttattttggaaaatttcagtgtatctccagtatactcatcacccagctttaactattaccaacattttgccaaccttgtcaaacgtaaacttttttttttttcaattgagatagggtcctgccctgtcttccaggctggagtgcagtgatgtgatcatggctcactgcagcccccacctcccaggctcaagtgatcctcccacctcagcctcctgagtagctggaataacaggtgcatgccatcacaccccagctaatttttgtattttttgtagaaatgtcaccatgttgcccaggatggtcttgaactcctgggctcaagtgatccacctgcctcagtctcccaaagtgcaaggattacaggtgtgagccatcacacccagccaaatgtaaacatttttattactgatttgtattatagaatgtggtaggatttgccattaaagaaattaacacttaaatgtttacatctcatgcatacttcactgagttcctgaggtattataggtttttttaaaactattgtgctttagtttttgttcttaatattgcctttattatatttgaataggaaataaattccattttttctgagttatagacagttactaattattcaagtgcaaaaaaggatgaaaattcaagagtttccaaaatttttactgtattagaaaataaataactaattgaatcatttgatgtcaagttgagtaaaatattttagatacttttaattttttaaatctattttaagactcaaattattttagatattcatcttggaatttattggactttttgatgcacttttactcccatattgcaagacctttttctttggttttatgagctgtgaaaaacccccttctataacttgaaaaaagaagaatgaatagtctatctttattgctcctgtcttaacatcatttgtgaggcaatctcaaaatggttacggaaatacctcttacttaagagttttcacttgttaaatgtcctcaggcaagaaccatgcttcagctaaggcaagaagataggttatgtaaaaaggctggggatgtgggagagtttgttatccaaattgcatggtggaaaggtttgtgggataaaacgttgggaaaaggaagaagcattgagcagttacaaagatgagaacacaggaaaggatagacaggtaaaggaaaggatattacggttagtgaccaaggatgataggttttagcagcaatacttgctgtgaaaaatgttttagcatttctcttgtggatggagttagggaatactcagttaagccatggttttagagtacttctaaggtagttctagtcactggtggattaggaagtctttctcgaggaggcaggtttcatctagattgatgggatggactcttggaatagcgcctagggttgagcctttaagggagtggatataggctgcatgacagagtaaaagatcccatagacttgcttcaactaaaggaagcaactgcatttgtatcctgaaacagataactttataggtacatgattaatatcacatcacagttaatatatttttagtttagaatttttcaggatggtaagggtgaaaaaaatgggtgtacttactctactttaggagagactgttacatattgacctttaaaaatctgttttgtgtataattgagacatataacgtgatgttttgacacacatgtaaatagtgaaatgatcactacagtcaagcaaattaatgtaatccattatcttgaatagttaacctttcttgtgtgtatggttaaaatacctaaaatctattcttttagtaaatttccagtataccaatatataactaactatagtcctcatgctgtttacagtgactattttatataaaacatgaaacactgaatattgagccctatgatatactttaccttagacatagcaaagttgctagcattcctgtgactgagcagttaaagggttacagaaactgactgtgtgtcttatttcattgaaggactattggaaatgcacttcatgcaatgaaatgaatcccccccttccatcacattgcaacagatgttgggcccttcgtgagaattggcttcctgaagataaagggaaagataaaggggaaatctctgagaaagccaaactggaaaactcaacacaagctgaagagggctttgatgttcctgattgtaaaaaaactatagtgaatgattccagagagtcatgtgttgaggaaaatgatgataaaattacacaagcttcacaatcacaagaaagtgaagactattctcagccatcaacttctagtagcattatttatagcagccaagaagatgtgaaagagtttgaaagggaagaaacccaagacaaagaagagagtgtggaatctagtttgccccttaatgccattgaaccttgtgtgatttgtcaaggtcgacctaaaaatggttgcattgtccatggcaaaacaggacatcttatggcctgctttacatgtgcaaagaagctaaagaaaaggaataagccctgcccagtatgtagacaaccaattcaaatgattgtgctaacttatttcccctagttgacctgtctataagagaattatatatttctaactatataaccctaggaatttagacaacctgaaatttattcacatatatcaaagtgagaaaatgcctcaattcacatagatttcttctctttagtataattgacctactttggtagtggaatagtgaatacttactataatttgacttgaatatgtagctcatcctttacaccaactcctaattttaaataatttctactctgtcttaaatgagaagtacttggtttttttttttcttaaatatgtatatgacatttaaatgtaacttattattttttttgagaccgagtcttgctctgttacccaggctggagtgcagtggcgtgatcttggctcactgcaagctctgcctcccgggttcgcaccattctcctgcctcagcctcccaattagcttggcctacagtcatctgccaccacacctggctaattttttgtacttttagtagagacagggtttcaccgtgttagccaggatggtctcgatctcctgacctcgtgatccgcccacctcggcctcccaaagtgctgggattacaggcatgagccaccgcgtccggcctaaatgtcacttagtacctttgatataaagagaaaatgtgtgaaagatttagttttttgtttttttgtttgtttgtttgtttgtttgttttgagatgagtctctctgtcgcccaggctggagtgcagtgtcatgatctagcagtctccgcttcccgggttcaagccattctcctggctcagcctctggagcagctgggattacaggcatgcaccaccatgcccagctaatttttgtatttttagtagagatagggtttcaccatgttggccaggctggtcacgaactcctgacctcaagtgaggtcacccgcctcggcctcccgaagtgctgggattgcagatgtgagccaccatgtccagccaagaattagtatttaaattttagatactcttttttttttttttttttttttttttgagacagagtcttgctccatcacccatgctagagtgcagtggagtgatctcggctcactgcaacttccgccttctgggttcaagctattctcctgcctcagccttccaagtaactgggattacaggcatgtaccaccataccagctgatttttttgtatttttagtaaagacagggtttcaccatgttagccaggctgatcttgaactcctaaactcaagtgatctactcacctcagcctcccaaaatgctgggattacagatgtgaggcacctggcctcagatttttgatactcttaaaccttctgatccttagtttctctctccaaaatactctttctaggttaaaaaaaaaaaggctcttatatttggtgctatgtaaatgaaaatgttttttaggttttcttgatttaacaatagagacagggtctccctgtgttgcccaggctggtctcgaactcctgggctcaagagatcctcctgtcttggcctcgcaaagtgctaagtaggattacaggcgttagccaccacacccggctgtaaaaatgtacttattctccagcctcttttgtataaaccatagtaagggatgggagtaatgatgttatctgtgaaaatagccaccatttacccgtaagacaaaacttgttaaagcctcctgagtctaacctagattacatcaggccctttttcacacacaaaaaaatcctttatgggatttaatggaatctgttgtttccccctaagttgaaaaacaactctaagacactttaaagtaccttcttggcctgggttacatggttcccagcctaggtttcagacttttgcttaaggccagttttagaaacccgtgaattcagaaaagttaattcagaaatttgataaacagaattgttatttaaaaactaactggaaagattgttaagttctttctgaattattcagaaattatgcatcattttccttcaagaatgacagggtcagcatgtggaattccaagatacctcttgacttcctctcaagctccgtgtttggtcagtggaggcccatccgagctcagcactgagaagtgttagtttctttgggacccatctaccctgaccacatcatgatgttcatctgcagctgttgcaaggtgttcagattgtataaacataaatgtcacaaaaactttaaaagaagtgcaattctcaaaaggttaggtggactaaagcattctgtaaagcaactgctaataatgagcttacagtggatttgaatttgaaaaatatagtaacaagcctgtcaaatatctgcaagaactatggaataaaactactgatgcagtgaagacagttgaaaagatcaaacaaatgccaagctatatttataatgaacaaattcaagaaaaaggactacggaaagttcaggacatcaaagaagtcaggcaaaactcatcttgacccctgttgcaggcaaaggaacgcagctggaagaaaagatgatataacagttaacaggatgcagacatggcagaggtttcctaaaaatctcattatctataaccatttctatatttacatttgaaaatctcc

SEQ ID NO: 12997 - DNA, 36242 bp, Human; identical to SEQ ID NO: 12996

SEQ ID NO: 12998 - DNA, 36242 bp, Human; identical to SEQ ID NO: 12996

SEQ ID NO: 12999 - DNA, 36242 bp, Human; identical to SEQ ID NO: 12996

SEQ ID NO: 13000 - DNA, 36242 bp, Human; identical to SEQ ID NO: 12996

SEQ ID NO: 13001 - DNA, 136265 bp, Human
  misc_feature (1)...(136265): n = A,T,C or G
tcgtgctaggtagctattaaccacccccaccccactccccccccccgcaaaaaaaaatacaaaatacaaagacgtatacctctgggagtgtggatgtggcaacccatgtggtggcttgtccctcctttgagtgcaattgccagtgactcttgcattcaaagtcttgctttaggcacacattcaaagcacagttcaaagcagtttatcttaatatagtgttggatcagggtattatttgtttcagatttcatcagactggaaacaggagggtgtaacatatttaacaatattaaagcttaaaaattggtgtgaggcagctctctggtcctcttaacacctccacctttacctttccgaagaatcctaaatgctgtgaggctagaagtttatttgtgctctgaggttctcaagcactttcactctttaggaaaaaaaaaaaagtctcacagttatttaagaaattgagcctgaaccatccgaggataggagatttcttccttttccgataaatgcctgtgctcagcatcctcaaatttggctgtctttatttacttctatattagttccaattatgtgcagtgtaaaccagctttttgattaacaaaacagcagagcattggttaagaacacttaaacttcaaaaaaattcccctgggaagtgggctctgaattggttaataatgtgcagtacttgctaaattgctgacttccagatgtggaaaatatctttcttgtttaggacctatgtaacctgattggattacgacagaagcgtcacgttggaagcttttgagtgattatttaattaaccatacagtagaaagctgtattctccaggaaatcccttccatatttgcataaccaatcccttcagagcaaaggtggagtcttttctttttaatcttactttaattgtaatatcaaaaaatatatactccaaaacttagaccccatgccgtttaatatcatgctctcccttccctgctaagtttctctatggcctttctcgtttctcctcctgcctccctacacactctcccttactttgtagtgaggtctccccgaggtgtagagagattcagagatcggccaaccgagtgttctattttaatttacttagagaccctttattaaaatgccaaactactttttaatattgggatccagtccagaaattcatcatgcacacaccctaatacacatgccctaagatgcagctcccatgcagcatttttttttctggctctggtacctaaaaagaaaaaaataacaataagagaaagggcagagaactttgttccagaagctgtactgagatacctacacaatttgatgtgcatctcaaatctggtcattagagatatctgtataagaagagactatctggattgaggacccgggatctttccctttaactttcgccccttggagttctccagttctgtgaatggtgtgcaccgttttccgccctgtactctgtaggatttagtgatgaggataatgatgccaaaggcttgacgggctgcccattcattagggcatctgattaacatagtaaggaatgtttattttcagtacataaaattgtagaactttgggagcatcgtctgaattgtcagagctgaacagcgaggagcttagtgagacatgagaatatagagaggtagctaatgtgtgggaagctgagctagttgatattctatgagaagttcgtcgtgtccatctcatgctgtaggtgtagggaaagttgttcaggtgctgctcactagtcctttgagatgcaggtgccagtggtctgatctctagttgatgatgagagagcatctactttcacatactgagtgtcttgaagtgatnnnnnnnnnnnnnnnnnnnngaggcgaaggcgaaagggagggagaggaggaagggagggaggtggaatttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcaggtaggttttttttcctccccttttctctctttttatccctttttggtgtgctcgtcctccatcctccttttctaattttctcattttgagtggggatgtgagtctgaagtgagaaggggtgtccgtgggtaggaatttcaggtgggtttagctcctttatggcaagcttttctcaagagtggcttcttcgctttctcttacactcacactctctctccttgcttttctctcctttttccctcccccaaataatttcccctgtacctgttcattcaggtaaccaaaggtgtcctttgctatccagcccaggaaaagttttattgagaattatatggctggaataaaaactcatcaaggggagaggtcctgctctattttcgcatctagttccaattcattatattcagcaattaggacttggcaaatacctgttaataattacaaaacttggtcagttacagacctacaaattcgggggcaagtctttctcttagacatggcagttcatcctctcccaccgagaaggctgttttctaagcagaaagttgtctgtttttgtctgcttagcgagtttcatttctttatttcattctttgtgtgtgtatgtgtgtgaagtaacacctcacttctgtgattataaataaagaagtgaaagtcctcatggaacttgagtcgtttaccaaagtggaggggggggcactacagctgggaagaaaactgctgtcaggatatcagggttttaaattaggataacttttaaaattgtatttttagtggcaaagtaatatagacatggatttaatagaagacacatacacacatatatcccattccatactttggcactgaaaagtcgagagagagatagcaggagttcccaggaacagtgatgagcccggctaacatgaatgtgtttatctcccacctactgatatattttacatgctccccctgtaatgatgaaggcaagattactaactccagacttaggagtaacaggcaaagataaagtttacagcacaaatgccctgtctctctctctcacacacacacatgcccataaaactagcaacttactttattaaacatgtatttatatgcagtcgtgtgtctcaggatgaatatagacaggccagctgtttcatcccagacacttgtgtgaccatttctttatttcaggatttcccctaacaatttcaaatcaataggacaaggaaagaaatgataaaatatgtcaaacttaaaagtctcctactatgtatgcctaggtaaatttaaggtgctttctaaaatatccacttccccttctctctgcccccctcccttcacccctctcagcaaatgtgtggaaactgatactcactttccaggttttctgcaaagcttctagcacaggagacaataggtgtggggcgtggggactgagtgtgcccggcagagaaagggttaatggcccttgtgttacagtttgcatctgttacatcttttatagccccctgtttaaactaatcctcgaggcacagcatcttcccaacctccaccgagttttcaggattctcctcctctcctgcctgcctccgaggtcccccttctccaagttttgacagtttcaactgaaaaaatgcagcgcctctctcgatttttaggtacaaaagtttcgaagccagaaaggatacgatcatttagtagagcttaaaagtattgccgtagtggttggactttctctttcctttcttaagggaaaaaaaaaattctactggaactatttaagggaaccagtgtgggggagcatgtgtgtgagtgaggtggggggaaatacttaagtaaatattgtcaaagtggcgagggggggtggggtaaaggacagtgtccaaagaggcttataattatatttatcattgcggcgtaaaacgggaaatcttaatttgggggcgagggtggggggaggaagagacagtgcctcgataaactccaaaaggggaggggagggggcgctgggcgagtgggcttcctataattactattatcaatttgcccgagtgtgcttcatccaggggctgtttcgcgttgtttgtttgtttgtttcctctgggaattggggggtggggggatgagaaaagatgagaacgaaaagaaaacctcgcctcaccccaagttcccgagccgggggctgaggacttttcgaaggaaagggtccgcctagccctgagtcaagcggtcttactgtaccgccgtgtgcattccctcatacggtcaggagttatgactcattttgaagatgtaattcttgtctctctgatcccctcgcgggtgcaacacaccaaacagtaacaaacacaaagcgcctcggggccaaggctgggggtggggggcgggaagagcggcggccgaagtttcgctttggggttggggggcgcggagaggtgctcgccggggcggtggcgtgggccctgggcggcccgcgcgcgtttcaatgggcgcgcgatgcccacattgtcgctgtgtttggttgctagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacggtaagaagcagcccgaaccaaacttttccgggccactacgcggctcgagacccagggagaaggagggggaaagggaaaaggaaccgaggcggcggcggcggcggcgcccagggctctagggcgagcctccctccgcggccggcgccggagcccggcgcgcgcggcggctggaccggggggtgttggggaagtgccgggcaaagtgagcgtcaggcacccgggggtccgagcgcgggggtccggccggggccccgcgcccccagccccgctgcccccctcgagcccctgcctccgccctccctccgcctccgcctcccgctccgctcgcgcccggcccgccgggtctccggccgggcttcgggagcgtccgcctggggcagggcgggggcccaggcgctggatcgcgcaggatcccggggcgggggcgggggtggcagagagactgcgaaggcaggagaggggaaccgggtctgcgcctcagcgaggcttaaagtttcttgccggagtcgcccggccgcttctcggtgcgccaagtaacggtccgcgggcagcggggcccggcccatcgcgcccagaccccggggtgggagggagtcggccggccccgcgcggggtccggtggggtcgatgatggctcggggacggatgactcctctccagcaggctctggcccccaggccggggactgaaggagtcgcagggcgcagcgagacttttcccggcagtttctacatggtctggaggagcccgttatccaggctgagtcaggaaggaggaaggagaaaggagatgggggttcgaggggcacacgcagatcagaggtgggatattaaagggggggggtgagagtttggtaggtccgttttggagacagccagagaagggacgcggggggacagagagaaacagagagagaggaagagagtgagagagagaccccctaggtattaccccaaacaaaatcgtgggaataaaagagaaaagtgattggcaagagcgcggaaggcgcctgggggaggggagagggctggggactagcgagggtgccgggggggggtgggggagctgacggaggataactgagtttaaaaagaaagaaaccaacccccgaaaacaaacaagcgaacgagcgccagcccagactcggaaaggaaacttctcgctcccctcgctctcagcccgatcacccggcgcggggccgcgtagacgctcccgaggcaggcgctgggacgcagcgcccacccggcctcccggcctccgcagccccagcccgcgcctcgcggggaccgcccgggcccacttggagcaactttcctctagagaagacaattgtgcgcgcccccggcctgccccagagctgcgcggcgcggggagggggcggctgggggcgcagtgtgaggtgctggaaggagcaaaacacaaagacgagagaattttgattagagacaaatgatgcttttctctctctctctctctctctctctaggttttgtgtgtgtgtacgcgtgtgtgtgcgtgtgtgtgtcttttgcttgttgtggtggaggtgtcgagccatatgggggagtgatagaggaattttagtcagaaactgttcgttacgttatcctgcctttcccctttgtgctgtctttgatctatttgcttggcttagtattacagaaaaacaagtacaataatatattccgagctgcttccccaagattcagttcaggctgcttctttttaagtctctccctctctctttctccctctctctctctcttaatttaatttttttttcactctggtgtctggcattatttaaggtggtccttacacaggagacctccccttccccatctctgagtaatttagtagacactaaaattacacctaatgtccccctctcctctcttgtgtttcctctgttccttttattaaatgttggttattgattttctaaaatcaatgtctgttgtggggcttttttccccctcttacaagtatctaaagcacgttgctgatcaactggataacaaaagctttgtgtcaaggaggcttttttccctcttctgttaaacagtcattttttttttttgagagaaaaagagaatgagatttaaaacaaggctcccagaagtgttcttttgcagggaagactatttaaagtgtgcatttcttcttgccttcctccttccacctccttcgggattttgccaccgttgaccagcctggccctagcagtgaggtcaggccagagcccaggtctaaggaaatagagggatcctggcttcctgggaacccctaggagacctggcagagagggaggcccgttgggcgcttcgcaggtggaatggagtgccagagatgtccgcagtcatggacactgcaagtatttcccctccacccagccactaacttgggagaagcctccacattcagaagtggaaagttgaattgcacattttaaggcatttagcccagatcctgcacacttaatatcaagcctgtccattgcttacagcttctctaactttgactgttacctgtctttttttccaaataagctgtgggaaaacatgctgtatactggttattgtaagtgtttttcactgggtttaatctgaccgagcaatgttctggttttgagaagcaggtagaagagtactaccaccccacccctttttcattttctttctcatcaaacacatatccaatgcctttccctttgggaattgctaggatttatctgaactgagtggatttttcttctttcctggattcatggaaaagatgtcacttttgagcttgtgtctttgctgataacactaaatatgatgatgcttatcaaaatcatatagaaattcctggaaagaaataatggcaataataatcgtataagtagaagctggaagggaaaaaaagatggtcatccaggaacctagaatggcactttatataattttaatgaagtcaacagtgtatatatagactaaggcgacaaggagataaaacgtgtaaagcagtgtgtgtgttttaaaggctggtcaagaacgtgagttagaagacaatgctatgtacatttaataaaaagcaaaggagaaggaggcagttgaagaaaaataaatgtacaaagagagaaacaagtatctgaaatacaaccttccagattctcaggctagcaagatgcctggcagaggcagtgccagggccaagttaacccatagcgggcagtcagtctcctttcccccacatggaaaggatgaaatctcttcccagaaaataagatgtgcaggaggaaagagggagtggggtgagggggaaggaggcaaaaagcgagttgcccgcagacaagaatgtgtgtcggtttcaagaaagttcagtcagatgatcctcagtcgcctgactcactttgtaacactttcactgacgctggagaggagggggaaaacccagcccccctttttctttcccctgattataccccactatctccacacagccttggagtcagaaatgagcactcggagcgggagatgccctgctgctgcttgccaccggtgcggcccgtttgtaacttgcaaagtttgttgcttttgcccctgattcgggcagcgggtcctgggatgctcctgcttccctcctgcctcccacggagcccgggaagagggtctgcctccccatcccgccaccttccagcatcagcctctgaaaaatctcacagagacatgcacgttgtagcaaaaatcaaatccggaaactgcttgtttcagagaaagaaatgaagttgtcttttaaagaaaaactgaattaggaggagagaaaagggaaataggagaagaaaggaaaagttaaatttgatttttctccagagtttccactaaagggttggggacagtgtgaaggagaaggggagctttttacaaatgcctttggtctctgaacttcagtggcaaagaacagggatcaagttgaatgttctcagggctttggatcctagaggagaaacaatcagaagagcagaaatggttatccctgtttaaaataagccctcactctttaccacttccttaaaggagtggaggtgctggtagtgatggttagaggcaatgagggacggagaagttgctcccgtttcagagatgcttaaatgaaaaggaaagaaaatgcagtcaaccccttctccaggaggtgcctcctagctctcctccctgagaggtgaagttgggatggggcaacgagagtcatacacacttagacaaggaagtttccttcggatcactgtcagtccagacttggttatctttgcaaagtgtggaaatctttggcaagtagctttcttcgtaaagttgatgagcttctagggagcctgttttgctgactttcaaagcactggggcaggttgtgtggcaggtaccagttctgagggcgctccaaagatatccatctccatccttttttctctgtggagatcttctgcaagttttgtcacgctgcacacacacaaggctgggggctatgtatctaggctgatctatttgttttattttggtctggaaaaactaagccaattggggtagaaacatgctttccttcgtagcagagccagtaggctgctggtgtccatagagtgacagtccaccaggactaagggtgggctgaggattttaaactttacattgtttctctgttaccagatacaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgtctaccctgaaggtaggaaaggagggcgttgctagcctctagcagtgccgcgtttattctaagatgtgggagattcttttccttgcaacagtttttgtcatctgcattcttccaaggcttttaaggtgcattttcttctgtgtgaaaggaaattctttgtccttttcctctcagcaccgtggcttcccaaggtagacactattttgtgcctgtcacagagagagggagtgcaggtttgcaatgctcacagacaattgattgtctgccctaatgtgtttcatttacatgtttataacgtcaatggtgctggggtgtccactgtaccattcattcccgcattcccacaagggggcaattgtctgaatggccaagtcagacacctttttgattgctctttggttgtcttttcagagcaaagagataaaggaggaaaatctgtgatgcagaaacactagttgaaaatatacagaattaaatgtcaccacaaaagcagatgttaacataagcccaaatatgctttttagccaagatgtgaaggttgaaaaaaataattcagagcagagggaaggatgatttaaaccaataaatatagccctattccccctctttacttcttttctgtctttagcaatcagaagatgaaatgtaattttccttttcatttttaagccttgaaacatccaggcacctcctcattatttgtatgtttgctgtgatttgtgaattttgtatatatttacatagctctgtttatgccaacagcatcagcttaccacttggaaaatctattgaatgactatttgggctgtggggagggtaaacttttaaaaagtaagatccaagtatttcttcatcaagcagtttttaaaaggaaaacgataataatcagtaggctccatggaagcctttgccttaatagctatgtgccaaatacttttatcttgtgtgacagtcatgtcagagtgaaatctctcaggaaaagtgtaactagtagttacaaagtaaataaaggatttcattttaaggtgttctgtagtgtttttatgctgtgtatgtgcatgtgtgtgttttgtcttgtgtttcctctgaggaggtaagaagaaaagccatccatgcgtgtatcttttggcttttctcttctttccgttctctcctacatattatgcatatatgtagcccacatgaatacacctgtttaaaagaaaatcacagttcagatggtgccttgctggttcatttaggaaacaacagttattagaagttggtctgatttcgcgtgtggtccatgaagacagaaaataccaactcttgtgtcatctggtgggaggcaaatgggggaaaaacttttataattttgtagtaaattagagaggggaaaaaaactgccagtctgtgaaaagatttttgcctctccgggaagacacacacacacccagtagctgcaccgttagctgaacccctgacacggcggtcttttgaatgccttaggtatgatttcactttcgctcacatcaatgctgacctgaatgcctttcatatctgatccgctgtgtctctcccagtaaacatcccctgaggggagaacaaagaaaggagctcttcttcttcttaatcacaattcagccctttcaccgccggcaggctccatttgcattctgccacagaaagccaagatgaaaagaaagagagagagaaagagagagagagagagagagagagagaggcacagggtagtagctgagtaaaataacttaggtgtttgtggctgtttgttgggcttcccctagttaccagccttatatagctgatgctccaccaggccctgtccctcctgacaggcatatagtgttacaagatggcatgtctgtactattcatggccacccgctcaacacttgaggtaaaaagtgtcaggaggggatcgaattctcccccagaagcctgttagatttggggtcaggtgtgtggacttcccgcccttaagtgctgcctacgatttggctttaataagtctgattgtttaccagcggaccagagaggtgagggccctgggggtgggagggacgggcgagctggagactgggcccctggtctggtttcagtgacgggtcctcacacccagcctgaacacactgataaatcctcaggaaaactggaaaagactttcccatttttccccctgactttttatgataattcatattttcaaatgaaaggggaaaaaagccaagaagaaactctcaaatgagccaaaaaggaaaaaaaaaattctctgaaaagaattttagggggaaaagttgtgctattttaaaaagctttgagggctgtaaagtgccacgtttttcacaccttctccatacttttttttcagatttttttagtatgtttaacatttgtgagatgacagcctttttgtatctcaaactggatgcttcaggatttgtaggggaggggttggtggtattcacgttctcttgtgagagaaagtttgtgcctaaaggcctccttcctgggaactgtttaaaccctcgcaggcagacctgtcaggttttactgtgttatttgccaccattttcaacatgcaaaagtaacatgcagttaatggtattggaatgagaccacagcaagagcagaaacctctcgtgacaacttttcagcgacattatcttgctcctagactgtcttgtctttttcttcccctttctgaaaccacttttgagataccaataattttctcccaacaattagattaaggatacaatgcgctcacacacatgcaccacacacacacacattcacacacacaaacacacacacaaactttggaagtgcaatctcttccaacagcagagtgaatgatttgaaacgggggcttttccaataacccttgtggaagatttcacttataagagcaaaactaacggatatattagaagttgtgcgaacatgtgacacagattcctgatttttttttctttttcccagaagatttacagaatttacaaaaagagattatccctacaccttccacccctcctatccacccccatgacccaagcaatgaaggatttaggcagatttacttcagtaaacacctttggacacttgcggggaaagtgggagtctgtttgcaaaaggaggcttttgttaagtgaggtacggggataatgctttaccaggcagctgtgatattaacctacccagcaatgcgggaacactctttaactctttgagtgcctggccccttgcgctcagcagataaaatcctggctctccaaagacactcagaattctggctctagcagtttattattcagacaagtcttataggcatgaaaactgttcaagcttttaaaacaatgtggtttaattagatgaggtggacttacattgctcataagccctccaaatggtggtttataattggcaagggaaaaaaaaaagatagaaaaaaggaatcaaggcagcacattaaaaattccaggaaatatctttagaaaagctattttcatttctagcttttaaaatattagactacggtagctagagggaatgaagcagctggggcctctctccttcctataaaagacaccagaagtttgtgatgaagaaaggggcttcaacttgaaaagctatgagaggccagttcggacagtgatatgatctcagccttcgcatcttttcaagggggaagtactgcctatctgtccaaacctgggaggtcatgtgaacctcagagtcagggcctcaggctggccgttaccaacttgagactttccaaagcaagcagagaggcatttatgaggaaggagttaatggttattttttgctgggcacaagaataactttacaggtgttgcatttgggcttaaataagattgccttatttagtttcgaaaaagagtgtaggtgtcaacattcgagcagccacaaatgtgtgagaaagtaaagggtatgagacatgacggaattaaaggtgtttgctatgttgttacaccgtgtgtcaggctgcaagctccctttgtcacagcctcctggtgatttgacagcgcagatctacttcccttctaggtgagacagcatttttaaacttgagttataaatatggtacacccttcgagttgcaccctgcctcccagatccgtgaatcctatttgaaagcatcttgccctgagacacaatgaacaaacgcccgtatacaaggaggctgtgggctcgggggcccgggcagcgccagcatcacagtagctggcattgactgttgtttggcaagaaggtcctctgccaaatcatccaataattaagttttatgttatttgtatgaacgaccaagcatgcagtattccttttcaaatcaaagggaggcttaaaattactttttgaacactttcagaccatggtcaggtcacagtttgggggctgaattaaaatgatctcattcatgatctaattgaggttggcaaaaccttagcagtagcaggagtacataaatataaatcaaagaccaaaatttagcaaatcatatcatttgctagaaatctgctcatgaattattctccgattgccaacccagaagttaaactttgtctcccctcagcaacagtaactgcgcatattttttcaggcttctgacaggaaagttagaggatctgaaaagagaaaggagaaggaagatgatcactgtgtcatcagatatggtacatttgtgacccaagaaactatgagagctgataaagccatgtacgtttacagtggctgctgcagccttggttagaaattaatatgggtttctaaaaaccagactttggaagagcaggcagcacagacacattaagagtgtaaggggagcaaacgtttcaagaagggtctgattgtactttgctttcattttttcaattgaggaatgtaatcatcataatgattcatgattatttacaaatttagttctatcactgagctgggtccagggattgagatttgaagtagtggttagaactagaagacgatacggagctgttagtgtgcatattcaggttacctttcattctttctttctttttaacgctgctataaaattaagactccaaataacttttcctataatctgtgggattaaatgtcatactctattgtatctaatccatttttaagttgtaaatttttcttgtttgctgtgtatgatttcatcttaaacccacacaacactttactataaactagaagaggtctaattctacagttgaatcttttgaagttaaaattttaaatcctgtgtaaaagaagatgttcttttaatcaaacagtaaacacagaactggtcagttggccacctttatatatcacaaatatatgaaggtatacttttaaatcttcaggataaactaaggtgggaacatttaaaaataatctcaggtgagagaggtagatgaccacattcctgggaataggtaactgtcattaatgatttcctaaaatgtattctacattaaaaaaactgtaatggatttctctttaatagttacgttgcccatagacaacatagtgatttttgttctttatatactgtttcttatttttttataataactcaaggaaaggtactcctgacaagatgatagccaccccctcctcccaaatatgaaataatcagtaatagatgaacagattaaaatattgtgctatataaaatctgaggtttttttctttctctcaaatggatgagtaaatttcaaggaattcagtgcccaagtgatctataaatgtaatatattgctttcaatgtttcttagtttaagaaagtatttattgtcttgtatatccaagtaactgtaatcaaggaaattgcaattgcctattcttggaagtacctaagtttctattttagacaccatgcacatcaatggaagtgtttcacatcatgagaattctcagttttaagaggtgaggtttatatataaggaactcagtaagctgtgttttcataataaatagacccattaagagggaaatatctctgagcaaaatggttgtcctctaaagatttcccatcacctttgctctgctgatgggaatttgaaaactaaatacagcccatgtgcacacattcccacatgcacacaaacacaaatgcaccctaggatccaaactctgagaattttcctctttaactttcactacagtcatctagcttgtgaatgaaatacacttaaacaaaaatagtagaggcgaagaattaatgtagattcttgtttagtaggatttattgtaggggggaaatgtgttccctatgccacatgattcttacgaaacttacacctattaatctaagctttaagtgtattatttaggataaattactagctttctgcttttgtactgttttctcccattttccttcagtattaccaatcttaacacagattatcctaaactgattgcaaattattatggtttttaaaacagcattctggagtcctgaataaagatggtattttaaactagtgtttacaatatacagaataaaaaagggtgggggagatttaaaaccataccgaacacttagaaatgtgtggagttttatacttgtgcagataagtgtgaggtagccttgccctgtgaaaccaagaccacaaatgatacgtgtcagtaggttctttgatagggcttctggccacagtgtttttgtgctgtcaaactgctatgttgaacaaacacctcctctgggacagagtgataaatgcagagacaggctggcttcaaccagtctcagcaacctcctcaaccacaccccccactcccagcccacctcctacctcctacaatccagccacctcccactccactttgcccctttacctgaaattgacatttatatagaggtgcccaggattttttaaggtgtcagtggtgagtaattgttgatactccccaaatcttatgaatcagtactctgaaactgcaggcaaagtcctttttctggcaggctttatctagtctttttaaatggaactggactgagcttctaaacttttgccaacttgaactttttccacctttgcttaatcacttgaaaaccacttgctttccttgtctttcccccagtcgctttttattttctaatgttcaagctattacattgtgcaacacagacaaaattttgccttaaaaaatccaaacactattacctcttacttttcactttctagcattcttttagggctaacatttcaaatgtatagtcaactggtctttttttttttttcttctctctcttggagccattattctctgactaaaacctgtttactggtgcctttgtgtgtgcgttttttccccctgacattaaatgaatttccatcttctacttctgcaatctctaagaaatagataaaccattatattttttccctgctcgtattttaaagtggtgatcctgacagcaggacgattattgcactttatgttttagtggatgtttgctgttgctagttacagcaacacttatcataagacagcaagaaaagagtagtccctggtaattaaagtaatgaaatattcatttactctaccttttctgtagtctcacaaattaggctgctacatttaatgcctgcactgcctctgtttttattataatggcagctttcgcatctgcaattaggactaattctgacagttacaatttctgagggatggtaaacagtgaacgagatgtgcagcagaggtattacacgtgaaaagcccttgtctctttaaccttgttgttttttttctcgcagaggttaccttttcccgatggtgcaaaatcgacttgacataactgttcatcagtttcagggttttccctggaggtatttgcatcaaatcagcccagtcaagcttcaagttgaaattggcaggccagaaactcacagggtagagactggaaaagagacagccaaagtacaggcagcaaactgacagcagcagagtgaaagacagaggggtggggggaggttgagagcgagagcttttcaactttagtgtgcgggaaatctcagctcctcctgtactgatctcagcagcaccatatcctgaaggagcttgaaaggttgagattcagaacaccttcagctaattcttaccactagggctcaccagccttgctccgggggtttgctctcacttaatctgattggatgcctaaagaggagtgggcacacttaattaaacggaaggaaagttctgaggcacctccccagcacttattaaagcttgaaagccaaatctcatgatcagtgttataggaggaaattaaggtggtttgtttttttttttttttctaattgttaacttgtaggaaagtgaacaatccctctctttaccaggtttgttttcttgggggttctcttctgagtagattaaatgttcacagagactagagctcaggggactgtccattcaaaagctaatgcattttggctaacaaaaagccagtacaagtagcaaaaattatatttgaagagatactcctttgaatgacatgggtttgcaagttctctgtcaaataatgccctactatcctggtaatatgagaacacgtattaagttgtttaaaaggtcaaaaaacatggcaaaaccttaagatgtctaagatactcaacttttactctcaacaaggtcactttaagaaaaattctatgattgcaaaacttgtataattgcttttacaaagaaaacaaatatgaaaagtgtttcctttgcctgagaacattttttctccttgatgtcttaaaaaaaaaaattgtcatccttccccgtctcttctaactttggagtgggagggggctggtgtttttactagatgatttaaaatcctccttactttccaactagacttgggggtcgaataagcccttgctttcaaaccgttttctagctctgtgtatgacaggcattggctgatctgctgatgcccattcgacaggcactgttgaactaaagtggtgtgacggcacagttttgttaagctgtgaacaaagggctgaagatgccttgctggcatcatccatgtgcatattggccttgtcacagttttgcttgatttaatgctctgtttattcctagatattaaaacttaaattctgaacaatatgttttcaaatactacataccaactttattttaaaagctttaactttgaggaccctagggtccatttgctcatccagtttctgtgtagccaacattaaaacacagctttggaaataaatagattgccagtagcctcttagctgttatccatttaaaaatgggattccagtctttaaaagtcttattaggataaaagatttatttttctttgatcattggttgaaagtcattatttatttccaacactggattgtcacataaattcctaaggaagagttaccttgtgtgtactcagtgcagtcagagtagactttttaaaatgacaaattattaaagagatattcagtaataaaagaaagcctataagaatacctataagggtaggcacatcaccactgagagaaaaaaaaaaatcaagggagtttatgttaaagtgagccctatttaagagatagcagaagaattaagattgagacttaaaaacaaaataattgttatgaaaatccctgttccagaggcaacagctcgcctatctaaagaaatcttaagtttggtactaaatttagattccagcgtcccgttgaatgtgtcttgagctttatctacgctgggtttttgttccccctctgcctctctttccactcttcaggttttcttcaagtgtttgctaagagattagttagcaagtttatattgaggaggtagccatgggaggcagctctctgcttgaaggaacgcgcagtgggtcagagtgagaagatacagggagctaagactgactaaggcctgggatcaggtactttattttctctcaaagacaaaccgcccatagaaaggttggtgggatggcatctgccagcaggagcacagatgttaccacttttagaaacttccaaacaagcattattgctggaataactttatgaaaaaaaaaatctgctgccagaatactcctttttcattatgtaaagaggctataatttgagatattcaaggttatttttacctccattcataaaacagcatctttcttgagagctgttacgagttaggtgaggaaggtggcaaaggagagaaaaatactcagcagcctaaaagtattgctgctgctaataaccggtgagactgcactaagaatctgaaatggaatctccggggtaaaacacatccacatttctacctgccctaagcgtgctttcttagcagtgactgagatgaattgtccatttcttttcagtggtagtttttctccatgttcacttatgccaaataattcccacagccagaaagagtgatacaggtcggggtggctaggaaagaataagcctttattgctagtttttgtataacatcaggcatgagaaagacacttgctaacagcatagattgcaagacactctgtggcctgttctcttagtttcatgagaaaattttgtccaatcccataggtgtgaacaagatttagacatgtaatctccaacctggaaaagaagagagcttttaatatattaatagggcagattcttacttaatatataaagtgaattttggcatcagtttggggtttcctattaatactttgttagcaactgtttatggaagagacaaacagcagttcatccaaatagtcctccttccccaacccccaacccctatcttggtattaactgctttgtcctgtcagcttataacattctatctttaaattactctaaatgaagtcataattctagttatgttttgtaacaagtccatggctaggaccaacatgacttctcaccttttaatgaactgttctactttaggatcttctaaggaatagagtgtaaaaagaagcaaagcaggagatgaagaggtctcgtaaatagtttcctttgaacatccacaattgcttacatggccttttccccttttttccaggctggcagaaatggcctagcccaggactcattcaagtgagcacatttcagaatgactcattggatgattggagggagacacaagccctacgataccaatgcagtgtattaatggagaaagttcctgagattgggagtgggtgtgacattaggctagggtattcctgaagggctctaattcatgtgagaatattaagtgtagatcttctagctatcagttagcgtaaggtttcataaacaggtaatgatggctctttccccccgctacccccccatccaatttctagctgagtgaggaacaggctctgcttcatataaatacgatctttgaatttatctgcaatgaggtacagctttaatgatctgtatctgcaagccaggagcatgaatgtgatcttattgtatcatagtgtagagatgagataggctagcgctacagcacaccagtgcattgtgcctgggtgtcgggagcaatccttccatttccaaagcagcaactctttatttttcatcattgtttctttacctcacttgtatgctccttgtgatacagatctgagtgagttgtgcaagcttcagacttgccagcccccagctcccaggcctagtacagagtaattcataaacttaccatattagactatcagattgaaaccaagggtttctactgtggtggaattggaaagcccattgttttgattatcatttcatcagccccaactgatactagtatgctcaaggaaaacatacttcagttacagttgattttcagattccaaaatggtgctgcaaagcctgtgcatctctaattatattttatgctaggctgtgcaataccaaaatatacgccgcagcaatcagtgagtgaacagtatcaatcaatttgtaaacagatgaagtcactcattcccaaactggttttccaaaaacaattactaaattacaatagaaaaaaattgtacagttactgtatttgtgtgctgtgttacaatcaacataccagggaaacaaaacaatttaatgcagaaaaatcatcattcatctacattataattgcttctttttcacatctacagggcggttaattaaaattgtgattaaatgcggtcgcgctgcctaagatgtcttgcccaaaacaggtggtacagaatttaaaagtaaaaaaaatgtaattagcattggaaattgagaaattgcctgtaagaatcagtgttaatttcagtcagtgatgaggtaatttataaatgaatgcagtggaggctgtgcaaatgcacaattgccttccttgccattcttagcattctcagcatgcaggtgaaaatgttttcaaaatattgaggtaatttgaaaatcaatccatgcattctgtatcttttttctcccatttgtaccaaatgctgaacaaatgctgccatagatggcacaatccatcagttttttactttctaaaagtaatgctgcacatattttagacctagattaagaaatataacaacacaaattgcaagcctaaaattgttacacgggtcaaaattgtacacctgaacttctgactaatggagatttggttggctgtgaaatgctcccatcaataaaatagagacatggggggaaatctgtccatggtataggtggtacaaacagaatgactattaaccaatccaataaatacttgagattaaatttttaaagtttaagaaagaaacagaaaatttataataaggctgatatttttcttagaatcttgaaccgtaactttgttattccatctagaaacatctaaaaccagttaataaagttatcactagaaaaagcgtttacagaaattaactgtttttcaatgtcatctttcctttcaacaaagatgcaactttctacaaaacattatgctatcaacttactatatttcaagcgttctattggcaaatgagtggattctatagattagatactggttaaaaattatttctatttacgctgtatttttactattaaaccgctagacttttaaaatcttttaatggaagaaatttaactttcatgtgcttattctgaccctctgaacaatatgaatttaaaatattttaataatgaattgagaatatggggtttgagtatctggcttgataccactggagttaagagactttgtggggctttttaagcatcctcttctgtgtttggcattctgcaaaatgatctctccatataaagctcatcctaagaatatgcttatttaattgtggcagatcaatctgatgatcaaattctctcatgtaaaatattctacgtgttttttgctgtttcaggcagaaatcaataatttcacttcactctgaagttatgttttgtggtaatacggacattttcaggagaaaggtgaaaaataagaaatactgtatctctgggagtgtcatctttattcattcattcattcatttttagagacagggtctcactctgtggttcagactagagtgcagtggcaccatcctagctcacagcagctgagattcctgggctcaagggatctctgggagtatctttctatcctctgatttcaggcctagtttcgggccttccctcatgacccttcctgatcatttttaggacacaaatgaaaagtgcaatttagaggtgacagctcagctggttgttccaagtggcatgccatcgtttctctcatatttaaatctgtttcccatttaatattacaagtagaaataaaatgagacctctaaatggaggaaactgaaaggtcaccagttaactccatgatccctctcctttcaccagctcttgcctcccactaactgtgatgatgacgatttcatattccagcagtcagttcactttcagcgagggtgggtgcagacttcatcaaagaatggcttcctggatttccttcaggacctgtgaacataagatccgcaaccacatggggcttggctcaaatttcagcagagtggtgggatggaggaggtattatgacgtgctccaggctgcactggttctgagtttacaaggggtcacaagggttagagaatcacagatgtcaatagagcgcgaggaccttcctaccccttgaaatatttgcagtagaaatcttacctctttacgtttggttcgtagtgccccatgagcttagcacggcaatgtggagttacttgtgagatgccaccaatgtttcatatatatatatagtatattatataatatataatattaatatatattatataatatataatattaatatatattatataatatataatattaatatatattatataatatataatattaatatatattatataatatatattattaatatatattatataatatataatattaatatatattatataatatataatattaatatatattatataatatataatattaatatatattatataatatataatataatatgtatgataatgacatatatatatatatgttgagaatgacagtgtctttttatacaagctccctccaccaagtatcatctctgtactcttacagggtcatcaagattgtcagaaaaggcctggactacatgcctgtcccagcactagattggtattttttaagtccttttttgtttcaaagtttgccatgtgagcttaactcagttcattctgctgttattacaagcatcacctctttgaagctgttatcagattcatgaaagaaaaatgcgcattttctttttctactgagggcttctttcacctttattcctgagagtgatcagagctttgaattgtaaaaaaagaaaaattttctcattgtacaataattgaaaagtatgtcatcaggtcctttctaggtcttcctgtggtatgtcagcagaaaactacagtgtttgttcattttgcattaattacacacctactatgtgcaggctctggctgaggtctgtggatcaaaaaatggatgctagagcctgggcccctgaggagcttgctgtctagtgggaaatgggggtgcatttaagatatgatgaaaatgtggcaagtgccacaaagaactttctacccaatacagagagagtacagaggatggcacaactagatctgggagaaggtggtgaggggtcacttcatggcagaggtgacttttgaggagactgttgtcatataacatggatttcaccagcaagtgagggcacagcacgctgggctgagaggatggcatgtacaagccaggagaaagggtgaacagcgcaggcattgtcagccaactgagatgtctgaaacacagggcatgagcaaagaggatgggcttgatttgagtctgcaaaggtggtcagggagcagaagaatgtcctatcccatatttttggcttgtatccagtaaataggtgatggtgagcttgcgaaccatgttttatagaagagtgacataattatatttgcgtttcagtgacacgtctctggcaactgtacgaaagatattatcatctaacatttgttgagtacttaacaatgtgctgggacccgtgctaagaattttgcctatgtcatctgatctcgccccaacaataatgctgtgaaatgggtactattattttcatactatttttactgatgaggaaattaaggtttagaaagggcatgagcctggagtcaggaagaaagtctacggttacatgttactgtaatcatggaatttctagaattacaagcaacacaggcaataatgatcattgactagaaggacatttggaaaagaaaacccagcgtttgaaaaagagtgaggcagtttgattctgtttctctgagtgaatagtgagactaagtggggtgtaaggatgtttcatcctcaaaatttattttttctttcattactatgtcagtttgaaaaagaaaataaaaaatggttgttgatcctgaagaaactaatcctagaatgtgctacatctttgagagtttggaaagagacagttaacatacaacccttcaaaacagtggaatttggtaaaccctggaacactgttcttgctgatctaattcatgacattaaggccttcctcggccttatgaggaagcagatgaaaataatccttttgcgatgactattttcccccttttctgatttaactcttccattgcctaagactcaccaattctcaaacttctaaattctccacactgccttatctctgccatcccatggcaagtcctaaagctgctaacattttgtaacaactatgtgacaaattgttgtgcttttattcaggtcggacatctttgccaggcttgcttgttgtgttttctgtttggctgtgtcatgggaccaaaggtgcctgcctttgtacagcatgtcaaatctggttaacatgcagccatttatctttaaaaccactcctgcacaatggcagaggtgggccaagccacagggctctaagcacaacccaatttttcagaccatcttttctgcatatagggagcacgttggacagcagacaagacattttgtgatttggggaatctcttagagacaaattgtagagtgcaagtgcagtgtaactggactgctgggtgcccagtgaagtgaggaaaatcagatacagcacaggctgaaagaatgaagcaagaattcatatctctgtgcagaacatgcacagtactttgctcacacagagagttcacacatagacaaaagcatgtttgcttgtgggttattttcaggggattctatagccacagtctaggcgtatatatttgcacgtaagctttctttctgcattttgtactggtaggtgtgtctacatgtgaacatgtaaacatgcttatatgagaagacaatttgctgttgctgatttaagacacgggaaaggcctcctagttcactgaggcgtttccctcctaatgtagtagaagcagaatctttttgttttctacaattgttttaataaaggactctgtgtgtgtttaaggaagactcagagccagagtgtcaagtgctgcagtgaaaaatactgaagatttttctttccataagacagctgcaaactttataacccagttcactctgggttttcatttctcaattgtttcaaggtgtcttgggaatgatttgcccttaaataactagttatcaacaaaggagaaaaaatagcaataaaaaatgtgataaacctgcatagactagtttaactaaaatgaagaatttccttgcttggagcagttcaaggaccgaacatagcaaaactgtgtgatttaaatgaaatattcagagtggtcaacataaatacacatgtagacaagagatagtatatgtgtgtgtgtatacactgaggttacttcttgaagaaataggcattttttcctttctttttgctttttctttcttttctttttctgagtaaaggaccccagagattgtctttcactttgaaaacaatctctaatatcaggaaaatgcgctgtttgtttatgcgtacataatgcaagtttgtccgcctgggaactgcagcaaatgggagaagtatgcatggatttcacaggtaacaggattacgtgggcacataattgatccatttggagaaaaaaaatgacagtgctctaaagatgcctaggctttggagatggagtttatgaaacaggcatttgtaaattcaaaggaatcaatatgtcaattttattacatctcagaaccagctgggcattaaaggaacagtagccttaaaaaaaattacagctgcatattcctacgttgtctacctttcttaaaggccctagaatttaaggaaatgaacttagagatgtgtaccttttcagaaatgaatttacattgtccaaagagaacaacaatttaacattatgtcagttatcaacctaaaaatttgattgaaatgtctgccttatcattacaattgaagtctattaatagatacagataataagcagaatagtgattttcacataggttgcactgtcaaggattcattggaattcatatttgcattgtgcttttcaacagtctagattttacctcttcactgatgataggacatagtttaagagctagcctttgggtgtcccacagaattgggtctgtgcatgtgtgaaatattcctgttttattagagtttttgacaatctatttttttttttttttttttttttttttgagacggagtctcgctctgtcgcccaggctggagtggagtggcgcgatctcggctcactgcaagctccgcctcccgggttcaggccattctcctgcctcagcctcccgagtagctgggactacaggtgcctgcaaccacgcccggctaattttttgtatttttagtagagacagggtttcactgtgttagccaggacggtctcgatctcctgacctcgtgatccgcccgcctcggcctcccaaagtgctgggattacaggcgtgagccactgcgcctggccgtttttgacaatctaaaaagaccaagctattttaaattattaagttcctaaataataggatttggacagcagccataagagaggtgaatgggatgggaatttaagatactattttaatatcacaaagaggttacacaactaaggatgaaagttagaagctatgaattggtccacatactctgcatgtgctgtctgctagaggctgcaaggcgagctgcttcactgtttcatgttccaatctccaccacccagactcctgctccaataacatctctagatctattcacttgtaacaaatggagcccagttctcctccctccccaaggaggccagacactcgatacaatgaaaagaacacaggattcagacccaaacaaatttgtgtccacattctgattctgccatttactctccatgccatgtgcccctgggtgcgtttcttaaccactctgaacttcggttcttaatgcttaaaaatggggagcagtatttgttttatagaatctttgggagtattacacaaaattctaaagacagtgtctggagcctagaaaacgctcactaaattctgattatgactgtttcaaggtgtgactaatcaggatgccaggaaccctacgatggaggcacttcagtttctgggccttgctgaaacattcttgaaaagaggaaacaataaccgtagcctgagatattcgttccttttttttttactctttggagagtacttaaaaaaagaagaaaaaagaaatagtcatagtgattggcatgctattctacctctacatttccaggaaatatacatggtactttttcttatagaaacagcatctcctccaaaaagaatacattctgagatgacttttgtcacagcacttaaaatatctgattcctatttgtctccccacaaatgtgtaaatggcttgagggcagtcttgcccatctcagctcaggccatgacatacaaaaattgtttcgttaaagcaaaggtataatgaatacagcgggtatattaaagattcagtatacattatcatatgtagaaaaaagctttgggtaactttatgtcagattccctaccaccatattaataactttttgaaattcactttgtgacagctatgttattttgaatacttgagtgggtttgctttttgtttttgtttttgtttttagtttgtatttaaatcaactggctctctgcctttctcaatgacacctttgagacttgggagtcagggaggcagagaggcagtgtgggtgctcggaagagtgtaggctttggacatctgggctcaaatttggtttctactttcatacaagccataagacctgtagcaagttgttcagtctaactgcatctctgcttctcataataatactcatgttatagggcagttgggaagaaatactggtaacaggtaaagtgccaagcacatagtaggtgattaatgttctgtccccttcctccactcttctttgtcacttgagcattcactttgggttggcatttagtgagctccttctgcccgtcaacaagtcaatcaacatttaatacataccatgggtagatatcttacccctgttccaaatttcattatgaaaattgggctattttctactcaaggaaatgagcatgcagaagtaccttctgtacttagaatcacaatcattttagctattttccgcttaatctgacggtttctttgttcccatcatcttttttagtgaagcactttggtgtttctgcaatcctttgctatcattctgtgcttgggtatctcagatctctcttctcccccgatcctttgaagacatcagaaaagaagaagcacaaggtctcttgactatacgtttgccacacaactgtgtggattggttagttaatagagttgattaaaacactttgtttgattctgcttaagcataccagaaatacattcaaaatctacagctacaaaatgtaaagaaggtagtccaaatatagtactacataatgaggctccctgttggtagtatataaagcagtttagagtatagcttcaaattctaatgaagatcattttaaatcttgcactgaattgtgaatttaaaattcccatgttctccataagtatctgaagaggggcatgtaaataccataagtgaattaattactgccttaagttggtaaagcatgtgtgaatccaaactttattcttgaacttgcacttctcttcccaaggttttttgaaccatttcctatatgctgagttctgagtacctatttaactactgaggacatatgaagaaggtagttttctttgcatggattaaatgtttcaatctctgaaaatcaccaccaccacaacaaaaagtctgcccggcaccatctacatgtacatgatgaaattcctaaagcagaaaagatatatttataatctgaaacttataaaaacatgacaaactgttaccttcacttttgtgcccccttttttcattaacagtattaggtcgtttttttttttttttttctcttgagaagaaacgaaagacgaagtggcaagaatatctttcacttttgctcacgttttggtggtgtaatattgggaccactgaagtaattggacaacttttccgagctgactcttctgaagtaaacccaaggcaaagggaaaatggagctgctgctaggctcaactgatggcgcccacatggcgcccaccccagctccttcagagactccatcatttccacagaagggccagaggccctgccaatatccgcacatcactggcatgatagaccataacagcttcttctgagctgttccggtctatcgtgtcaatgcgtactcggggagtcctcaacgcacggatcactgacacggcactacataacggctccttagcagccattattgggtatcaagtcaatgcctactcagggaggctttatcgcagaggcctgcacgagcagacacattccgaatactaaaattccttaggaaaattagtcattgcccatgtgtgatagctgttttccattttgaattttaaccattttgggaaaaggaagagaatgggaaataccagtatagtccgaaaagcccttaaaaaatgagtgcgaaaagtggaagggtggagtggacataggaagatgatgaacttgtcattttttcctttccatagcttcattttattgtgtcaaagttgcagaaagcacttcactttcatcgaggctctttttaggcagggtacagccaagaaaacttttttatggctcagatgtaaatcctagaaaacgtagtagaaatgatggcaggatctctaactgtaaaataacagtagtgttagtagtaagtgtcattataataacgttatagaactctgcacatcaaaaataccacattttatcatgatctctgcaagagatttctgttggtagtcattctagacttctaataaataatacgttgagtaggaaaggttctgtgaggatccaaataataatgaaaatgacagtggtgatattaataataatagtacagctcccatttattgtatcattattatgtggcaggcatttgtatacattatctcatttaattttctcagcagatgtgacaaatcaggaaactgtggcttagcaaagttaaataacttgactgatgtcatgcaaccactaagtgacagtggtgggatttgaactatatctggggagagtcatgctcttaccattgcattgcctctaatgatcatcactttcagggaactaggtgtttaattagaatatcccaacccattgtctgcttactgatcaggaaactgaggcagggtaattttagtaattcccccaaataataaagagagtcagaatgaataccagaaagcaacaagaggcaaaaacagcctttctctctgacaacatgttaaccacaaacaagacatgggaatttcagagcctccgtttgtgtttcagaaggaatgtccactgttgccatcagtcctgaaaagatttccttgcaccaaatcaaaatggttcgagtttgctgttgttgatattttttttccttttgtgttctgcttactgactgacatctgctatcatgctaagcaggtgttcctatgtaaacgaacgtgccctgtttgtgtttcgccatcctcgctgctgcgcacccaaatgagcagcgtgattaagaatcctgtaaatttttgaaaggaaacggatggctaccctactagaacataattacaccgttccaacatccgcagctcactgctgcagcagagttggagaacagcagaaattaataatatataatagcatcattctagtaatttataaatgaaataaagtagagaggagattctgctgatatgcattttctccttaattctaaaagacaaagtatagattagaattttagtggggtgaaacctggccagcagtctcccactagttgcctgattcatgataggagtgtttttgcttagggaaaagagctaatatgttttattaggccagaggaaaaaaagaaaaagaaacatgaataaacaaggccctctaaaggcaacactaaataaagggggtctgaaaaaatctctgtggattgtgtgcccactgtatttaaaaagatattattactttaagacttcaacatgtgctgcattttttctttcattgtaataacataccaccataggtcaccccttctgagaaaagagggactgatcagttaaagatgtggcccaacataaactttatgttaaatagcactcgtgtaaattctagagatctgctgaacaacaatacacccatagttagcaataatagagtagatttcatcttgtatgttttatcacaataaaaaagaacattcatgcctttttaaaaacattattttgagtacccagtatgtgcaaaggagcctcttattacaaatcatcgttagattaagggagttgatgcttttagtcaaccatgctggagaaagaacaacactttctaaagaggcaaataaactatatgttaaaagtaaccagtccatttctctgtctcatagggttgtggcaggcactttagaaactttaatgtttttctaacttcatttaccgtaggtaagatgcctaacaaatggatgagctcagttgtttcaagagtttgtctcccatgagccaatgcccatcacacacacacacacacacacacacacacacacacactcacacacgagcaattatccttaagaaaaataatatttatagcacttaaagtgttatttaagcaacttttcctgcttaattccaaagaatgacaatacatccaaaaaaaaaagtcatggattttcttcctttaattaaacttagagaacatgaaaatactgtttgcctttcaagagaagcatgtccatttaagatgcttattcatttaagcagtattcatttaaaggtccccttgagtattactctatgtgttttgatttggttcagagaaaataaattcatttaatagatttatttcattaacaggtatttatttaagtgggttccactgtatttaaatctccaaacagtttccattacttccttagctcacttgctccatgttgactaattttaataagcctaaggtgcctagggtcttattgagtgttcagtttgatcaatatggttaaattaaaattgtgcaaaatataagcaaatgtactctaacaacacagtgaaaaatgtgctgtgcactaagcattgattggtatgctgtggacacagatatatgaagctgggtgggcctctgaactacctggaaactgccactctcctccaaagctcccctggctttagatacatccatgtgatctcccacccgttcatggagacagcagctcagatacccccattgaattagaaggggaaggagattcatgtcaggtgttttgctttttgatttaatggaaaacagcatgtaaggctcacagtgaaatcctatataaagaaaaaaagctaagattttataaaagttcaactttgagtattgctgaaatgctttaggtaataaagaatgcaggccctagttctttttcacagaataactttttaccgtaattatccttaaattttaatcatttggtagcttgaattctttttcagagatcttacttgtcaagtttgttttagcaaattacaaaaaaacaaaaacaaaagccaacctgatttttaaagtataccaaaatcagctttgccattggtactgcatttgaaaacctagtaagctttctaacaaattcattgctttctatataattgtaaagttaaatagataactgaatatttttagtggattccttttagtatgaataagtttgtatcttctattcctaaatcaatttctttacctttccctttttctcttctttttttctccttttttgcctgttttatggcaagcatacttaatattcagtgtcaatctttttaagcttttcaaaaatctaccacaatcacttaccaatcataagtatatatcattcaaaattgttcctgatatgtgctggctgttggggcagtttctttttcctacctgttgtgtgcctttgtacctatctttaatctcttcttgctaagtgatagctaccatcacaacactggctttccttgatagcatatcttcctgcatgtccaaaacttaagttcacatgagcagaagttgttcttatcaaaggtaaatcagaagttaaaaaaaaaagcagagagataaaaacatcaaaaatgtacatcttgcaagcaatgatgttgaatttgggagaagtgtgttctattgaaatgaaaatcattttctagtttaaactgatcacggaagtttatatgcataataaggatttgaagtttcctatcaaattaagtacagtgtttgagcttcctaacatttaataataccatcaccaatacacctgcaaaataaaataatgtttgagccccaaaatcatcagaaatatgtagaccaataccagttcagaagaattgactttatttttgtaatggggccaagaaaaattcttaggtttttgtttagttttgtgcttgttaatcttgatttttcccagtgttttgcatgttttgagtttttaatatcaaaggtactgctctttgtaaacaagtgtaagtttacccaggcagcttcacttacacccttcccttgtaatcagatgtgaaaattacaccctcccttttggatacatgataattacacatttcaacatgcaaagaattgtctctgtttcagttgttggaatgaaaaagctgagacatttcagtaaaatatattattatattaaagatcatttccataattgttttcgggatttgtaatcaaaaccatgatcaaggtagtcttagttttaaaaagaatacacatggaaataaggagaggataaaattaattgccgagttccacttgaatgaccattcttttattttatgaaaatacagttaagtacattatattctttctttaaaaaaaaaaaaaccttctagtaccttatttgacattttctttctccatgttcgttgaattacctattttttcaggtcgaccaaaaaaatgtagaaatacacatttttgtgatcaaggtgaaaaatttagtcagaagagagatataaatacaatgaaggaatcttttcaagaaaagatgtgtttgtttttgtttgcaagagtgcttttcagccaaatataaaattttgtaaactcaggtaaggcacctcacacttcacaatcagacttctggattcatctagagtatcactcatatcataggtaaaaatatatgtcactattggtataaaatacactgaagccttaaaaatgcagaggttttggcaaataacactaactcaaaaatatcttgtatatccaaggagagggtttaaaatcaccgattcctttttactttcttaagctaagaagaaaaggaagagagaggccaggcgcagtggctcacacctgtaatcccagcactttgggaggccgagacaggtggattgcctgaggtcaggagttggagactagtctggccaacatggtgaaaccccgtatctactaaaaatacaaaaattagccgggcgtggtggcgagtgcctgtaatcctagctacttgggaggctgaggcaggagaacagcttgaacccagaggcgaaggttgcagtgagccgagatcatgccgttgcaccccagctcaggtgacagcgtgagactctgatgcaaaaataaataaagaaataaaagaaaaggaagagagaaggcagcattagatggctgatgttatggcttcgtgaaacagtttatggcataaagaaataactccccaactccttagttttccaagtatgtaaatgtttctgctcatccaaacactagcataggtaagtgaggacacatatttcatctagcccaaatatattttttaaaagaatccctgcagattttttgcttctataaaaaatatcccaacccaaatttctaaaaattttgatttttggaattaaatgataatactaattagcatttacctatacatccttttctattttaaaatcattgcataatctggcatttatatttaattttctaaatcattttccctagagagcattcatgtaattttagaacttggaaggaaccaggatttcaactatactcatccacagacttttcccattgggtagaaattgaaacagaactgacagaaccaggatttgaataccagccttttgactccaaatcagggacaagatgcagttttgtatgttaattatttttattggttttgatattgtggccccaagatccatagtcttattttcatgctaagtgactctttactctgaagggccaggttataattgccatgtatgccaagagtgaagggacccaggaccagaaaattcagtatgcccgggtggtgagtttttagacttatggagctgcatgttctgaactccacgttctttggttttactgctcctgtgttttttgacagttgcttttttttttcttcataatttctgtacaggctgggcagagagttcaggaaatgttccaccgtgtactgacattcccctggcaataagtgggttcccacttcagtcgcattccactaagcctattttggcaccatagagagggtgatgagagggaagagtcagtggaggagaagacaggaaggttgccaggaaggaattgaaaggcatatgctcctggccccattgcctgtgtctgccttcaccacctttagcttcacaagcagtggccatggcaaataggaaaaggtttgggtgggagaaacacagaagaagccattcctgattaggccatgtgtcttccactagtttccatcagagtgggctgaccgatctgtgaagatctgggatcatgactcagtataacaagaagagtcctacacatttgattcaggaaatttgggctcctggcccacccagccctgccttccaatctcagcatggccttggacacatccttaacctctctgggcctcacattcctaatgataaaatgcagggactggacagagattgcaaactggtggctgacagatgtttgatttgtcccacacagtattttaaacacatttgaattggttgccaatatttaaaaattgggctatttcacacacacacacacacacacacacacacacacacacacacacacacacaaatccagatttccagctcccctggagaactcagatgatctggtgtttcgggcccacatagctgcatggaaagaccatgtgggaacaactttgagttccgtaagaaaaatcaatcaacttccctcacctgcttggcctgtgtagacatttgagtgtgggaccccaattctctccaagactcctttgaagctctagttttagaattccaaatatgatttgcttgaccataagaaatatacttaatccatagtggtttctatattcacggcagaatgctaaggtatttgtttatacaatcagcatcaggtaaaagttggaactatcttaggccaaataaatcagccccatttagaacaaatgctgactttgaaatttgataatgggaggcaggaatagttcagcaaagatagcctttgaggtagttacaagaaagatggtttggctcctgactcactattacctacacagcgaactgtgtattttgcaaattatccaaaagtagattctttaaaacccaaatcaaataatacaaggcccttcagttaacattttttcacatctcccactctaaactaacatcttcataaatattgagatcatgaactttttctgttcatgtaattgcaaacaaattatattggcctgggaactgtttgatcttcttcaaaagtaaaggaactacattgattttaaaagttatatttttgtaaatcatgtttccaaatgtatccactttaaacacaaaaggtaacatttgcgactcatggttatagagtgtttaatattgtacaaggtgcattgacaaaaatatctcatttgatctttacaacaattgtaggagctagacagagaagacatttaatacaaatgaggagtctgagacccagaaaagttggatgactattggaaaattggcctattacttgcttaatgtgaaaaagagccgggattcaaatctacagcttttggctccatatttaatgttttccatgccatcagtatgcttccagtgtcttagggtatgtgtgtgtgtgtgtgtgtgtgtgtgtgtgtgtgtgtgtgtgtgtgtcttacctaaacactgactttttctctctctctgtcatgaacaagaattgagaggttaaatgggaattgtctcatgaattgtctcaatgttttctaagttgaatgaagaatcttttttggtagctattcttaagtgaatgctggatttttattaagggaagctaacagatatttaaaagcaccctccatatataaaagcacaatccatggaagcatagtgcaaggaataatgatatagacaaatggaggaggggcaataaaaagtcataaaacaggcaggtagaggtttctggaaaaataaggtggtgagggaagagtctaactgtaaaagtaaaaaggtagaagatagaaccgttgaaaaaaaaaaagaaatatcagaaatataaagagaaataaacagcaagaagactccgtagtaatttaagaagtgaaaacttttaggacagaggtaggagagaaatgggaaacactggagaggaagtaacaactaggaagtgtggaagaaaaacctgcaggccagaaatctgagcaaagacttgagagaggatgatggtaaatgtgaaacattgaaagggatgttttaagggattcagacattgagaggaaagtaaattttcatcacaacaccccatgacgacaggctcaacacatttggattatgagaaaggaaattaacatggttagaacgaaagaataaaaattagtaagagaaatctttggatgtcaatggagaggaggagaaatgatattaaaaggaaagaaggcatgggtggaaagtagaatgagatgagaacctatggtaggtggaggtgaaaaatgaaatgcgtcagggaagatcatgactgggaccgccgcacactgcagtgatgaagacggagaagctattcttcagggaacctgcaaataaaaagaaaccttaagatgtatttggagggaacccaccccagcaaggtgagaaagcaagaggttacattctgcaaaaagagaaaatgaacggggagaagggggaaaactaggggaaagagaaaacagcaaatcaaagttatggagcgtacagcattgaaaggaatgaggcattctgttggaattattcatttaagcatatgggtattggcgtcccttttctaaaaccggatcctctcccttatttctcatttttctataacactattataataaattcacatggaaaagtacaaggatgagcaattttttactttagaaatgtttcaaaaggggaggtaaacttgatggttatctgtctgaagggtgacgcactatagtggcatgtgagaatgaggccagaggtaatcatcagttttgaaattgttctttcaacaaattcataatgcatataaagtaactcgtgcacacatttatggcaaaacatactctagatattaatttatattgcttatactgaagatctcttgagttttcaaaaagtttgatttacagatttttcacatcaaaaattttttgtagattctattttgtaattaagatgtgtagactcctcaataattctttaccttgatgctgtgtatactcatttatctagattaaaatacttccttgccctgaatgttctaaaagtgtaccccttggggctctagaatttagaagtctcccttccccaactatttctagtctaccttttcaattgagttaatataatggctttagaaatacaatttccatgttgctataaaaatggggttaaaagtcataacaggcacaagaaacaggaggaaatgagaattgtgtactttcagtcacacccgggccatgtgctcgggccacatacagcatgcagccctccggagtgggctgtgtaacccggggcacacttgaggtcagggcacatagaggattaatttactgaaggtggtagacaatccctctgccacaaatgcaaacattttttcataagcgcctgaagcaattagttctcttcaataataaatttaatcttttcctccttcctttctttcctcttcgtttctcctctttcttctcttttcctctataaatgctggcctttgtctaagatcttcaactcaaaggtgtagatgccaggaaagaaaaacaaaatcaatgtattgtggtactaacaaataatgctataattattagaaaaaaacagattgaagcaagatacaaaaattctcaaaagcagctatctgtatgaaaatcttttctacttctagagagtatgtgaatgactgtatctttcatatcgtgaaagcagatgcttacatgcaatcacctttaaaaaaagaaacaaactatcacagtagtgacattgcctattttatatgagtagggaaactagccaaatagctttgggaacatttattagccttgtcctttttttttttttttaacttttagtatagagagaaaatagagatgacaggtaggtggctaagtaaggtgacaggatggcagacagcattcctatcagggcagaaagaatttataagggagctgccacttatagcgtaatagagctaagttaagaattgcaaacagagtagggccaagcaacattttaagaacaattgtccttaaacattcttgtaatgctaagtcactcatctttgtttcccacttgcttcctagagttaagaaaagttctttcctaacttgggttgctatgcagagatgtgaaatttcattggctccaaatgcttttctgtctagtagggactactgggaaccctgctaatgtgcatattgatgtaccctgtagcttcacagatgatgaaagagcatattacttatttccacaacaacaaagctaagagaaatttgaaaggagccagttattttacctggggaatttctcccaggtgatggggctatggaaccatggaatttaaatatgggggccgtcctattttctaaaaagtttttatggggagccataatatcactcccaagcagaaatcaaatcaaataaaagactattgctttcatttgcatttatttagtcaactatgcctaaaatacggaaaagatattatcatgctcattcagagtgtattttattcgttgtttactagactggactgacatgatatgatttgtgctttgcggggtcacaacaagctactagcaggacaatttgctgaatcaagaggatgattgtgtctggtgccagtcagtcgcaattaggaccaggatcagggaggcccggggcttgtgcatcgtcttgggcaagctgcatagaaatcagctcacctgaaactaattgtcacaacagagaccttatgcaaatgagccctggggttagcgtgggaaaagaaaaactgtcgcaaagataggtgacctgctgagcagggggtctgttgctggggaaatctttgttcaatgagtttaaaaatgttttcattgttcaaagtccaccccccgccccccccccccccaaaaaaagtagcatacacactcactaagagtatggcaaacacactcatctaaaattccaataaagcagaagcctgctttggagcatgccataaattgggagtctttataagggctacagcaggagaataatttccctttgcaagggcctttaaagtttaggtgctgcggattgcagtgtggcctaccttgaaaattcacttgcaaggtcaagcctattgctagcctggcaggacccgcacagccttttctccctgcattccagcaggccacctccacacagccgtgaggggtgcctgtgaactagacaagaaaggcctagtttctaattgagctttactggtatctcaggtagaagagaagggccaggagcactctcttaacacatggcaaaagaatccggggaaacaatggcagtttcttgaattgtggtttctcaaatactcacaagttcaaatgaaatgcaagcattgtgaaattccaggaatggtaatgcagcccaagtggtaatagatcataaaaatttagcaaaagaaaagtaaaaattatttttaaactatgatttactttgtttttcaatccctgacaaaaacacgtataagttggaaatgacgtttgattttattgtagcactcatttggaataatctttaatatgttttactttagaaaaccagatgaagaaaagttattcaaaggtaatgataaacatttttatacgttactgtagcaaagttgcctttgggttcttcaattgatttttagcttttcaatcttgttttcataaaaacatgggctaacatattgatacttcttagctttacactaaagatttcccagtgacatagtagataatgtatattcacacaggagtataaatataatatcaaggaaatgaaatagagtgttctaagctttagcagtaacagagagcatagatattttgcatctaatgatttcaaagaaagaataatttgaatttaaaaatgtaggtgagagaaaaagaaagtttcattgcattggcgttgaatacaaatgctattttgtttggcaaattactggacctaagaaagtgttttcattgtgtttcctaaagggctggattgaaatttggacttgtacctgataagcaagctcaggaattaacttggtagccaccacaaaacctaaagaaagttaggcttagaagtgcaacttaatcacaatttagattaaaacacacacgcatacacacacatatacaactcttttgtcccttcaccactgtctgaaataatttccacataagagacatttcacagtgggtacgaagtgctcagctttcactcatcaaactttaatcggaactgcattttagtttttgaataaagaacacttaaaaaatttagatgcaaattattttgcattattcatgctctaagtgtccttgtagatttaaacacttctgaggccaccttgattcaagtaattacctaggccctcactgctccgtcatgaataaggtattttgtacaagtaaagtatgcacccgatgagcttttaaagtggctttacactgaacttgtgtattgcttcttgtgcatgagtgagccgaacatgtgtcgcaatctgtctcaggtgggaaaccctggctgggcatccatgggtgacgggatgaaacccgagcgtctccttcacacacatgctcttcctttgtctctacctaagaatgttcctgcctgattctagtagttgttttaagcattaaaaaaaagcaatagattctaggaaaagagacagggaaagtgacagtgattccgcttaaccccttcatcaccagagattattggaaatgcccacttttcaggcctcctcatctccatcagcaaaggcttccttgtaaggtaataagtctctctcattttacatggttctgtacatctgtctccccatctgtcagcccagcatcctgagctattagagctaggtgctacctccaccacggtattcacacgaaatggagcaggcttcaaactcaaaagtagctgaagaatacttacaatggaaatgaaagtgaccatagagcatcaatctgtaagtttatccacacacacaaaaagagggtttgtaagagttaaatgtaactggctgaagcttatagctggcgtttgttacaaagtacccaagcttttcctttccaacttcgtggctttgaagaattataggaattttatgatgtgctgttggagttatactggcagagattacagtaaaggggttaaagttggtttatggtagaaaaaaaattatgcagaaaccaataaaaataaacacactcaagtagactaaacttgctgggcttttagttttacttttaacaaaggaagtttagatgaaagtaaatgttgcagcttttagaaaattagttgacactcatacttgatcatctttactatacagtggtataattaatatttaaacattctaataatgcagcttgctttgcatgcacttttcagcctcacaacattatattttatctggaattgtgctagcattttcttgggtagtgcccattttcatagagttaaatttaaaatagggtagggcctcagctcttattgccagtaaaacatcaataggagagtgaacaggtttcatacatctaccagacagtttattattaagaacaatatttatttgagataatagataatatataaattttgtttcattgccccatgaatgtttttaaatgatcagaatagattaagtttgaaagttgcatttggctgttgtccactcactgttcaaaacaggaggattttgatgatgtcaaggcagtgcgaaatcagcaagtgatacatgaaacatggaacccccatgcctgcccattcattagggcatctgattaacatagtaaggaatgtttattttcagtacataaaattgtagaactttgggagcatcttctgaattgcaaaagctgaacacccaggaacttagtgaaacaataaaaatatagagaagtaagctaatttgtgagaagcctgagctagtttattttcctatgagaagtttcttcctgttccaatctcatggctgtaggtggtagggaaaagttgtttcaggtgctgccctcagctagtccctttgaagagtgcaaggtgcccagtgttcctgatcttctagtttgaatgatgagaaagagcattctacctttccaccatcacttaagtgtcctttgaaattgaatttgcatgcacatatttactgctcattctttttaagtgagtaggtgtgctgagcttcaagtctattttgagactcagcccatgttaaccccttgaggcccacttcatgataggtactgccctgtgggaatcctgtcatttagtgaagcatgaagccataatagatccacagccataccaccattggggcatctcatttcgattaattccctgaagcctttggtgctgtggtttgcagaaatcaaatggcgcaaatgagaactacaaaattaggcaggttaaatttcgcaagaaaaaaaaaagataagtagtagaaaaaatagccagtgtaaaatattagtacacaggagcagtaagtaaactaagttccacactgaaagaaccaccagatctcgagaagtagatatcaagaaacagtttgcactggctgttttatttccttatgtcagaaggaagtaggtttttacagatccttggacatgatcatctttgtttctgatattcagaaacggaaccaacagtttggtgtctatttattttatttggtttgtttttgagaaagcgagttaaataaactcagcttacaaataattaacagcccctggactatttaaaacctgctactgaggtggtagagataagttgaatccaacagctgtcacatgtatgggtttgacagataggtaagtccaagagtggacaaattaaaagcatttttcatatgctaatctccacctgcacaggaataattttttttaaggaggcagtctactggcagagcaaattcaagagctatcagtagtacattacttctaggaattatgacatgcaataatgaataaatacttctatgagaaaagtctgctgtggaatcttaattccagatgggtgtcctgacagcaatgtgccagcaatattgtggaaagaaaaatgacatatatacatacatatatatatacacgcacatatgtatatgtatatatatggcttttaaacttgaataataatttcttccatgtgtaataggttcacaattatatctaaggaattacttttttagttgcgaatagagatcaaagtgaaaacaatagtcaaccttgcccttcaggtggcagttacatgtgagctgcatagtgagtgtgagagacagtcaaggatgtcaatcagaacctacagattaacccacagcagtgaaatctgagatggtttataacaagtagataacagtttcaggcctatgtgagaacgcataaactaaaacttcatgctgggacaaaacagggcaggacatttgaggtagagagtgagaaaaccatacttttattatgacaaagcctctcccatacttgttgaaatgtcactgggttgttattaaatgctcaccatttctctaggttttatattatcttacaaaaagcttttggagtttcctttaattttgataaacattcaaatttgtgcataatttctgcacttcagctttgaatgacagaaaatttcccatgcttgttgagtttcctttcaagtaagaaagtaattcttgtaataaataaaaatgttatatttctttcttccaatgttatcaagttaataaacccttaccttagtttataaagtcaaaatttactaatgtattgaaatgagaaccgaaatactcaaaaagaaatcttaaacatcaaataataacgagggtaatgaatgaatggtcatggttatggatggtgatgatctaatgtaaggtcctatctctttttaatagagagtcctcaggctcagacaatttagggttaaagtgcctataaccagatcagaatcctcagttattacgtagtactcttttaagacccgtgaattaagttataatcaatgattacaacactggtatcatttattaatgtacccttctcttctagggtagcagagatcagtttctgacaccttagaactcttcatgtgcaagaggaaattgaaacaataacaacatatttaggcagtaggcaaaatgatttgctttggctttacctacagggaaacttgggcaatggtcattagacttttttaatggaacttcaagtctgatgccttgtgaccaggtgctaacatggaaaagagttagcatcattgacattctttgattcggaagcacataagaggtagataaggagacaacacaggcgacccacctccaggccaggagaagaggacagttcctggaatgtctgcaatgtgttactatttttgtcacacctatgtgaggccatccatctggtctgaatcaatcagtctcatcccagggctctgctcctctcccagctgaaataatacccttctttcctcagtgctgtcttcaggaggggcgctgctcaggactgcccggacaaggccaattaatgagcctgtgtatttgcaaacgatgacccaggattagacactggagaaaactttctttaaattctctataagctctgctctcctagaaacagtacttgagaaaaccgggtgaatcattagacaaataattgaccccagaaagcgaaagactgatgctacattactttgcatacgtacatcttattttttaaagaaaatgtccttgccttgaatttaaaccatgaattggtctgctgttatacccaaagtagataaagcctgggtgtgaggcattcaccacgacttagcctgaagtattttcttcggccacttcactctcctccacgctacatgttcaatttccctgcacctctgtaacaaccctacacctctgcttctagatcatcttcttggcattcctcatgtgcacatcctgttctctagcagtcccttatccatgccgcctcatcagattcctgcacacctgacagcctcttgcttgctatttcagctactagactactgacctctattgtacatgcctgcaatcccagcactttgggaggccagggtggtaggatggcttgagcccaagaatttaagaccagcctgagcaacatagtgggaccctgtctctaccaaaaaaagaatcaaggtatgcaccagttaagccagccacgttttaggaccacatagcactcttcccacaagagacctcaaaacttaatgacattggctttggcaaattcaataccatgacataaaactactcattttccctatctgcctagttttccattgcagtgggaaataccaccctatcgtggacctcccaaccaggaaccccatggttatttttgtctcactgctgtctttctcactccccacaaccagtctgttaccaaccgttgctactttttctttgccaatgtttcctgaatccacccctttcctttccattctcatagttgtggtcttagtctaggctttggccttggcccatggggactttgcagccttctttcccctctcccaccacattcacatatcaaattccagcttactttatttaataacactgacaaatttttttttctcttgtctatgtttttggtccattcattctctctgagctccattgagactgccagctgctctctggactggcttctaatgttcacttcatacatgtcacctcttcatccagctacctcctaattgttccaatcttttttctttctttttggaggtaagctcttctggtacttctttttttatcgttctcacacttcttcagaaactcttctcatggtatacatgttcctggtacacaccactcaagggcagattctgacactttctttcggtagtccatccgtgcttcctttctgatgtagcaaagtgtcctctttgtgagcacgcccaggttcaaaacttccatttccaccacttgctacctatgacattgggcagttacctgacagcacttcacctcagcttcctcatctgtaaaatggattgttgtgacgagtaataagatcatttatttagagcactgctggcacacagtaagcactgttaacatgtttgctattagtattattatcatatctcataggactccccaatcacaccccgcttcaatcaccatcatgctgtatgccatattatccttgcatgtaaattttgaggaccacataactgggttttaaaaatctggttctaacagtagtttatgtcttagaaatcagggcaaagttaatcgaagatacctaatatcaaaccaggtaatgatgaagactttaaatgctttttgaggatgattataaagaacattatgataagaatgatgatgatatgatgatgatgatgatgatgatgatgatgaagaaaacatgaccaaatgcttctttgggttaatactctgcttataaaacgaagtgtccaggaaacatacagtattcctcctgaaattagtttttttttcccattaaatggaaacatgttatgcataagaacatatattgtgcagtatgcatgagatttatttttcagaaagcagagaaatggcaagaattttaagtgttctacatacttatttagatctcacatcaggagataaaacaaatgaaaactctgacttgttaataatttacgttttggtggaaaattcatacaagctgttaagatacctctaagacccaacacagaaaatgcaaataacatatatccactgtgcactgaagaaaatttgtctgaaaagaaaataacatcaattaaaaaaaaaaaacacaagtgatttcaagggaatgttgaccacatttacagggctgtaattgtgcttattaattttagatgtctcttttgaaatattcgtgtaaatgatctctccacttaccaggtgtttcttacagaaagtccactgggctacctcactacctaggaggtggcttacaaataggggatttctttttagaaagccacaccattacttttctctaacagcttatgcaaaagttttgtgggggagggaaaaacccaagccaaaaaaaaaaaagaaagagagagagagagaagagtgtgcatgacaataactacctctgtcccttaggtttttgttcttttcatgtcatggaactttttagctgtgctgcctgggtaactgctctggaaggttggaatatctgttgttgaaggaggtttgtgattgagggccctctgacacaaccttttgttgcattgaggtgtttgatcctctttccctttcttctaaaaccaatcccatccctttaaaaaatggataaccagcacttcttttacttattgtcagcttttggaaagttactctgggggtttgtagaagtttaactagttaactctttgcatgctgatgtcctgtcgctaaatattcttcttctttctaaacaggaaggattttaatcacttacatcaggtaactaccgctgttatgcaggcatagcaagtgaaacatattaaggtccagaaataaagcatttgtgttcaaggtcttcaaatgtgagagtgattcaggctttgcaatgagacacatccttattttctttttgtcctagaaccgaaacatgtgagagttatgactctgccacttgaaaaaacatgatgatatactaatttttcattgaagaacaacaggctttggtaataagtaaatgcaaagggttacttcagaactggggtacataactgaatggcaacaaagaaagagagccttagaatgaaaagtgtaggggtcttgttccagtctgctgactaaatgctggaatatttttttcccaaaagaagggacacaacccaggctctaggaaagaaaagaagcttaagtggattatttaacaaaaaagcaacttatggcttctagatagtgacctacattctgcacacaataatgatgttttacggtggtgatagggttaataacctaacatcattcatgtagtgttttttgaaaattgaattttactgctacaaagtaaatgtaacagccctctggagacaatattacaggcactttattgtttgctaagctgatgtcatctttctacagactgactttaaaacaaaggcagaacatttattacaaatatcactgtgtgaaaggaaatctactgaaatattgtttagaaggtgagctgataaaaaagtattaatacttggctttgatcatcttgtactataaagttatgacttcaaattttttctcatgtgatctctattcaaggcaaacttcatcctggcaattcctacctgtgtctctaacattatttgccctcaagttgaaacatttgtttaagattcatgcgtgttttaaatacatttttactctctaaggcaatttcttaacagagttgatgagtttttgagagagagagattaaatagcatctttcagagataatatatgtatgattttaaaaacaaagtatggagattaagctgtttagtttatataatgaactttcaaaatcacctgtaagtggtgactgcaaagtttgcaatttaaataagctgtttcaggcactgccaagcaagcattctgcatcacaggttgcttgcaactcagagggtttggtctctgtatctgatgcacgtgtaatacagcgtgaagttgtttgtggatcacacaggagcttcttagagcttcatttccacactataacccttgaaaatgtatcaaatgagcagatgcacttggctcttccttaaaaggcacaagtaatttgtttgtaaatcagttacctttcaagaaaagttaaattagggggaactcttgtttctttgatgttttccctcttagaaagccaaagagcaaattaatgatcattttgaagtaataatgataatgaggaaaatataatttagtgagctacactatcccaaaataactttttcaggtacagcatataaataacagcccaaaggactaaagcagcctgatggtgtttttctaagaaaatgatttactgctctgcctttgtctctgaactctggttagaaggaaaacacaggtcaaggaaattgggttaagggaaaaaaagcctgttatgggctaggtgtagaattatatgaatagtgactaattgggagtctgtagcactcagatcagtgtgtgcaatgctcagtactggctgatggtatttatatcagtcaaaaatgaagctggatacatctttgcgtgctctatgaaggcagtgtgttagttggtgaattggccgtgaccaggagaaagctaccagtagtactatgattgtgactaaaccaagaactgaactgcaatgttttaaaaatttattttactaataagtgtacttctgtatagaaaaatcatttttaaaaaaccttacaactattttgaaacattttactataagcctgcctttgatttgtttgggaagctattttatagtcactcaattcatttattgtatttgacaaatactagctacttaccatgtgccagcaccaaaggttcaaaagtgagccctcacagagccttacagattagtgtcagaaagaactgcttggcaagggtaagagtgtgacacattgtgagtattcaagaaatgtttgttgagtgactgatagaatgaattgagggatgatcaaggtaagtcctcgatttggtatatgtacaaggaggaactaagagtttccctccctgaacaggtcagaaaggacatgcttgagctggccttaaaaaatcacctgagtggcatgtagcatgtgaataatgaacaggaatgggccactggtggtagaaacagcatcccagaatatgctctgagttttagcagcacagcccatttctgacccctgcatgcctcaaagccactttaagaatttggtctttgcccttctgtcctcacccccgttgtactgtaatacacgcaaacatgtgtgtgcatgtacacacacatgcacacacacatgtgctaactccatcgttggaattcgactgtccaccccttcaagaatcaaagcatctcctaaaaaaaggaaatggcatgcctgttccttacttgtatccataaaactcacatttgagttgtctatcatgagacctcagttttttgaccaaacattgtccttaagcatcagacacataagaaaaactggaaagaggaacaggtaatatttaaatcacccactattcttgtaatgaaaggatttttcaaacatcaagatgaaatggttttatcaaattattaaagtttgctttttgtgtccgacttagcaacaagtcatggatgggacactcaaaacaggccaatttgggacagttccaactgtaggaggccttgtgtcattacctctataaatggaatcgagcttcccttcttctgcagctatacattttcttgcctttgatttcccactctgctttctctcccggcaggctcttcctgtctcctctatcagttactctataggcagatgtgcctctttttccatttgccagatccccccaacccagatcttccaaactactcccctttgaagtctctattaccgatacaatcacttttgtttcccttccatcccctctctcactgctccagtttcttctctccctaaccccattagttacatctgctgcccctaccattcagcctgtgttaaatcgtaatgcgcttgacataacttcagtttgtctgctaagtactcaatcagcacgcattgctatcttctgatttgtaggaaagggggcaagactgagtaagctggctcagaattctctgagtgattcagctctgcccaattagcacaaccaaagtgggaaattgacaactaataataatgaaagaaatgggttttagttgtgaatataaatcccacaaacttggttcctgatgcctgtggtagatactgtatgcttcatatggtggtcagatggctcagagaatgcagaagtggatgaatgaaggagagtgtgtcaataattgcaatatttattagttgactgggattctttccctggaattcattaatggattttttaaagactctgcaaaccaccagaaattgtatgtaacatttagtatattgatgcatttttttcctgggcagtgggtccatacgtttaagcagattcttaaaaggctctatgtctccccactatccgcctccaaaaaggtgaagaatcattgctataagtgaagacacctatttggtctatgttttcatgtggtctgctttttttcccagcccattttaacattccacatgatttgagcagttcagagagtagaaacgtagggttttaaaggcaaaatttaccttctttaagaggaaaaatgtttaaaccacctaccaggttatacaattcacattttaaaaattattttagttttaccacaattcaaagacaggcctttttttttttatttaacaatgggtataatcacacatctgaacataagaattagttttatgcagttccatagaaaaccaaaatcttgaggaacactttcaaaacaaccagagaaaaataaaccattccttatgtcagtcttgttagggagggattaagaaactggcaattattttggcgaccttaattgttgcgcggcaggaaaatatgtaattagagcacgttcccaggcctgcacacctgcagcacatcctacagcataatgtcagctttcagtgcctgtcggtgccaggttctagcacaaccagtcacagtgacgctctgagaacatttcggactcatgtaatgtggcttctgtgtatgaaagaagcaggcatttacactaccacacaatggagtgcattgctgcaacactggtttcattattttctgacgcctaccttcagcactgccctggtttactccgtttgaggttttattgttacggtataatagtcctgtacatttttgaaattcccttattattcagcttattaatacagtactgacttgattatcaggctgcagttgcacagcggaagattcagtgcattagctaagtcagaagctgagtaaattcttggtataatgagaacaattgtttgacatttttttatgtagaaagatgggccatggtagttctctatatagttgcattttggaattcactctatattccctatatgttgttgagtattcgtttttcatataaagaaagcttaaaatgtgttctcactaatttgaaaagtgtttcagggtatgggaggactccatcatgattctcattagcttttttcttctttttcttttattggcttttctcaacaaaaagaaactctgacgttagaaaaagtagtgaaaatgaagaaacagtatgcacgatgcctatttttcagataattccataatctggcatagtgatagttaacagacttttcccccctaagggagatacactgtattttgctatctgacatgttgtcatatataaagaaatcaattggtaattaaatgatgcaccttgtgaagatgacaaaaggcatttggttgcgaaaagagaactgggttttgaggggtttgtagtgaaggcctaatgactattcataagagattttcagtccgttgatccacttgactggaaagttctgccctggagagttagtgctgtcagtttctctcacctcagaaagccgccgcaatcgacggtgtagaggatgagcgagaaattatctagtagttgctctaggcctgtcttaggtcacgtgcagaaggcacatctggcttcctgtaggtacaacctcaggacataaactttgactaatttttaaactataaatatgtacgagtgacactgaataagttaccttttattcatatttcctttattttagaatgcatgcaagttgtgtagtaagctgccattttggccttatttttcttccaattttaactgttacacacttgcttgttaagctaagagtgactgtttatgaaagttgtcaaggaccaaatgataacagtctccttatgtgaaatccaacaactctgtgtttgctgagaatatgccaaagttgccctgcaggaagctcacctgaaacaaatacagagtatatgattggatagcgctcttggggggtgtttattgccctatttggcaaaaggcagtaagatatcaaaatgtacatacataggactggatacaaggctgccaccacatcaagatctctagaattgcagaacattgttgctccagtgtcttcataaacacaatcacaaaaactacgatgaaaattcatgcattcaaaacagaccagttactgtccaccatggaccaggcaccatcctagctttggaggagacaaacatgagggaagtaaaatctcagtgctcatagtttactgaggaacagacaaataagaaaacagttacactacaacatgtaaagagttatgattgagttgtataatagcacagagtttagaatccaggaaagggttttctgagaactgttggggtctacaaacggggtaaagatttcttatacgagctactctttccattgccaaagccaaattagctggcggaaaggtgagttggacaagtgaggtgtttctgttgcatgtggaatctcaacagaacagtagtggccagcaatttctgtacatatttactcttggaaagtgcttctccatgttatcttatcaagaagctcacctaatcaaaggtaaacacatttatcgcctcattaaggcttgttttatggccacttcgatgtcatgtttgaggtagaagtacctgtcacagtctttgtctggaatgtatgtaaaagggatttcatggacactgcagaggttttaatctttcaatatcaaaataatttaatgcataatatgtatttgagaagatgtcactggtgattcctacttgtgtactgtgtgtactgagttttgctgacacatttgctagagctgtcaaggtggaccaaatgaatggacagatgccaaaaaaacaattatgcttattaatgtacattgattgcttgtttaggttataaaacaaattaaaaaaaaccattagtatttaaacccttttatagctgagctaatgattgcttgtaatatagtgtctggtaaagaatattctataatacctgtaaagcccagctatgttatctaattagtagactttgatttaagtggctgtaattatggaattgaatagttgcctttctaaataaccaaatggtagatttaaatatataaagatgttgacttgattatttaatatttgtagcaaagacaaaccacctaaatagagagattaattccacatcagtgcaacattaaaagggagagaggatgccaagaatcccattaatttgggatataagtgtctgaaatttcctcaaaacatttacgccaaggaataccaacaagacaatatcaagcagctctccctaaggatagagaggtaaggcaaacatgattttaaactgcacaatatcacacagtaaaattaaggacaatgtgttccaccagatgctaaacacagccatttatcgagctacaaggttctagactaagtaagtgttttgtatacatattagctccatattacctccatgacctctttccccatgaagccttccctgagcctcagtatccactctttcctgtaccatgaatccatttttcttttactttttcttttctttctttcttttctctctctctcgcttgctctttctttctttctctctctgtctttctttttttgttttttgttttttgttttttgttttttgagacagggtctcactctggcacccaggctggagtgcagtggcacaatcatggttcactgcagccttgacctcacaggctcaaaccatcctcctgcattagcctcccaagtagcttggaccacaggcatgcaccaccatgcccagataatttttttttttattttttgtagagacggggtctcactatgtcacccaaactggtcttgaattcctgggctcaagtgattctcccacctcagcctcccaaagtgctgggattacaagtgtgagccactgcacccagcccatgttttcaataaagatggtgctatttgaaactatggcatgtcacgtgtatattattttatttcaccatgtgtttaaatgagataaccaggtgccaagaaagcttcaatatttgcttaaatagccaatgtgacggagaataggtaacctcttttctttttttttcttatgatttgctttggctattagttttgaaacatacatgttatattcccaattagatctcgttacatccttcacaggctgtccaaaaatttccatacttctaacaagaacttcggttgactgagtttatattatatagtttttctgtcctttgccctatttctttcaaggcctttgagtcagaagcattcagcaccacggcgtacgatagccaccatttgctttgcccttttaactttgggggttacttctgaccatagtccaactgctcagaagggctttttcacaaattgtttaccgtggcagttgctaccctattggggtttgcattcagaacccataagcagagagcaatggtgtcagtataacaaataatgtgtacaattttttaaaatgctgaatttaccaaatccccatattatgttttcacactgctctttcagaaactgtgctaatacaatactcctataaactgatcttggtcctggcaggccctgttggaactaatggggcctgacagttcttcagttaaaaattatacatgagggccactttcccttaaattatctattgtatgccagctgttcacaactgcactgcttcactttctttgcagtgctagaaatgtctaattttctcataatatccatagcaactattctcatggagggcattgaagttagtaagacttcaaacacaccttcacagaaatcatgctagagttgcagtttccattttctttaattttttggttctgaaaaatgtttagatggctcattttgccggtttcatgccatagcacttgagttatatcataatttctcatttgctgcacaactttattctatttttatgctcctaaatgacgcagctctaagtacccgtgagtggcacttccgtgctgtgagtgctatcaaaggcaacctcagatggataaaactcctggttttttgttttcttttgttttttgttttgtttttgttttgtttttgctggggaggggagaagcggagtcatcaccaagggccttcttttgtttttcaggcatgttaaaactgtataaccaacagaaccatttaaaaggaagaaaaacatcacccaagttccgtgtctgaatgaaggctgtcttctcaaatgctcctcattactccagagcagttatatttggattataattaaaacgaggcttcttttttttcttttattcttcttttttcccagaatgcctcaagtgaagtattcctcccaaagttattgcacctctttactaacaagtgctgggattttaataagcctgtcccccctccttaccctgtacagaggaaaggatggcaaagagtggctgtggtacaaaggttacatattcagtgatattttctgcttttattggtaaaaatggggaggtgggtggaggatttcctttaattatgaaataagtgtgatgttagtagttatttctgtaacctggtgaaaatgctgcatatttcaggcctaatttttagcatatgttaccacgtgtgtaataaaacggtgatctgcgctctccgaatcttttggctgttaaggagcactctgattataactagttgctgtagaaacctggtcatccagatgcttatcaagaatgcattattattttttaaaccttggtggagaagccacagactgcagcagttggacaaggtcacatatcgatggaagtgacatgtctttcctctttccattgtgtgatcgtccagggcctgggggcattaatatgcaacggttctgtttttctttcagaaggacttgtaaactctttaaacagaggcacacagttgcaattgttgcggtactgagtgggtgtatagaagctagggctgcagccttgtccagttgcagatagaataaaactgacaatgatgcaatgggcctggcatgtagacaactctgtgggatggatgaatggtgcggctctcgctgtccctccggtggtggtaggccctgtaatagctagcgtaggaagggtggtgaaaattgatatgcactattactacacgtataaaacttaacactggggccattgcacaggtggggggttcctgtttattgatttttatgagtttgttagaacatgcgcttaatgcttttatactccgggagctctgggagggctcaccttaggtaataaacctttccgtactttgcaatcgctcacaatttacatggggactcacattatccagtacaaagcccagcattccccttctacttggttttaggagtgtgataaaaaaaaaaaaagaaaaagaaaagaaaataactatagcacttactttgaattttttgaaaacctgtccactcccgctatgaaaatggcccctaattctaattactcatatttccaagaaaaattagtcacacaaacttatgttatgtgttgtctcagaggttgaaagcaaatcaggtttccaataagacagtacatcaaacaaagtagcatgttcttgatgccgatgacttttttttagaattatggttggacatttttggcagacagattgtcttttgctctatcaaaatgacagtttcttttgtaactgcaacattcataattagaaggagagaagcaatctgcccaatttaatatactaaaagaagtttagagtctctgctagtaatttcattatttttaaatttgaattaattgacttaaaataatacagttaagaagtataaccagcaggattatggagaaaggtttctttttccttaaaaaaaaacagtgctctcagtgttacacttaagatgagattgaaattttcttttttacgccaggtgccccgttctaagattcagagcagcaatgtgaatattcatccttgcagtggagctgagagaagttgtagggcaaatcctgggaacaaggtcactttaaacaaaaaagttctccaagtttcccatgcttataaggctggctgggcttaattaaagtcaatggatgaccaaaaaataaataaataaatagagagagagagaaagaaaagaaaatgaaagaacaaccacccaccccatatcagtctctttctaggcctcacttcacattgtataccttagccgttgatgttcaagctctttacatagatcaagaataatatttcttaaatcccttaacaacactgacgtgtccatggtttaatcactcttccccagtccacatctctaacctacgtcacttgggtggccctcacccacagcaccacaacaaaaacaaagccagaattgcattcagaatgaaatcatcataacatagcaaccttgttcaggatgtgacctttgggtttcagcaaccctgtcttatgcagccctggccaaccttaacctttcctgttggctcggagggtaacctttcttcatattttcttcaggatctctccttacgggacccagtatgttgcatgcctatgatgcacagggccaaaagtttcggagtgttaaaatctacgagcctgttttcctctatgagagaatgaagcctgcactcattttaaagaatacatacgtagcaagatctctttttacccttcctgtataattttggttatgcttaactctaaaggaaaccaattctctttagctctgttaccttatttcgtaccttagctgattgtcatctttacatgagcatcagatatggatgtgacaaagattttttagaaataataacgaccagtgctttatgagttgtgaagtgtttttctctcccacaagaaattacaacacaaagtgccctatgcatttttttagtatgttgataagacagcaggaaattttttaaccctcaaaactttctgattataagctgtgctctaaatttacacgggcagtgttccaagtcccacactcctttacaagtatatcattacagacctgcaagtgagaaggtaaatttccccatggcagttctgaaatctgacttcaggctaagaggccatggactgagagggctgattgtgctgggtacctacatatcaaaatctcctctagtattttagtagttccttctgtcctttttgcagccccgtgtcctacagaagtgacattttgttccattttcatttatcttactctccttagttgtatatcaaaagatatacacatttatataacccaagaagccagggattaaagcacaatatttcttaacacagcttcctctaagatctccagtagctacctaatgcttaaagcttgggctgacgtgggttatggggttatagtagctttatagatatttctatttgtgtatgctatgtttatatatgtaatacatatatgtgtggcttagggctatactgacatgttattttctatgtgttcatttattataaacagcaggcaagcagacgtttcacctcacacctcactctggtctctatcattcaaaaaatattgcaagattcccattctaaattaaatacatccgagcttacgtcttttatcaattctttattcttggtatctcaaaattctggtcttcgtcctttgtctcaaaaagggaaactgctgaaagcatttccacctggatgtttaaattatttaagttgcaggaaccagaccttttccctcctgagtagttgtgggttttaaaggctaaaattgcttcatcatgccaaagtgaaagtatgcataaattatttagttaaacctgagaaaatacagacttttcccagtgatctttcaagggctgcctacttaaatttcagaagaatgggcaagatttttttttcattctcttagaaaattgaagtatctcttgtgtcttctgtcagttggaatgtgaacaaaattacaaaatggtaatttttttaaaattccaagcttcataatatccagtatatctatatcattccaaggtgaatactgtgataatcaatcaataccaggaagactcctccagctggcgagaactgcaaaccctctctcaatgtattcttaggaaaatcaggcaacttgttataggtctttccctagtgccaacctaaagactggggggcatttccgattcaatttctagtcatccagagttggtatttcagttttaaaagtagaaagttaggtaattttaagatgttatgaaaactttgttgacatttttaatttgctttttaaatttacctttacttcagtaaataaaaataccagaaaagtgtgaagttgtgtggtggtggtggtggttggggtgtgtgtgtgtttgtgtgtgtatgtgtgtgtataagatagataatattaaagtagcaatgaaaacagcccagaaatataggcaattgaggcccaatttcaagtttctgtagcataaggcatgtatattacagaatgtaccacattatgtatctgatctctaaattcgccttagtataaatgctccaagtacattcttatgaccaagaaaagaatggtatttttaattgaatacctaacctcaaatcctgaaagaaacattaattgggacaggacaaaatgtcaacaaaaaagtacttatgtgagttatttagtatacagctgtctgttcatttgtagaatccatttgaattttatgttcagagaaattgggagatgagagtaaatatggggggagattggcatgtaaatttgttgagttttcatgaaaaaataaaaatttaaaaaaccttccaagcaaaataaaacctgttccattcacaaatgatggatgtcactgatcccattaatacctgttacataccaggtcctcttccttatatctaacttgctttttctcccaatttcagtgtagttgctcttgaccttgcctttgttcttctctcctccttctctcttctgcccaggcacagttatgtccactaaaccagatgaacaagatttcatactgacaccaccatactctgttaaatagttaaaaatcctattttggcttttgtttgctcacttagatttgtacacccaaggtgatgaagagagcacagatagaatctagagacaaatagtttctggagtcaggaatcagatccagattctaacacgaggtgatgtgggaaaaagtcagttaaaatttctgagattcaatttactcatctataaaatcatcctcataataattgctccccccttcaaaggtttgttatgaggagcaagtggaaaaatgtctattaacgggctctgctgtcagtagattaatgcataaatccaggtattattatataatcaaactgtccttttaaatgtagaagaaaagggtttttaaggcacacatgagattctggaaacgtagacgttatagaaagtctatagggactaaaaatgcattgtcttctatatgcatttatcttgccagaggtacatgcagacctttggggggtgctgctctggccaggacagtggtggagagctctgactcttgagtgtgagagctggaacgattgagaaaagacaggagggaaacttcgaggtcaggtgacttctttctaactacagcaggttctcagatccctaggctggcccaagatgagagaacagtcaccaaagagagtctggcacagtaagcctaagtctcagtgtcatctgattgtgaaatctgcttgtttgcatactcatacagtaccagagcttaagccctggccactgtacggatgactgtacaagagcagaatctaagaccaaggggttgtttttactaaggaagaaaaatttattagagttacttcaaggaaatctattagattatctcaccaaatacattaatagcatcaattattgtattttacataattttttttacaccagatacacagtatattaaagaatttgtggaagtcccccatgtgaaccagtattaaccatgataagagtaatcaggactggcccaagaaaggtagaaatgagaatttataaacttgtctaattctcattgcttgaagaaaattgaaatgaaagaatccaaaaagggatttatgaatattttttaaagcttaaaaagcccacatacttatcatcgaattgtctgcttacgataggagctggaagagtcccttatatccactcaactgtacttacattttaaatggttgttttcctttctcttacactactacaagagaaaggaaatgcctaggcaaataaactcagttaaaataactttatggttgtgacacagtttgacaaaagcaaaggaaattcagagtcactgctcacactgtatcctcagctgattccaactgtggaaaataaaatgctttaaaaaaaaaaaacaatggaacaaacttgggatggatttagtcttagtcttagaggcagccttcttaaatgctgaatctctgagttcgccatctttaagttcttataagagttgcaatatctgtattcatcataaatctagtcagagttaaagaagagtatttggttaagtactgcttggaaaatatgttgtccttttttaagattatgtgattctaactcaaagctgtaacttcttgggggttaataacctaccttgagatatactttaagtaataataatggcttcttgggattaggaaagatattaaacttacccatttccaacgatcctgtactattgcaggagagatgtggggagggagagaaagagaaagagagagagacgagagaaacattttgaccaaaattccatattcactattgctatgcaaattataaacctaacagagaggtgatgtatcatttttattaaacttatgctgcacaaatagtgtttacatagaagagtataaagttaattccctcccgggaagcatttctaaaaaatataaattgtattttgagagttaatcaatttgttttttctcttttggcattttaattgaagcttccaaaccgtatgcttcctcaaagtatcagaaggcaaatatcagtcgtgtggttataaaatcaactcttaattttctttcaatgaagtagcagatagtcagcctgtaaattttacctacattactatggagctgcagtgctataaattcaaaacagtgtgcaggttggtggaaattgaggtccaggcagcaaggcatgtccataaacttttctcaggttattggaacagaacgaatcaaaagcggttcctggttgtatgatattctcttttgatagagcaggctgcttgttgttagcaatccaagtgcagaggttagtcagagcagaatgtaatttctagcaatctgacagacctgcggattgaagcggcaggttttcccttccgatttcagggaattgcttcttactgtgacaaatgattagctgttatctctgactgaatttgatttctacaagcagctgagtcaggtaactttgcagcgtttgagggggttttttacaggaaatgaaatcggctccctagtcatatgtggaccaaatgaaatcttctctgtcagggcaaaattgtgcttttggttaattgaaggcagatttagcatagagggtgtgtgtggtgatgtgtgtgcagggtgtgtgtgtgtgatgctctgatggtgtaggcaggcacacccatgtgtgtacatttacaggaacgagggatcatttcatggattctctcccaactttgaaaatcctgggttcaaacaaaatccctacattctgagcagggttgaagcttttagaataaactataagtggagacagtcatgtgggtgtcagaataatgagccttcatataaggacatcctgtttcaaaagagtttgaactgcaatattaatcaaaacacaatagatactcactgagcatggttttcacaaaagtattcatcaaagggcagctgcattcaaagcaagagatttaggtaaaataagttaatccttgatctcatccaggtttgtgtgtaaattttgaatagggaggggttctagtgatagcaagcgtcctctggatgataaaacaaaaaacgtggcatgggaaattccaggtttatcttgtgcttcttgttcgcttttgatggaatcttaatagtgactacacaattaggatcaggtttatccttctgtttatagtttgtaattgctctggaaatcctgagtttcagtagttcaacttttagtttttaagcagtcggtgagttttttaaaaagttactatcggataatgtttcatagtttctaatcctattacagcaatgtaaaataaactgtatttcccaaatacgaagcaacatcttttattcccagacctcttactttgcaaagaggaaacaccatctttaaggtcatactagtaatactccttattttgtgatgaacataatatactttgtttataaatcctagtttaaaacaacagagatttgtggtaattgacgaagagtaaaaaagtcacaaatactgaatcttcatttttcagatgtgagcacaacattcctaggtatgtactaatatattctaacacggcattgcgctgtcatcaagacttttgtctaaatgtcaccactattatgagcaatacttttgctaaattctttagttgtattccctaaatggcagatacctttggacctctctctcattagctattaaaaagaatagttctttgaaaataacagttctgtgctccctaaacttcttttgttttttgttgagtgatgtcaacttagagttccacactgattgcccttcctccttgctttgtcgccacaaaaggggtgagggggtgccggagtttgacccacacctctggttagtattaatcacacagacatcaggtaatcacctaagtgcactcagacatactaatagaatgatttacagaccaggccctttgtgtttttctaaatctcattttaatttatttaaagtgacagtgaagctagactccaagctaatgagtctgcataaaaatgatttctttttccacctttgtgtttgctaaaactttctgactctgaaatcctgtcagtgaaaaattatttgagatgaaacactgcaaaagaaggtaaggggaaaggagacaaagaatatgatttgatcatcagagacctgccctgggtccaagtgggcctcatggtagccacaagtgtccagatcagacaaatggggacttttgcatatatgttttagtgcttcatccagacttgagtgcttcacagagtctgtgaggcaactcacatcctttggtagctaacaaattggtcctttctgaccagcaagcagtttaagaaagctaagctgtgttgtatgcgtattaaatatagcacgaactgcttggctttgcttaaccttagttgtattaacagattgtttgttttgatgactgcgccgttagcatgccagatgataaggaaatggttttggattagttaggacctataatatagaaactaaataagatgatagacttacaaggatatacatttcctgtaaaaaaaaatgaattcccttatcaggatttacttgaaaggaatatgtcttattacagaaggagaatgccttgaggaatgtgggaaagattaaaggcttttgtcagtagtttaggttgggaccaggtttcctgtgtagccagcccccctgtccccacgtaaatgttttgcttttcctcctctctctctttctctttaaggggaagagtaagcccttctcgctgcctggcggtgtcagattaaataccgagatggcgacaggaaaaaggctggaaggaaaaacaaaagacaggggggtgagagttatcaggttggcgacggaactgcaggcttgtcggactccaatttacagaaatccaaacagattttagttgacacgatctgcaatcattaccgccggagcagagctaattaagaaattagctttcctgattgcctgttctcacagtgatgagtagttgaataatgttgtatggctgaaatgttctaaaaccagacagtttaacaagtgtttagccttttgtggtgatgctgtatttactttatctataatatctgtgctgcatcactatttgtttcctctccttagaagcaccccttgactttttttttccttttccttggttcaccctcttcttcttggcattaagtcagagcttccccccttacttcagccgcgtataggagagaattatcatacagatttgtggcatgtggtacagaaaagttatcggaaacttgtggcacattcaaaagcatatttcctacccgtctaggcatttttcacaagaaaatatcaggtccaaagtggcatttgaagtttctgaatctgactaaatgcagaggtgattgtgaataaataacattaaaaggctttagtcagcaaagatacagtacgagtgagtggagctcattagaaactagccgtggaccccagatatgtcaaaggggggtttgctgagaggtgaccacgcagtcttcataacttcctcatctctcccacaactatcaaacacataggaagatgttatttggagaaaaaaaatagttatgtttaaaaagcttgacaaagaaattaatcaaaatgagcttcatggaccttgtaaaatatggtccaggcacatgtaatgcatatgtaataggcatgcgtaccgatgtgtccatatggacaaatagaaaacccaagagttaaaagtttctgcaaaaagacaacaacttctttccaaattaaatagaaggcttatttgaatataaactttctcgcaatacagcaaaataacaaagattggacaaaggtttccaggtgtcactgttgaaactgcaatgggaggtaagagtattgctagcttcccaaatgaaccacagaaggggaagttgcatcattcaagatgcttatcctttaggatttccaagttttaaaatgtaaatattcatctatggaaaaaccaaaatttccaagttttcctagtacaccttcaaatcatttctacacctaagaaaaataaatactaatttttcttaatgaggcctaataacacctttaacttaccattttaagagacgctaagtcaatacaatgtgcaggtcccttctggatatttattttcctaagcacaaattcatttataccgaaaaaacagtggatgaaatactagaaaaatcttttctgcactggacctctcttttccagatttacctaagagaatcttaccaggaatggagatagacttttacttcctaagtagatttaaatttaacaccaatttattcactctagtatttctatatgggaactaacagcttctataggacctctacaaagtgccagaaatatgatctcatgtgtagtaataaatttaaatgtgttttcttttacatattctatccctccgtattttcccaatctcttccttttttatgactcccccactctcagtttctaaaatcacttgtccactccggagacccaggggcactgcctagagaaggagctaactttaaaaaaaataaaccaggctggtcacagtggctgatgcctgtaatcccagcgctttgggaggccaaggcaggcggatcacctgaggtcaggagtttgagaccagcctggccaacacatggtgaaaccccatctctactaagaatacaaaaattaaccaggcgtggtggtgggcgcctgtaatcccagctactcgggaagctgaggcaggagaattgcttgaacccgggaggcggaggttgcagtgaaccaaggtcatgccactgcactccagcctgggtgactgagtgagactccagctcaaaaacaaaacaaaacaaaaaaagcaccatactcagagctgctataagtaacatgcagttgtaagccacacacttctttgcatgattcttattttaaagattggaaagtagaattcgtatttgtttgttgtactaattccagtggtatacctggaattaataaatggtactaagacactaaggcgttactttcttgcattattctaaatcagagtgttgattagagagaataatccaaaggtaaaatagtcagataatttatttttatgtaagtttaaaaagagaaagagattgatttttttgaagagttataattacattcagtatgtaccttttgtgcattgaaataattttagattttctgaaaaggaaatattgatgtaattcagctctcaaaacacttgatgccatgcctttcttcctagtgtttatgtaaaagcaagtggtcaattgtcgctgcatcagagctatgacaagttcttctatattaggtgggcatcactcaaacacttttccatagtagatccagtggtatacctggaattaatacaatttattaagtactaagctatgttgtatttattgtattaattccagtggtaatacaattccagtggtaatacaatgtattaattccaggtatacctaccactggaattaatacaataaatacaacatagcttactactcaagtctattacacgccatctaaaatagctaatcagaaaggctgtatgtctgaaacacccaaaagtcactcatcctctttcttaaagcattaaaagttttggcaacttttctgaatccgagttgtgtgagtcctatactgtactaagctggacatcttaagggctgcaggttttaatatttacactgccccgactcagttggtaaccgctagcaaatcatctcaccccagtttttgtccttttcctgaagaaagctgaatttggtttcatgatcactgtttgctgaagaagacagtcccaacaatggtccaaagcaaggccagcttttaaaacagccaccaactctgagtcaaggcatctaccttcattctaatcaagaagggaagatacaaagtttcaagaccagtcttcaccttgcactgaatctgacggggtcttactcagccactttccactacctttcaacctaaaagccaagaaaagcaaggatttggattttaaagctgtacttgttataggtgttcatgggttttgttagcattgttgttttttagggatgaggggtgttactggagtggaagggggagctgtgttgcttttagtttgtcatttaggatgttaaagttagtatgggtttcagtttgcattttaaaaattagaatggtaatgagcaaggtgccagaaggaaataacaaagcacattttcctgaatagctccccctgtcttctgtgttcagattctactctgacttcccaacccggcttcctctcccgcctgctcccttctgaggtgcagtgtagaagttcattctcaggtttctctcagtttgcaggacgagatgctgccggccaggccaagggcagttatgccagctcagtgtagtgcagcttccttgccccagcgtgcgcaggctgaaagctcagccagtttctctttctgaggctgcttcacgtcttctcagggatttccaaggcacggacgttcatttgcctaaaactctcttaaactgcctgacaaaaaaaataagtacctaagtacgacataagtggtacacccacgcaggataattaggattgatgtgctcttttagaggcaccagatcctcaacctccccttactagtggcatttctcacctgctcatgtggtgcccacctgtggcttgctggcattgccactgcctgcgagtggggagatttccaagttcaaaatgaaggcctgattttacatggtggaacgctgtaggactgtgtggagctctgtgaaggaattaaggatggcatgaagtcctagtttatgtcactgctcccttgtttatgttctttccttgactattcccacgccccctctccagattttgcatggcttttatagcctctagtaattatatcagcagcatggagtctatttttatctcttctgaatgtgtgcaacgtaaatgtcaaaaaccataaaggccctttttagcatgtaccttgcatgcacagtttgaaaagtgtgatgcagcgttcagagagatgttgcattttgaggtgagacagatgaaaagtggaaaactcaatttcaccacttagctgcgtgaactttcagtaagtcctttatcatcttgaacgtttagcattttcttctgtaaaatggagtccggctgcctacctcatagggtggcagcatggaacctagtttagtgtctgggatgccccctttccacagcaggtgcccccaaactcctaaattatatatttcatgcttaaatgtcatgacctttcaatgccctgcattgccctttatccaacttagaaacggagtaaaaataaaatcttaccactgtaagtcacaataggattgtcacaaaattagcatgtgaaagaatgatacggaactcactgtcaccaaaaaactgtccctagacttggctaataattataataatacctagcatttattactaagcactttctgggagctggtctctaggtgctttacatgtaaccttcacaaccatccactgacccagtggatagatattcttgtcctccacttaataaaggaggacatggaggcaggttagataacttaacaaaagtcacaagttaggaagttagtcagctggattcaaattgaagcatcctgatcccagaacctacagaaatataaaatgtctatcaggcaggagcattcacatggctgagctgccccagcttctaggcaaggttgtttcctctctttgcacttcctatttgaagttgggccctgaaagcggctagatgggcccgtcagaagggcatgcgaagctgcagtcccttactcagctacgagttagggaccatcatgcttcaaaggggaaatggcctcagcatgtttaggtagtccagtaccatggtacagtttttatggctcattaatttatctttaattgaagataagttgggagaatttagagttgtgagaaaatgtgttgttttctagtcaaaaattctcctgtagttgtgatgaatggacaagatgggagtaactgggggatgtggtaagggataataataaataataaagagcatatttgtaggccctcaacaaaatctagtgatggaaggaagaacatatataggcatgttagacatatgagaaatatcataatacattttatgggtaagctaagaagaaccagttatgcaaattttctctacttttttatgaactacttattgattaccccagtcatttttccattgctaccactgcataaagcagaggaagccagtgcagtcagaaccctcttatttatacagtaaaggctattaccgaccaagtacttagcagccagagaaatcttgcgtgtaaaacagaactgggatctgaagaacttagaatatgtcatttaaagaaatatgatcactggtatgtactaaagtgctccaactttttaaaaactttaaaatcagttgactgaaatttacagttattaaacttaattcttttttttttttttttttgaaacagtgtctcactctgtcacccaggctggagtgccgtggcgcgatctcagctcactgcaacctccatctcttgggttcaagcaattctcccacctcagcctccccagtagttgggactacaggtgcaggccaccatgcccggctaatttttgtaatttttggtagagatggggtttcaccatgttggccaggctggtctcgaactcctgacctcaggtaatccgcctgcctcagcctcccaaagtgctgggattacaggtgtgagccaccgcgtccagccaattgttagtctttggtacggtgcccatgagtcatcaaactcatatgtggaagtttttgaaagaagaaaaaaaaatgagagtagattgattaatgactattaaaaatagcctgggatctacgaatacccatagtaaagagcaccaggcactggatagataattggtctaaagagcctggaccttgctgaagataatatatacatgtaacatgttttgtgaaaatggagtcctgaagatgaaaggtgtatcttttccatattgactacgtgacttaattgctcacttactaggctgagaaaggggagcagaggggatgtggagagggaagaaggagggaaggaaggaaagaaggaaggaaggatagagggaggaagcaaggaagggagggagaaaagaagggaggaaggaaggatgtggaaggacggaaagaggggaaaggatgattcaatatcctttgactactaacatatggcctatttggggaagtagacgatggtgcatggagtctcctgaaagcatcatatgaatgtttgaaaatgttattgcccacacagtgcaagtgcatttaggtatgttttaagataggtgggctaactctgaactagggattcccaagtttaactgccttatgaaggttagaatttgagcacttaagttcagggaaggaaggaaggaagggggagagagaagaagggagacggcactgcaggtagagtatccccacatgtcttacctcttctgaaaggctgatgcaacaaatgcgactgaaaagccaaagtatggatacgttttcaatttatttctaaagagttcaatttaataactgtctgagactgaaaccattgacacagcagagcttctagtaattataattctgagattccccaaagtggaaagtcctaggaatactgcctgaaatgacagtgcatttgctgttcaggtaaaattctttaggaattttctctgattctgatttctatttctaaaattttcgatcatcttcaccattttcccccaaaaaatgaggggtgcatttctgtcattttgtgtgtggttgggtggtattgttgcgtctcagttaggggttgtgaaatggaagctctggagggaggaaaggcattcttggtttgcaactgagagcaaaaggtaccacctaagcatcttctgtgagactagggtgcttcctttagataaatgtgtatctgtaatcagcttaactaagcaggtaaggtgttcattagctaggcagggttttcaaagagagagagagggagagtgagaggaagagagagagaatgaatgtggaagagtgagaagaacaaacaagtcaaagcatttgttcatgctgcaatctacacatcaattatcccgctgtgctaattaccacctttccataccccaggtacctaagcattcacacttactcactttcatgcctctgatcaaaaaaaaaaaaaaaaaaaaagaggaggaaagaaatgatagaagcaggggatgatgaacccagaggagaaatacattcttagatcaaaatttcctttacatatgaaagtataaataaggggtcttctccatcttgccattgttgttttagacaattaaatatttgcaaatgttttaattgcaaaatattacttactgtcaggcttccaggagtgcttccatctcatcagcccttgtttccatacttaaaagaagacagagaggtgagaattgctggtcttgcctgagattttggggttgtgccattagaatgagatcagatcattaaaagtcagtgactactaattatcaggctacttttctgaggctattcaagaattgggcagtgaggagccagagagctacctttgtatcaaaaccttggtgttccccctcaccgactgaaccttcatctaacaattaaacattctttattatgatgaaatctgggcttggaatccctgttggtttgtgggcttccttgtcagggtgctcattttctcatttcagagtgaagttggataaaaagaaaacctatttcctgtagctcatttgatacctggtggggatgctattcaggtgacaaggatacaggcacagagggggaacagatgtgatttacacactcattatcatttgaatgaaagtgcagataggcctgttcaggggcctgggcatcacctggacagctttccttctgatctttatcccatctgagaggccaggtccccctgacatctttaaatccccgacccccagctggtgacacacagagttttatgacagtcagcagtcctctgaagctccaagcacagatgccattcagaattgtgcttcacactgtttttttcattgtgttcaggcttaatcaggaatatatccaaaaaaagcttaacttgaataatttcttttggtacttctccagaaacctgtttgccactcgaagtttgtgtatagtattctaaagggcctcagattttgtgttcttaaagttatgtgcatacgtagctgcttcagctttcgaaaaaggacaacaaaatggaaaggaccataagttatagatgtcatcaaagtcttatgtttctacgactatcagatcagatgagcttagtattgtggtagatgcagtcagaatgttagagtgcaaagacaatagaaagtttggatgaagctaccaaaaagaaaagtttctgtttggcctcttttgctcttcataaaggattttcagcgtctttgttttgctacctggaatggctgctgtcaccatgatctctcaagcattttgttacttatttgtgggatgtgtgaataacatggaaaaattgctatgtcatctgaagacctcaaatgatgagtcctgaacagtacaaactgtttttttttttttaaatacattttcaagaaagcttgctttcgttcaggacaagaatgcacaacaaccttgaataactttgtttttaaccttcccttatctcaggcagcctgacagttttggtggggagcgaaaagtgaaaggaatctgtgagaacaaatactgtggtgtttcatgattttaattaggtattgtattaaagagaaaaatataatgaacacaagcacatacacattttatttcccatctaacattaacagttaaagaaaacaatcactatcaaattactttgttacagtccataattacaactcaggttacgcttaactgttattaacagaatgtacagtaatatgttctggcatcgtaatatgttattgtagcattataattaatcttacaggaagtataataaatttacagtatcagattgaagcaatactgcatatagatttattaatgcttttaatcagttctggcaaaattaattttgcactgattgcttacattggaatttgcatatacttagtgaaagtaatttattttttatggattcctttttattaaaatagggcatatggccctttagctaaaaaactttgtggattctttagctaaaaacatttctaaacattttgaaatgccatatatcttccctttaagataattctttctcttaagatttatttttaaattatattctttaaaatacttttttaactcttatttcaatgatctattttttgaaactgtaatatttatttccctattgtcattagcctacttttccccaaggatctaagtttgaataaaaacacaggccttgaaaaatatctacattgataagggactgcattaacatttcagaaagtgtcatgtgaaaattaaatatcattgaaaaataatgaaattttactctttgaaaagtccagtaaaaatgggacagcacatgagaattttgccattatttctaagtgcaactatgttacaatactccaaaatgctttctgtgccacgcaatgtatgtgcagaaaaaaggcgagtgcagattttttaaaaaaacttaaactgatatcagtgttgtaagttcaaaaatagtattgagaaaaatatacctaaagtgtctttctattaaaatatacatgctttgtaaggaaaggtaaattattcaccaaaaaaaatcaagatgtcttcataaaatatatgtttactatatcttaacttgtcaggcaatttgaaattttgaataaactcatcacttaaatctttattttacctctttcaaaaatagtaaattaggtgttcctgtaggtattgattaatttattttgcaaaaaatatttgaagaataagggaagagtgatttcttattcttataagtcttaacaataaatatgttccttggcttgaaaattgagtgagcctaacagtacatagctttcttttcctatgttagtgagttacattatgtaaagcatattcatgaacttatatagattctgggtagttctgatgatatgaaactaaattttttaaataatttaactgaatattttgatattgcttgtatcaggaatttcttcactaaaagagcatatatgcaacagtgtgacctctttgggctcaatacaaaagtgatttgtacagtgattctgtgattttccaccataataaattgagaaaggcaggtcttggtaaaactttatagtcatgtatgaatacccatattcaggtcttcacctccaagagacattcattttaatttatgtcgttgtttatcatcaaggaagattttgaacttttgagaattggcctttatctgtcctaaacctctaacattccactgtatcttaatgaaacggaggttctgttctttctgcccagggcttctgataagtgtttgcagactatgtaaacttctgaataataactttcagtaaggcaggagtcttaaacctcttagtatcattttgtgcagtattattctgctctgtaagataatgtgttatcaatacttcataagataactttggccagagaatgaataaaatttatagtcactttcaaactgctccctttttttagggtgtgggtcatagatcatgcagctgtctgccaacagataatcttgatgagtaaaaagaagctaacagagaaaaaggtggcttagtctaaaacacttaggaaggacttaaaaaattatttcccaaagaattagggagtaaaaaaattgtaagtacatttgtttacagtaaaagagtggtctctttgtttgaggaattttccttgccacctcagaaagtgaaaatttactccttttttttttttttttttagaaaattaatgctggtgtgattgtttaacttgtgtaacctgttccttgaggtaaaatgaggaagaagcatatgatttggcctctcttttcagtgaaggaaggaagtccatggaaattactgaaccaaactagagatctaaagcaaaagcccttttgtgacacagatgaactcaatagtgcactgtgactatctgacttttgccacgtccaggcttaggccgccaagcggccagggtcagcaaattccactacctgaaaatgacagaaggcggcagggaaggggaattgaggcatggggagaagcagttgaagcatactagggaggcatgaggttctctctctctctctctctctctctctctctctctctctctctcgtgcagctaaaggaagagaaggaaggaaaagagggtgatcattgaacgactttaggggcaagtctggagttaggcgctgtggtgtccaagcagagccgtgtctggtggcggcaaactagattgctccaagcatggagcgccctgcttgaggacacttgttgttggactgtttgtttacatgcagtttgggtggcaaaaaaaggggaaagtctgggtgacatcagctgcaagaagacttaaccatatgccgatgtcatccaacccccaattatttgaacattgtgaaggttaagacatcaatccatccatttttctttctcttactctgaatcgtgacattattttctctagttcattgaccttgttggcaatttacaccaccaatataagcctcaggatccttttgtaaaatgagacttgacactaaattagtcaactaaaaatttaaagggtaaagggtccccccagccacccactcctgcccctccctgtactaaagtagaaaatttggacaaggcacaccatgcgtgtgactcaattgttctggccaaaaaatgggatgaataattttatttcatagatgcttggtgattactggactttacaaaagttaaccactagttaaaaaaaaaaaaaaaaaaaaaaaaaaatatatatatatatatatatatatatatatactgcttttgggtactgaggttgaacaattggtcggggataattccataaaatggatttaagtatttaacaaataatgtaaatgtatagagcaggcctaaaatttctccactgcctttgagtatacctttagaagtttacaaatacatgaggataaagcagtttcaataaaatgatcaattgtacaaagtatagaaatataccaagcgtctcttaagtaaatgattacaacatttagaagtattcatgagtttgacatatgcaaagcagcctatctctcatgagtctgagttccagcctccctgaacctttgtgcatttcataggctggtgaacagcccaaacatgtaaataaatagccattcaaagtgcaagcatttttaaaagtttaaaactccacacaagttcttttacaaaagagtccacccttttatgtacctttaaaaacatttagccactttattcttttgtgtctttgaagagaaaaaaaattaataaagttgtaggatccttttgaatttagaaaatgttggcaatgttggaaagaaagacattcagcatttcaaagttctggtggggaaggaaaaaaaagattctgaataaaacaattttatgtgattttgcaggtggtttgagctatcattttatatgtacgtttgtaccactgctcattggaatgttcatataatactgacctaattatgcatagaaaaagataagccatttacttgattcatttcttctttttaaatcaagaaaggaacaaaaaggctcctattttctgaaagaaattgttcgcttttattgcagaaaagtagcagcttgtgcagagctagaactgtaacaattttatattccaaaggttttgtgtgtattcggttagttacagtaattatacccaataactgacagccaaaatcacgtaggagaaagcaaaggctgttttctcacacaggccctgctgcagaacatctgctgagagatttgcatattaattaacccatattaactctaattattctgggaaattatcaaataaattgaattttctaattttaacctttcttttacttgacgcgtgtcgaggctgagaggacgcaccaggccgtctcacctgggcaatgagcaaaagatcttttctaccccttttgctcctttagacctggggcagcctggggagcttttgtgtgccttgtgcttttttggcttctgtgcctggtagggtctccatgcatttgttgagagagggaacatgtgtgcttgtgagcacagatggtggatttatacaggggtgaggaaaggtggtacctcagaacagttgagcaaaccttaagtttttttttttttttttttttcttcctcccagcctgttgtttaggcctgagcaaataaatgggagtttaattcaattagagcctggctgtagtcagtgcctcatgacagaaattattcaatatttttcccctcacattgtttggtttacacatcactgactcccttccttttgtactctgtttagagtggccataatgtgttgagcttttgtgtctgccatgtcactgtccctttcaccgttgtctggttttgtcaattgtgaggtgcaatgatgctgttttgaaaacagggtcctagtcagggtgttgctatgtgagtagggtggctgcagttttaaacatactacacagtaaataatgtcattagcccaatagacctgaatctactgctaagccttaagagaaatcctttgggtagggaagtgaactttacatgcctttctcaggtattagatgtagcttaaaactgagatttcaaagataaatctggtcagggcagtatgaagaattggactccattgcatgatcccctttcaggcatttctttggggtaagaggcaagattgactgagattagaattttttgcatgtgatcaagtttgtaacgacccatactttaagccacagcgatcaggagaaagctactgatgaaacctctaccacaagcagatctccagcccccctacttcgagccacatctcttctaaagacctatgactctatttccccctcaatgatttcacttctccccatccactaagatctattaagatgagccacacctcttgctaccttgaaggtaattgttttcctctggaagagctgttctttcccattatttcagctgatggagtagaagcattacggtacctccatgtaacattccttagactcaagaattattattgacttcagtaaactgcagaaaaccaagaaagtcaccaaataggtctgttggatggacaaatatttgaaagcaattatttttatggataggctagaactccagtctcctttttcatggaagcatggaatgccttttgcaagaaaaatatttctttaagagacaagctgttgctacttcagatgaaggtatgggttcatgctaaggtttttgaggggaggtggtttaatttcgtgggactacaatagctaaaagtgtatttcagttatatctgtatcttagaaaaatgtacagttacagacaaggtttagggtggggcaactaaaacaatcagagaaaatttttatagtttttctatttcgtgtttattttttacagcacattccaacgtactctggcagttactgactttacaccttttatgggctttgaaagttgtgtaaccttttcagaggaaggtgatagacacaatatctatttacacaaggacacatttcccctttctttatattccgtttattcaaggttttatttccaaggtcttattactataaaacttaaagctagacaaggtctgccctcatgtcagataaaaaaaaataccaaaacaattttgatggctcagaagcttattttttcatacttccaggtcctaaataaattacagttattttcacattcctcttgaatatccttcaggcatgatagtgagcatattttttctgtaaagccccttaatactttccttctgatggtttgtatagagcaagttgttgaatgatcgtggattccaataattagagagagtcttctaaaatctttttttccttttgacatattgttggaagacatatagtcacttgatgtatttatgaaagtctgtggaattattggcagtagatgtacaatatatatgaaattatttgtgtatagcagttgttttgggggtcttccctcagcatgccatcatgctaggcttgctgatgaaggtgctgttagactttttagccatcaaagggcattattgacttgtgttctggaatatagctaagtattatgtccttggattgtaagcatattatagatgttgacagaaagtgaagctgaaaaaatttctaaaggatagaaataactacaaaaactcactaaatgaaaggagcggtcaggggcctgtatgtttgaaacatcaatacaatgactagtttcctttggtaggagttaagtaaggtaatcaaaaccattatgagtcctagatatacaggaaaacccgaatatgtttacttttgtaaaaaaataaacagatgtcaagtctttgggaaatcataaatttcactgagaacactgtgacctagaaataccgtgtcttcttgaaagaaagtgaatttactgttacaaattcttcgaccaatatctgtttttaggatagcttgacaaagggagggtccttgcttttattcttatttgccattatgtttatatttttgatattaaggaagaggtttggaggggaaaattacatatctaagatgttattacctgcatgttggagcctatccagaacctcaacaaatgtatggaaatttgaacctttttgaaaatcaccagcatactgaaatttgaaaacctctcccaggtaccagggaacctgctaatatttccagagggaatgagtggctgccatcttcccaagatgctcctgtaaccaggaagttggaggagcctcagaactggcctctctccactgcaaccatggcattgcagaaattctgctctcattttatttaatatgcgtatttttttacatagctaatctgaaatggaaacatttttatccctatactgagaactgcttttgttttatcagctgacattttacaactcattaatttataatgcaggtttaatgccttcgaatgttcctgggataaaaaattaaagtggccaagctagtttgtataaaggctgactatagtatgttaacaataattatttataacaatattttgtattggatagcacattccatctgaatatttcaaattggcatggtcccttctaactggcattaattcattcatcttgcatccccaagtaataaagttattcccatttttaaatggagaaatcaagattcatgcatttcagtgacagatgttcaaattcagaagaaaatctctgtttgagtttgtctttgccttgtaatacgtatttgtcactaggcctccattattaaataagaaattgaaccttgcatttagtcctatgatctttacccacccaagcacggaggtaacaaggtaactgtgatttaaaaaaaaaaaaaaagtcaatgataaatccccccggatgggcaagagtcactggacaaaaattattgaaaaatagctgcatcctctcctcagtagcacatacttggaaattgaaattttgtggggaagacaaggaggaataaaggctaaggttcaggagaaaagtcttagaaggtcttcccgacacttgccacatgtaaagacgttgtaagaaagcaggcccacaaggcctttaatccactggctcaaacataaatgatctctaagcatgtaagcataagagatttaggaaaccaaatgattcataaaattccaaaacacttcttttttttttttttttttaaagacagggtctcattctgttgcccaggctggagtgcagtggtgtgatcatagctcactacagcctcgacctcccaaactcaaacaatcctcctacctcaacctcctgagtgactgggactattggcatgcaacaccatacctgactgattttttatttcttgtagagatggggtcttgcccaggctgatcacaaactcctgacctcaagaaattctccctgcttggcctcccaaagtgttgggattacaggtgtgagccaccatacctggccaaaaggacttattttaaatttgaagtcatattaccagcagagacatttttaaaatgaggttacatgtctgtgtcacgtctaagctgaaggattaggcatggtctctctcatcatggccttcctacttgaggaagcatttgcaaataaatttctaagtgaagggccaacacaaaaattgtgactggcacaagttcaaatcttcctttttcctcgtagccaccacacattgcagcaccagagaaaagacaacagacactgaaacaatggtatttcagtgattataccagttacatcaccttgcatttccatgttactgttttatacatcacacagtgccattgcacatacaactttgtaggctcctatgacaacctcataaacagggaaccattatcatgatttttactcatttctaccaagcttccttggatgataggccaaggccacacagctggttacacgttggttctgggacaaggcaagtcttcaagctcataattctgtgaactgcctctttatctctattgtttccaaactattgcaggaaacatgggtgtattgttagattctggtaattgatcaaattggtaggcttctataactcaaattaaggggatccatgaaagtaacaatcatcaaaacaatttaaaattaagcaacaatctccatttttgtggcatgaaaatcccaaaaagtcccagggatttccatcccttactctggtcatgtggggtttaaacttagattgcattctgcactgggaatttgtattatcatgtatgtttttgtttggctgttgtacacctaaagacatgctttctggtaccggctttgctaccaactagctgtacggcctttgacaagccatttgacctcactgtgcctgtattacctcctttgtcaaagagttgacttcaagtgtccttctggaactacaattttgtgattatatttctccaaataaattgtaagcttcctgaggtgagaatggcacttccttctatcttctggatttgccacattgtgggtatttaataaatgtttgatgatggcattgaacgatttattggcacgcttgagtagagttataggaaatcattattggctgccttattaacaattagctgtctataagctgcatatgtaattttcctttacatcaatagagtttctgcttctggtgaagacgaagtattgccccttcacatcagttcttctgtatgttaatacattagcaactgatatcttatttgtactgtaactgacagaataatgtagagaaagcatataagtaggaaaaggggttagtaaggtaacattgtatagggcatcttcaaaacaacagttctgctatttcaaatgtcaagctaattatcagcaatgtttaaatgctatgataggccatttttgcaaatgctgaaattttccagcaggtatggacgttataaaaatgtcaaattttgctactattctattacatgtcaccagaacacaaaaatctgaaaataaaagttatatgtataggcaaggaagagaaaccattatttgttttgcatatgactgtaaaattaattggcatagtgatataatttagagtattgtttacttggaaggaagagtagagaggatttaatataatgtaatctggtgaagtgaaaataatgcttattatagataaactataaagccttttaaatataggcttttagtaatgcatatgcagatatatctttccaggcccatttgctataaagcaaatttaagtatcagctttatgccctttggtaaccccatattatacatacagttttagagaaaatgaaactttaatatgattccacataaaatggtgagccatgccagtaattcttatgcccttcatatgcaaatagttttatcttatccatcaattatcatgtaaacatagtatcacatggcaaatttccctgtaatacagtacagtacctgtatataattataggtgcattttgccaatgcaactgttacacagaattgtaattaattcctctgaagactactgtgagagttttggatactgatgctgtttttggacatttattactgctctttagttggctttttgctatgcctcagagacagatgtaaaattagtgtctattttgagccagcaaacagtacatctttcctcttgtttattgaattgcagaaaggaattctttgggctcccacttctttgtggttttgaagtaactgtctgtttttgtgccagccatgtagctccaatacatgtctaaaattttgctgagactcatgcaaagggtggcttatttgacctgtaaggactgaatagaactttgctacgttatatgggaacttccaggcttttaaatgctgaataaaaagatatatatcataagttcaaaaacagacactggcctaatatattctgcccaatgaacctcatttaaaaccagtatacgttggttattatacaaaattgaatctcttctttgcagagacaaagctacattattaagatctcttctgccagtggtgatgatggtgggcaaacatcaaaacaggtccaaatgggaaaatgagcttatttttatttcataatgtaagtgcggctaaacccatcaagtattggccattctagagtaagaatattttatggtgaaaatttccacagtacttgtactaggcaaatccactgactagacgtgagggaacattttaaaggaaaatcctgggatttagaagtcggggcatggggtagggatcaggaagtgcaaagtccatctcagtgcatttaattttgattgtcagatggtcaaccagaaagagcagaatgagattgtctcatttgaattcagatataaaaactatgttatgaattgttgtacctggatttaaaaaggggttgggagagtggcacaccagcataatggcatatggaaatgcatatcctagttaacacagcgctagaaaagatggcatactgcctctgtaagtgaatttgacagcagttatttatttagtttaaaagtatttactactatttgtgagcacaaaccctaaaggttgtgaagtattgttgtcctgtgaaggtgatggatgctgtactcctgaccctatatggtgagacatgacttcattgcttgtttagattgttctgatatttgggactcctcaagggctgttcataaatcatttatctctcttttttttccacaagaaaatatttcaattgtattgctgcaggaacactcacgtgtcacacgggatattgtggtccatgcagaaaaagaccttaaaaggcatgggtttttttttttttttttccaggataaaggccttttaatgcctgtccagccttagataattttattcactccttctggacctttctttattcctcctgtgcccagagatcagtttttaggaggtgggttgaaagcttcccaggccttaggagcttttgttgtagcccccccattcccactcccccctacccccagcattctgaaaatttgtaaagaatcttctgcttgttgctaagaaatagttaaatctcagtcaccaggaaaaaaaaaaagaagcacattattgattgtactaaggtatatctggaccacacagctagagcagagatgttagaatatctctctttttgtagatctgagggcattacccagcctgaacttgcctaagcccttgtggtcacacctcttgaaaaggttttgtttcccccgtcaattggtattcaaaccaggtcagcagattctgtttgcccggctccgctgccgttttcattttaatttgcacctgttgtgcagttgttcggaaggcaagtgcagacccgcggattatacaaagatcatattatgagcagatatgcacggtgtaatctttttgtccccagcttcacatgacaaaaaaaaaaaatctctctctttttgttccttttttactccctgggaacctgtcaaagcaaacagatatgactgactaaaatttgtaactagacatgtttccagaattctccaaaagcattatgaacctgacacacaatccttttcatttttttcctccttttctgccacttttgtataatccgatagctggcaagagccacttgagatagctcagttgataacttagcggaggattgctttattaggcgcagagaaatcaaaatgaacctgaaaattgtttgcgctttttttttccacagccttttttccccctttctctctccctcttgttcccatgatgtcatggttctaacttgtttttttgtgtgtgtttctggagagttgggttaacagttcttggcaatcctgtgtgtgcgtaacggctggtgtgtttctctagctgagctaatgccccgtgtttattactctaatctttcttgtctggtggtaaagtggacaatttatgtactagcatgtaggccgagagcctgtgagggctgactaattcagaaacagccaccttcaattgagttcacagaccttatttacaggctgtctattttaagaaaagctactgagcattgctgggactgagggctgcaaaagcagcccgccggttcttgtgagttattttaacatttgtgttggtcttgcctgtgtcactttgaaatcttctgtaattatgacactatgaagacatctcaatagtagtattaatggcccagaagatatggcttttcctcattttctgcttaaaagattaggatataaatggccttagcacatgacggttgacatagaagaaagagtgaaaattcagatggagcaggtttgtgtatgtgtttgtgtatttgggtaaatagatggacgtgtgtgtgtgtgtctactgtttctagggaaaaaaccacagttaatatagtgaagtcatctcgtatttatagtacaacattatatagtaaatacttcatgtctctaagctaataaaattgtctattgtagatctattttataagtttttgtggagtatcgaaagtacatattgcaatacgtctctttacatatgcagtataggcatagtttgtgtgtctatgtttctgttgctttttagaatttcccatcatttttaggaaaaaattgtttaaaatcagaaagagcacccagctataattgaaaaagaataaaaatgctaaaacctgaaggatattaattatattttcctgacatggttgagtaattcagttatgaaaatattaattattttccatttaactaaacaattaggggtggctgatgtttctcaacagagtgtttagagagtgtgttttgtgcttcttctgcagtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccaggtaagtgtctaaaatcacttggcctcttcctgtaccatcttcacatcttcaactaatctgttccacctagcagatcgcccacaaccaaataattaaaatatttctttccattgagcccttgcagaatagagataccaaagctggtgacagattatgaagtgatagtaatgttatcacattgcggcagttacatcttaggaagggattatatttcagttttgatgcaagtcaaacatgaaccacactttcaacacataacatgaggtatttgcaccacatttacaatgtgcaaattatgtaacatgatcaagatctatactttcatgataggaaatggaagcaaatgtaaaaactcacaacatatatatgtatataaaaatattttgtgtggaaattatgtagcatttcaaaccaaataactgtcagtttaatgtagcttcagtgtctgtctgacacctcctattggaattcaatcgtttaatgattcccttttgttaagtgtgaatgtgatttcacacttttacctggtcaggtagctttcttattatttatcagctaagtacttgataatgattcctgctgtttggtgggactctcaagggaagtaaaaatggtcccaggccaactataataaaactaaggtaaattatattcaaactaaaacttccgacaacactgtgcaaacgggaaatgtcttggtctaaaattcacttatgacggagaatcgctaaggtatgaaatgtttaacaaaatacaagaaatcttattcctgtgaactttctctgctcatctttacatggtaaagtggcctggaaaatttgtttaaatgacctctctaattcagacctcatgtcaccttcatctctattcccaggacccactgagagttatcattgtttaccccaccttgttttttctttgacaacataagcaacaaaagcatttttataaataggtgaagtggctgggaaggagtctacctatatgctgttgtgatgtcgcagactataaaccatcaaacataggcagaataattgtttggtatactggaaggaggataataaaagcacttccactacgaaagaaaattaaatgtgagatgaaagaaaaagaaaaaagactgatggcaatttgagtacagtgtatttgtttttcgttttcctaacatactgtgccaagttttctactctttccgtttccaattttgctttcggtgaaggtttctcgaatctcagcaatcccacacataaacatttatcgttatatccattaagccttaaggttttagattttcaactatgagggagaactcagccaaagatgcttgaaagataaatacgtttaattaggggcagaggatgatcattaaaggaagtctgactgctgcagaagtcattaacaatcttaaatgaaatttttatttttatgatagccatttacatgtataataagagccaatgattcttgggagcagtgtgacagaaacagagtgtggcgagaactcatgtaagacatactatttaaatgagctggtgttagctattcatatttgttaatgaactagatatgcagggctataagaatgaatgttctgatgctttaaattttaatatctagaaatcaagggtaaggaccaattactagaatttccacccttagaagaataattaataacaatgtaacaaatgtacagccccaaacctcttttaaaaaagtttaatttaaaaaatttaatatcaatagttgaaaaacagccaaacagcaatgtcaagctgtagtagtttgtgattgtggcagctttttgtgttggtcatggatcataattctaaacgttttaatatacagtaatccatatgaatgcattgcagaccctgttatcacctgtagttaatggtgcctgtgatacaagtgaacaggctgttctttgctcttacctttatggtaaataaaccagcattctggagtcacaataattaaataaaatgtaaatccctaatctcatttggctatttggaccaagaaacttacccggctattacctgtctagttctaatgattactaatgatttattgttctttttttttattgttctaaaagtgctctgatgtggtgccttgatgtctaatgaaaagaaattggtcttaaaaagctactcattgtttatcctgactctgagataacacatttttcttctgataaaatatttttcttatttattgttcaaaacacacaatatagacaataactctaattctggtgcagttttatttagtagtgttttatccccggtgcctggctgtctacagtcatacctcagcacatagctttactctgagataagccctctctcctttgctctttctcccatgctttctggagtttgtctgcaggatgcaggttttgaactgaagagcgcagtggagttcttactgtgcctttccggttccagcacaatcaaagttttgtgtttggaattgtccttgacattctttcgtcccacaatggggtggacacagtgtgctggaaaccatgacatcattatcattgacacagacttaaataaatcacctgcatcttggcctctttctgcttattcaaggattcttcatcttaaggaagaaagtgctctttatttttacaaatcttcatcccaggggtgactggaagacgcaaacttttacaagtgttttaaaaataaatatactatgtggttttagacacagtatgctgagtcagaggtgtcttagagaatgtttaaggttagacataaggcagaaagacagccagattgcctttaattcggaggcaatattcctaaactgtgtatcattatgtccttctgaatatggattcacttgaaacttaattaaataggcatatacataacatttcaaatacatacctgaaaaggcttagtagtgtttcattttcacacattgagcttgatattcaaaaaagaaaaagattgatgctcagtgaatcaaagcaaagtactttctaggtaaaagtgacaccatctcatccaatgtctctgaaagatctcagttgcacagtctttggataaaaagggttataactaaataatactacaaaatgcaatttacacaatgtgctgactacacatttgtatacccagcatttattaatttgggaagcaaccaactactgtaacttctctttactttttcataagaaaatgacaatgaggaaggaagtgcagcagaaatcttgaacattaccactattatgcaaaaaaaaaaaaaaatgctgttaactgttttcccctcagtgacttgatgtgctctcagatggaaaacttatgattcttgtgactcttggctacccgaaatcacatgagatgagcaaggaagaaagacacaaaagctatatttatatctagccctgaacttctcagaaataccttaatatgattccttgcagagactgataaaaatatcagatgagggagactttcaaatgatcagtgattacaattgacaatacaatattgctatatattaaacttctaaatgtttaatgtaaaatgtctctctgaaaatattttttaaataaaggaaaattccttgctcaggaatgaatttaagtggttgtacagcttaaacaaatatcattcaaattatctgattattatgaggagtgagattaaattagcatccaggtatatctgtgtattttaccttaagaggatcatgatttttcagttctgattccataaagagatttgctgcactgcttgtaaaatatattttattttatttttgctgtaacattttctagaacctgttctttcatgaaagtagattagaatatgataagcaaagaatgaccaggacagatttggaaattcgtagagtcctagttacaaagtttcccttgttttaagtaaaatgattatcacagagagatattcatcctggagcatatttggtctcattagtattgtcatagtaaaaataaaaatttttaaacttcacgtttaatttacttaagagatttttaactatcagctatcctgctctgtcctcctacgtcctctacaatctggtaggcagaaaatttgagagtgcccctatttttcaaattctcccttattttaaaatattgcagtttttgacaatgacctttaattgtttatgaatttttaacttcaacattatatatattcaccttcatcagaacactgagctgttgttatatatgtttccccagaaaatgattatgattacctacaggggcataaatgatgatgaggacaagacatttatggagtagttgggataggaataaggcaggtacgttttagaagtttgtatcaagcagtgaaacaggtattgttgttacttctgggatatttgttgtacaaactgggcattccaagttttgatatgtagaattaggttttcaaaaagtatgcttgcatagattagcaccattatagccaccccaaggggaaagaaaagcatgaaaacaaaatgtgaaattctgacttgccactaagcatccagagtttccagaggcatagcagccagcatgcctcttcatgagtgcaaatacttagttgcttttgactcttattgaaaaaataatatctttcccccatttgtcactagaactgccaccagaagaaaagcccttcatttgctccaaataagcacttctgtttttcacagcttgcagtaatgcttaaagtaaataagttcttgtgcagctagcactattggattcattcaattgcctgaacaaagctattgtttagaggtctacaacaagccttttctctgtttcctttaaaagaatcttccttgttcctgtgcttggcatgcttagtatagtaagcctttctacaattctcaaatgctaaagataattttcccccacagaagaaatgaaggaagactatgacactatggggccagaagccacgatccagaccgcaattaacaatggtacaggtgagttatgttggccacgctcagatcacatttgtcctgtgtcatgtgggtttagtgaggcagggaaggaaacagtgacacatccatttgtatctccatgacttaacaagtagtcaactttacaggtctctggttttgtttcaaatcaaaatttcctacattttggtattttactaagcaaatacatctttcattctcacacccctaatttacctgtgacgctcaagaatactgaactctatgaatggatcctttcagtgcatgagttgggtgaatttctagtagtaacttttattttaaaagactgcaaaaaattattttaaaattaggatatgatatacctctgctagccaccacttgatatcagtcgttgagaattcaaatgataaggtgtaatttagactgtaaaatttttttttcagaaagacaaatttccacgaacatttctctcaataattaatcatctcagttccttttaatcctttctttacttgtaattctctgcatccttgagcccttttaaataattttttccaggcagttttagagaagaattgacaagtttacttatttttaatgaagctaaaaaattacagtgggaagatactgagtggtgttttgttttactctgctactgcaatagaatggagtttcaggacaactgtgatattccatgttttttcccaaacactgaatggcatcttctctcacattcttacatcaccaacacaaatttacatgttccatctctcttttcctagatgagactatttattttgtggaggggaggggtgttgcaaacagtcctctacactaccatcacaaatattagcatagtgtccaccataaaattatcttccaaaataaaacaaaaaaaaaatgtaactacttctactcaactcatccatgaaaaataacttgaagttttatgaaatgtaaaaaactaagatgattttacatcacccttatgttgatacacatcatgatagactgctcatgttgtgtttctgtttaaaatgtgcttattaataacttaaaagcatgaattcactttcctgggtataaaataagagaaataataaaaacctattgtcattctattcattcgaataatgtcaatttaaggtataaaaataaagctgtacaatagatgattctagaaaaagtatagaatcaagcaccaagaatcctaatttttacacacagccctgacaatgactagattgtaacccttgggcaagtcagttttcctctttggaactcagttcccacaactgcaaaacgaatagattcaactagtttcttgataataatacttctagttttaatattttatgttgcatgggtattatcaccatgtaaaaatagaaacaagataaaataacttcatattaaaacaaaaataaagcgatatcatgaattagatactttctataatgtcccaactcatgggatcaaaaatggcttcaagttccttttaaagataaatgttaaatttcagcctccagcataaataaaagctgattttgattacccttataagcacttaaagtgtcacaaaagaaaatttaccccacaaagtaacaatttactagctgttgtatacacctagagtttaaagtgaggttaataaaaattgcttctattcagaaggtttaaaaatcaatcttgaatgtcttttcaccaggctttaaacaccccttttttctcataatacctgctgtaccttgtagttcatatgtattcagtcaataaataaatcaataagtgttcattgagtgtgttctatatagtcactgctgtgtgcatatgtggtagaagatgggtcaggaagactaaaacatggttatcatttcatttggaagatgagactaatacacctgaaaaaataatgatgaagaataagtgaaaatatgtgataaacctgcaacaaatggtaggagccataattatttagttttttgttgttttgttttgatttgttttgttttgtttgagacaagagtgtcactttgtcacccaggctggagtgcagtggtgcaatctcggctcactgcaacctctccctcccaggttcaagcgattctcctgcctcagcctccctagtagctgggatttcaggcatgcaccaccatgcccggctaatttttgtatttctagtagagacggggtttcaccatgttggccaggctggtctcgaactcatgacctcaggtgatcctcccacctcggcctcccgaagtgccgggattacaggcatgtgccactgcgcctggcctataattatttgaattacagaagtgagagagagtctatggaatgggcattcacatcaggttttgtgaaggaggtagaattcgaactaaatacattttcaatagtcatggaggagtgaggaagggctttctaattgaagaggagtctgtgagccaagaagggaaagtgtgacatctattcagaggatagtgagtaaagggttttggctgaatcagagagtcctaggaggcaatttctgggaaataaagctggacatttaagttaaagccagatggtggagaatataaagcaccagacagaagagtctgggtcatgttatgctaccatgatttctgtgggtgaaaaccagactctgagagaccaactggaagtcactgtagttatccaggtgtgaagtgataaaaatcttgtcctaaggtggagacagtgatgaaattagcaacatgacttcttaacaaacaattgattctctgaatgatggaggcaaaatggcttcaaaattacagatctgcatgtttagcatatagcagtacttgctatttctagatttacagaagaaggatctaattttgagaagatcttgaaccagcctttagacacaagtattttcatataaaagatatatagatatgggaatataggaatgtcctttggaaatgaggaattgaaacccaagaagtcagggctggagatagagatttgagagttatgcaaatatactcagatcatgttcaagatcacacaggactatgagatttacaactgagtgtatttgttgaagcaagtagaaagctgaggccagggctcctggtgggtggggaggaaaatcaacaaagattttcttttgaaaaaaaaaaaaaaagattatgacacaagagaaaaaaattaaacattcagaagcaaagaaagagaatttcgtaaaggtgagaactcagttaaaagcttcaaataactacccttgaaagaaagctgagcaaatacactggacttagttaattagaaatttactagtgatcttcagcttacaactctgccctttgagagaataagtacatattctttcttcctagctacaagtttaccacttcttctccctgacatctctttggatgctaaatacatgtggttttagaaataatacatcttttctggttgaaattgcatctaaaagactatcttcctctgctcccaagtcttgctcatcaagctcctgctattggctgaatttcttctctagccattccacactagaatgtctccctccaatgagcctgtggggtttgggctgctttatcgccatggatcctggaatggtctccatcacaaagtgtgtctgaagaaatgagcgagtgaatgggagacaaacagcacttggacttcccttttgtattttcaggttaacatatttttgagccctggcctgaagtaaccaaccagacattttcatctctccattattccagtcatccaaacttgaaagccttagttatatttgactgttctctgtccctcatgtcctcctctatttagtcagcccacatctttcctataacagtttcctcaatgtccaaattcccttcttagaatcctgaattgccccttagcacctacaggacgttcttcagtccgataataagtgccatccattgtataccaatggcgctccattcttgtcagaccaaatcccttggtgacaacaaaaaagaaccacatttataccaacctctgaatctctgcccatgctatcccttcagaccctaatcccccagctcctttcttccagtcatccaaattctccccatccttctgttcttcaagtccaggtcacatcccatttccttaatgtggtcatctctgaacaccccaaacgacagcaatctcttcagaacccttgtggggttctgaaatcccacaaccctaaggtgtatgtggctaacttcagcatgtttcatcgttcctccttatattgtttgcccttatttcatgtagtcaatttcatgaagacaagaggtttcttcagctgaaaaatgagggtggatcatcctggtatctacctcattggctgaccttgttctctagccagtaattaaataaataattactgaggtaattaaataaataatgaagccagttgtggtggtctggcccataatctcagctactcaggaggtcgaggctggaggatggcttcagtccaggagttggaggctacagtgagccataatccactgcactccagcctgggtgacagagcaagaccctatctcaaaaatagtaataatcagaatgtatatgtcgatattagtaagtgactaaaaaaatgtttgccctaaggaaaggactattccatttgcctcaacaagcccagttatagcagggagcacacatggcagatattacaactggtgaaatgaatgaatgaatcaatgaatgaatatttggtggagaagaaatggattctgataaaggaagccacagtaggggaaaacattctctgtggaggagactaagtatcttcagagagtgaaactaggatctaagtccctgaaggattttgccttgttaaaggcaaagaagaatagcctagagtatcactacattttttttttaacaacaaagttagattaactgaatggcaaaattgatctataacacataaaacagtgcaaacctggatttatattaataactttccacattgcataagttcaccagtttttatttttttttaaaaaaggaacaaaattgtaatgctttcacacgtaagataaagaatatcttctaacaaagagccttacaactttcagatattaataggatttaaattcaaaatgaaattattaggtaaaatttttaagtgtgtgaatgaaccattttctaagaagagtagagaaatggaaaaacttggaagcattatacacatgagtttgcctacgtgctagtagtaacaaggagctatcttaggtgcatggtgatcattagcattaatgcagttccacgtgcatatcaatatccaaatagggccctgatgttttactctttgaatgtgtgaaagttatatttactcagacaatctagtacctctagttataaagggctattaataaccacctgcatctgcgcttcctttgctaagagggggaagaggtaccttacatccagaaactgggcaaggccaatttaggcatcagttcttaatcttacacaacacaataaatttcttgtctaagaactaactttatagactctaactatagtcaaacttgtttccagtattctaagaataatacataaattatttcacatatgagaggcaattgttttgggaggctccagattctagagaccaattacctacacttgaattttatctctaccaattactagttacattaacttgagtgtgtaattgataagccttcatttctacatcggtaaagtggaaatcatgattccttatgtacaaggcctcgctgtagggattaaatggcatgacatttttatttatttattttttaactttatttttattttctttctttttttatttcaataggttttggggaacaggtgatgtttggttacatgaataagctctttagtagtgatttctgaggttttggcgcacccatcacccaagcagtgtacaccgtgcccaatgtgtagttttttttccctcatcaccctcccaccatttccccaaagtccattgtgtcattctcatggcatgccatttttaaagcacccagtacaacaactaacatagactagatgctcaccctgttttgttttgccagtttttttttttgtttgtttgtttgtttttttttgagatggagtctcgctctttttgcccgggctggagtgcaatggtgcaatttcggctcactgcaacctccgcctcctgggttcaagcaattctcctgcctcagcctcctgagtagctgggattacaggcatgcgccaccacgcccggctaatttttgtacttttagtagagatggggttttgtcatgttggccaggctgatcttgaactcctgacctcaggtgtccccccgcctcagcctcccaaagtgctgggattacaggcatgagccaccaggcctggccaacttcaaactatttttgttcattaagaaatgaatacatcgtaaacggttttctccattcatactggttcctccttaactttttctctaggaaacaaaaatacaattttaacaaatttgtaatgaaagaactaaccaattttgagaggctttgacatttaagttcttttgacattctggaaaactacacagacaagttgtaggacacattattttcagtactctggcatttgaggctaaaatatgaaggttaagaactagtttcgttttatatctgatttcatttttatgtagcatcccttctttaactgtgtaggaggaggatttagtagtatttataatgattacgtataataatgatgaaagctgtcagacttttcctttctttgacaactgactcacatcaggaatcgtattctttttaaaaatttattattgacacataacaattttacatattaatattcgtgaggtgcaacatgatgttttgatacatgtataaattaatgatcaaatcaaggtgattagcatatccatctccttaaacatttatcatttctttgtgataaggacattcgagaacccccgttctagctattctgaaatatgcactacatttttgtgagctccagtcacataatagaccaacataactatttctcctatctaactgtagttttgtacccattgagaaatctctcattgttcacccttccccctactctcctcatcttctggaatcagcctaaatgtccatcaacagatgaatggataatgaatggtatatatacccaatggaatactatttagccataaaaaataatgaaatcatgtcatttgcagcaacatggataaacctggaggacattatgctgagtgaaataagccaagcacagaaacataaatatcacttgacctcactcatatgtggaatctaaaaagctgttctcatggaagtggagaaaaatcatatatatttttttcttcttaccctggataacaaccaataaacaaaaacgaagcatttgcccattgttaacaaccactaaaatacatacattcagagtgtttgttgtatgtagaatttgaactgaggcttgaggaaactttaaggaaatagaagggtgagttccttccactaagcaacataaaattttaggggtgttgataaaaaaaaatcataatgacaagaagagaaaatttacaaataaataattatagcctcattagttattcaactcaatggtcacttattgggaccctactaagtgcaaggcattttgttagtcatcacaaaagatacagtgagaaaagaagagtcactgtcattaaggacctacattcatccgggtgaataaaacagtggtagacgaatacgaaatgcatgtaaaatatttagtgcaacgttagcgcataataaatgcgctatcatttctagccattattattgattataatatcatctggattaagacgttttatttgaaatacagcaagctatgtaagttcaaatgcaaagtgttcagtattgtagagggtttctgacagtatagggtcaaatattggagataggacaagagaggtgccttaaagaaattgcaaatttcagggaagactttcttcaagacaaagacttgctgggtatgcctctgtgcacaagagagaaagagagaaaggctgaaatgtaaaaggagactgggtgaaagatggagtgggttatcaaacgagttgtaagagaataattttagatgatagccacaataatgtttattttttagcagtaagatcagaagaagaagacagaatgatgataggagagaatgtagtcaatttaagatgatccaaggaatacacactgtatgggttgcactctttgaagtcaataggaaaaagagactatcagtcagcagtaagggaataggaatacagttggaatcttgagacatggacatgtagaataattgctgtggacaatgcgtggagattcaattattaggaaggaatatcccattttgaaaacatagtctgcaacaagactatactattatttaagatttttttaagatacgtttgatactccagaaattggactggatcgtagttcagcagggtaagaatgatacaagtgtaagggacagagatggaagtgatgatttcaagttccaaggtgaactgaggtaaataaaatcagaatgggtaaaagggactaggaaacttttcagggcctgattgtcacattgaagtacacgtttcaagggaatgagaaactggatgataggcaaggggagaaagtagaaatcagagagcgaaagttcgcggttctggttcttgtcccagggttagcccaggagcaagtgtggccatccatgttgctggattagagaaagcctaagcactgtgaagccaggttctgcatggactatctattaagtgatgaagtttcccagaatgcaatggcatcctgtgggaaatgtaatcatgggacaggcgtcattttgcttgcagtatacaggcaatgtcctaaaacatgacggtgaaaatggatgactttcgacttcgacttcaaaccattacagctacagagtggaaacaatttgagggtagaggttaggtctgctcttctccataatccctctcagaggatgcagtggtttatacagtgttaatggttcataaccagggtatttgttgaattaatgaataaataaacaaagaaataaatgatgagtgagttgacgaaacaggaacattgattggaagcagtagcgtgaattaaggagtttgttgacccttcctctttgttctgtgagtcataacaaatgaaagcaggaatggccctgtggaaaaggtctgtaagggatgggttattatcaggggatgacacagtttcatttagtctgaagaagtggaacacatgtaggaggatataattaagcatgggaggaaaataacgagtaatatgtgaaatgggaaagcaaaatgaaccgggaataaagttcttttttggtttctagtccaaagttaagcttgaggcatttcttgtttactataaccacaaaatatctaatatctgctaactaataactaatacctgctattttaacagatgttaaaataatacctaataaaaattcacctttgcaaggtgctatggaaagttattctttattgagcgcctttagaaacttgattacaaattagaaacagtcaaattaggaaatacaatccttaaatattaaatggaaattttaaataagcatcttgaacagagaatttgaaaaacttttatgtgttctctttgccccactagacccagctctggattacccagttaaaaaaaaaaatgtaagaataaaacaagtgtctaggattcagaggaatggggacatttaaaaaaaaaaaagaaaaaaagtaaaaattttctacacacacatatacaaacacacacacacacacacacatacactctgaagtgggcattttaactgacttccccccatattcattgtatggtgtaataatgttgctatttagaattgcttataatgtcattgtgatcgtttcagtatgtagggcctgttcaaatggtaccaagtcaggcatgatgaaaaactaaaaagatgaggttctctcttttcttgcctctttctctcatgttgagtcattatggtgcagtagaaagagcagtgggtgaagagtcaggatacataaatcctacatacagctcttccagaaattacttgtgcaactttgtatgaatcactaacctcactgtaccttagttgtaacatctgttaaatgaggaaatcaggctagaaattttgaactccaccccaccctgccctttcttctaatgaaattttactggaagcatgaacaaaaaaattactggaccgcactagccgtcatgggatgggaggctctcgggggccctgcctcacgataacatacacagggccagcttcctgggtctgggacctgcacagtcgcacagggcccagcactgagaagggctgcttggttggctctgcagttgctgtcttgaagctcttgacaatttttgaatgaggggcccaacattttcattttacactgggccccaccaaccatatagccagtcctgttcatgtctcacaaaatacatgagaagaatagcagagtacaagctaggatgggaagtggtggaatcagagaggcactgcttcaagtattgaacagaaatgccagttaggtctaagtttacaggatccttctttgggtgtctccagagcaattgaaccccaagtaaagatccagatctagactgaaaatcttgcctcagcaagaaatacagtggtgccaggtgtaactcccctaaactgataatattagtataaggttggcagcctagccagcaattaagtctctttaaccatcaattctgtgcatcgcatcgttagcataggggaaagtgggggaaagaagaactttttttactttcactatcctcttggtttaataactctcaatttctcctgttcctcttaacatggagcttaaattaaaacttttaaattagttagctttcttatatcagtaacagaagcgatacaagtttgattataacgtatttctctgcaagagttgagtggatatataatgttaatcaattgtacaaaatcagtttatcagataattcagttagtacctaaatacttaacaaggagggaatcatactattacaaagtatgtcatattcttcttggttgtatctatcacatttttataggttggaagagttttgtctgccagtcagacatctgtcagggaagtcattattttttaatttcttagttaacttcatacattgagtttttaaaaataaggtggagaaagagataggtttggaggagagaaaaatagaagtagtgcttggcaggtgagacgggggatgattttcagactataatcagtgaacgccaagaagagcctgttcacttcctggctaatgaatgctgttgttttattagctttgtttgcgattaggagcagctatcttcacttcacagcaagtgttcccacaagaaataactgatatttcaagcttcttgagtgcctccttcattcattcaacaaatatttaataagcgctgttttgcttgtgatgttgtctggggtttccaggcacttccaaaatattttctcttaatctgcatgtttgttttccccatcagaaagctgtgttgttttgagtttttaattgaaaagaatacagataaaattctctaggcctagccagtaaagaaaaagcaaactgattaaagtaattaattaattgaaattatggaattctggaactttgaggacaccccagaaagcacaccctggctcattttacagatgaggaaattgaaattcaaaaacatgaaataactgagccaaaatgaggagtccaaggaccctgaaccttgcctaatcattcaattattgcataataactgtgacccaggcactatgctaggtgctggtgacacaaagctgaataacatatggttcattcttttatcagctcacagacacgtaagagaaagattacgatgggatgtgatcaattcaatgattgagacacacagatgacattcagtaagtgaagaaggaagtctatgtgaactcaggctgagatagtcaggaaagctacctaataataataatatgggaccaattgtgcttctctccaaaatcatgttatgaatgtctcatttagccatgcgaggcagaggattgaatttgtagagttcttaaattggacaagggtcagaatttcgtgaaagacttgttaaaacacagattgctggttccataggtttggatgggccccaataatttgcatttcaagcaagctcccagatgatacggatgccactgacttttgaaaatcactgactgtcctgagcattcttaggtttcacgtgtctctacataaagcataagaaaagagcattgaattgctgggcaaaatcaccttacttcatcaactcctctaaattataataaactagtctatctttttggtaatatgccaattccaaatttttaggttacacagtaatgtgaaagacaagtgcatattgtctatattgggaatttttctttgtgtgtgtgagatggagtttcactcttgttgcccaggctggagtgcagtggcacgatctcggctcaccgcaacctccgcctcccaggttcaagtgattctcctgcctcagcctccctagtagctgggattataggcatgtgccaccacacccggctaattttgtatttttagtagagatggtgtttctccatgttggtcaggctggtcttgaactcctgacctcaggtgatccgcccacctcggcctcccaaagtgctgggattacaggcgtaagccaccgcgcccggcctatcttgggaatttttaaaaaagtaatggactctatcattctgtgccaatacacagcaatcaaaatcgttgagtgttagcagtctctacatcttgatattcaaaatcccctaatgtaagatctcctgctgtttagggagatatttgatactgcagactactacagattcccattccttgtccactcttcacctcgctctcctgaagctctcttacatgagaaactctcattggcatctgaacatgtgttccctggagaaagccatgttcagagcaggggtggagagagcggccaagatgctgtactaattcccaggaagagcagaaaacttttctgttgctcttgacgacctggctttatccatgcctctgtaccagctggaggctctgcgaggccgcccatgtagctgtgtaatgagaaaaagatcatcctcttccctcacggttgtttttaggtaactagtgccaatatgtcttttggaaaccttctgcaaaaacgcatacatgcacttttaatgatgaaaagcttacatttattaattagtcaactttaaacaaagtagccatgagaatctatagacctcaacaaatgctgaatatgtgcttccttaaactaaaaaactcaatacaaatgactacattcaaaataattttcgtgttttcttatcatctgagatgttaacaaaaaggctgtttttcaaaaagatgataaatacagttacctagatttgtaattgcttcttcaggtccctttgcctttcatagtgaagtaagcaaaagccagattatatgataaatacataatttatgttatatacattacattacactggggaagcgtgtgtgtgtgtgtgtgtgtgtgtgtatatatgagatgccctattatacatatatatatatatatatatatatatatatatatatatatatagacatgtctgtatattgcagaatcacaaccattatgtgtatatatctccaaacgggtgaatcacagaagtaggaaaaaaatttaccactcatgtcctcatttccaagaacactggcactagtaggcactcaataaacagttattaaacaaggggatggatggatgattctactcagttttttacatatacttgctgcaactcctctgtaccttccaagatattttctttttaaaaagaattatttattcattttgatgtttacttaaatggcttaacataatattcaattttcttccattttttatgaaaattaaaagcatgcaggacactaaaccagtgataatagagtacctgtcttccactgtgaacacaggcttgctacaaataaagaaaatgaatgccaaagggaaacagaaaatgataaagaataagtatctggtctatatttcattacctgtaaacactaagcaaagcccacttttaagtatctttgagaaagtattctaaagcaacttgattatgggggctgactaatttggggaccaatatttctcttttatttagagttctgttaacatcgcttgaattttaggcaataatttttaaggccagtctatgttgatatttattattatctgtctgaaaaatcaattatctatctaacgcagccataaagatatctataaaagtgtcattaataagcaacattagtaagagtggccaacatattgccaagagaactgaggctttcctgacaaaaagggacctgaaaattcaccctaacaatctaacagtattaaaatacacatggtcatgaggaaacatttttaattaacattcttttttatggctgggcgcggtggctcacgcctgtaatcccagcactttgggaggccgaggtgggtggatcacgaggtcaggagatcgagaccatcctggctaacggtgaaaccctgtctctactaaaaatacgaaaaattagccgggcgtggtggcaggcacctgtagtcccagctacacaggaggccgaggcaggagaatagtgtgaacctgggagacggagctggcagtgagccgagattgcactactgcactttagcctgggcgacagagcaagactctgtctcaaaaaaaaaaaaaaaacaacaacttttttttggtttttttgagacaggggtctcactttgtcactcaggctggaatgcagtggtgcgatcacagctctctgcagcctcaacctcccaagctcaagcgtttctgctacctctgcctccccagtagcagggaccacaggcacgcaccaccatgccaggctaattcttttactttctatagagacgagatttgttgcccaagctagatattctttttttggatagagaaaaggttatctaaccttagagaagattgagagatatttgcaagacattagggtaaattttaggactaaatgcaaaatctctggagaaggtatgggaagaaattacttgaggcttcttgtgaatttttgttatggtttgatcataaataccatgcaaatatcctttgtcagtgtgttttggcagttcttccaaagagaccagggagtgaagaggattacagaaagaaggaaaatgaggttgattttacactagaaaaatgcagtgaagaattctacaacctttcagctacttttgtacctcattcctgtgtccagtacacattattgcataatctttctaaaaacaaacatacaaactttcagatacaatcaaaacttcattcttcccaacaattctgagagtaaccaaaattgaatcccatcatttgtcctagtattgtaactgttagggtgattttagttttaagagactgaaacacaacataccttcaagcagaaaaggaagtttcttggctcacggaatttaaggaaggtggtcaaccgaaccactgcaaggtgcacctcggcctcaggaacgagaagagctagaaatgaactgtcagaacatgcaatcttgtctgcttttctctgtatgtctgctttattctctcttcataaatcttctttttctagatggaaaataacaattccttcattccacattttatagctacagtcacttggcagaaaaaaaaaaactgccttgatgctttttctggaacaaagtcctaaaatcatagggaagggatttattgaatttaattggatctattggctaccctggaccaatcaacaagttggcctggagaagagaggactgagattggctcacctgagcaacagagatcaattgtggctaggggagcaggatcacatggtaacacagcagctccttgggtaccataagccttggcaatcaggaaatggagaagcattcctaggacaaggtgaatgttgaagtactgggcagaaaaactgtatattactagcacctattgcacctcatggaaaaactacattagattcatgctggtgatacctagtttctgggaggtttaactctagcccacttaagtgaccctaggtatgtgagatatataaacaacagaatatctatacagcatgaagaaatatccagatggagcaaatggatttaaatgattgagtgacatcttcatgaaaccctttttgaatacttatctgagccctatcaaactctttcaagtatttatgaccactactacacagtttatcaaataattattctacagttgcctgagtattaggtctaagttcctagctcagctgcaggtatcttattttatgcttccttttaccaaaagacctctacaccaagattagtgttaaggacataatttattccacattcatcccataaatgattcttgagagcctactaatttctaggcaatatattcaatgcccaggatacaaagatgatcaaagatgaatccttaaagagagcgcatgatttgatgtattttgtccccatcacacttgacatagaaatctagcatagccaaatttgatctagcaattgaattacctctccaaacaacagtagtgtatctagatgcagttttgtttgcctatccagaaaaatcagaattttcctcccttttaagccaaaaggctattaatgcaaatccaattgaatttgcatatgattacatttctgatggaaacattcatatgcaaatgaaaattcatgcaaagatagccagatcattcaaatagttgctgaaatatcaagataaaattaggatattaaatgtacatccatctatgtttactaggttacactaaggtcatcaagtaggacaatattctcaaaaaacttaaaccatgtcttaacccttaacataaaccattgacaaccctcaagtagatacgaattcagaaaggagctattacgttactttgtgctgtcatagtactgaaaaagaagtcagtcactgataaaatcagtgaagttactcaaaagacattcatcatggctctgccattttgccccttttatcctttcttcccatcaaaagtaaaaggtgatttttttatagatctgatgttattttgatgatccaaaacaatgagcaaatactttatgcaagttgacagtttctacatactccataggggctcagtgatgcaagtgaaatgacatcatcacagtcaccaccaataagtatccattggaaagcatccatgacattgtgcatacagcaaggggaaagtgatcttatctaaagcccatattctttattaagtccagctaataacagatttaagcaaaatttcaaggtataaaatcttaatccactactgtacattccaaatctatttttgagggaaatacggtcttggaatagaccgttgttcttgttaaccttattagaagttacagaggcaaaaaagaaaggtttgagatcacagcattcaggattactggcgcttagtttagtggtccacatagtgtaattctcccacttccttttatttggtcccatatatttgtttatagtttcaagtctttttagaattctagtgttctttgctttgatgaatgtcacctaccatccatcaaatttggaaagtataaacctgagggaggtaccttagcatctcccaacttgacaaactgaattctttcccagatgaatctgaggaattttggatcttaggtatttctcaaatccagacacttccttcatctccatcatcaattccttaacagtatcttttgcctggcctaggacaggaacctcctaaccggattcccaggacctacttttctctttctccaatccctatcatactatagccaaggatgtcatctaaaaatgcaaataatcatagtttcatccagccatcctccttgcttaatactcttcaatagcttcctgcttcttttagagtaaaaacccaaatccttaaacaagctcttacctgctgcatggcctggctcccgccttactctccacccttacatcacgtggttcccctttcatcctctgcactccagcactgtcctttttttttaacatcctgagatgtcccatgcttgtttcagtcaccacattgcacatgctgctcttctccagcttctacatttagttaacttcatgcttcttcagttaagaccttcctgatcttctagctgccatcaggttcctgtgttactttttttataccaccatataactttctttcataatacttatctgagtttgtaatgatgtgtttactttggagataatatcagttgtattaatctctctcatggcttcccgaaggatgagcctagaactgttttctgctcaccagagcaggacatgatgcctatcacacactaggcattcagaaaatacttgttgaattaatggatagttccactttctattcccctcataaaaaatccaagttcataatcatgaaagcaaaaaaaaaaaattgcctagcttgcttgcgcatcaccctgccacagttgccaaagagaattagtatgtcaaatactataatattgtttatggtagagaagacaaggtgaagaatctcgtggcaccaaggttaactgctttcaaaaactatgataataggattccaccattaattgtaccagcaaagcacttttttcacctacttaggataaagaataatataacagctactctcccaactttgttagcataaaaatattatttatgatagctaagccacatcttatttcagaaacacatctagaggtttcaaatatacaaaatcttatgacacaagttgctaaaattgagttacaactgttattcatttcacaggaatagagtcataattacaaaagttaaagtcacatcaaaatcacacaccagtttcttaactccctctgttactttttattttatttctatcagctgtgagcttaattttattttcagcagctttaaaatacggaactaaagattaaaattatagggaaagataaaatgccacattctggtgcttttttttttttaacaaagttgcattattatctgtctaggaatatctttccttttgcatctgtctcagactatgtagtcctggctgtctgtgacattcagagggtggagggttaaaaacttatatttagcaacaggatgtatctgtggttagggacgctcagtctagtggacaatgaaaaattaaatatacctttcttagaagaaaatgaaatttcagatagactattaaaataggcttaatcttatattatctttaatgtttatggatcttagaatgcagttgttggctttttaaaaaaaatttatgaaaaacattttaaatttctttcattctttgtatatacagactaatattccaggaagaaaaaataaaataaaatgtgcttatttaacttgaaggaaagtgcccgccttcttgcatatattgcaagaataagcattcagtcaataatcggtcatcttcaacacttcttacaaataaactaggttttgtagtctattgcaagtcagcatttctcactggctatgatggagatggacttgggatcctaggaagaaggcccggaaacaacatttcttctccttttatgatttcagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatggtgaggctgtaaatcatttttagccactgcactgacctctgcagctgttacaattacaaatgcactacatgcctgggtgtttaccttaaaatttgaagaacagctgcagaggcatggaatttcatgagcaaagattagaactgtaattttagggtattgtgaaatttttttgtcagcaaatttgtgtcatttgtacatccaataaagaacaagaacaattagagcccatttctaagagataaaaatatctaaatgtattcctatctttctgaaatattttacttttgaggaaaaaaaagttgagaccgacactccctcaccttttgttcttctccaccgacacctgaaacgccccttcacactgtgagttcctgagtaatctgtggctacaggtttcataggaactgtcagtcacctaaagagaatttcctcatttatcagctgtttaagtcccccccacccccccaaaaaaaaaaaacctgaagtaattaattaatttttgagcacagtgtgagctgattccgacaagtctgtcctgggcatgcgaggggactggtgtgcgagggggccgggtgcaatgatggcactctgtggagcagattgcagtgattcctgtcataccatcccgggcagtcagcccattagctgccattgatttactgaccttttggcccgcttctctctctctctgtctctcggctacagacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcaggtggggggatggttttaagtgatttctttctataataaccccttagagaaacgatattgctttgattggcaatcattattaatttttcatggcattttgaagatgcagatcttttaatggtaatagctttaattgaggtctaaatgattttttgatggtctcttctaatatgatttaatagtcttatgttcacgatcgaatgagtgtgttaatttctaatttagaaattttatttgcactttaacttgactttagtttcatttttatgttccacaaaaagtgaatgaaattgtagcattttaattatacattattaaacatctcagcaattttaattccatttttcacctcgctttacttagaaattttcttttcatataggatctaagtcatagaaaaagaagtgtgtatttctttcatttttcatataacaccttcaattacttagagtatttttataagctgctactagtttatgaaatctgattaagtgttttaaggaaaatcaaaaaggcatatattatctgtgtatatataatatataaaataaattggattagtactaaaacgttggatgtacattaaaaatgatcccttaatatacatatttgtagctaaatgttaaaattactccccctctttttgcttacttgtctcaaaaataaaaactctgtcttcaacagttaagtatagcttcttaaatctttaaaacaactgaataggattgattcacagtgttccttaaatgttacatcaaaactcctctttcccactgggaggattgactctgcaaattgatattatgatatgtttgcatggacagaagtggtgtgccttaagtcacaataactggccctacagatccggaatcacttaatttaagtcttgacaccatgtctgtttttaaaattattgaacatgatattgtattcaaaattcttaggttttccttataaccttcattttcttcgaataaggaaaatgaggataagcaaacacagtcaataatggtgataagactagattatggaattttactattttaggagaacagctcatgtaaattattccatttatatctgattgggcttgtcacctgaatgcttttcaaagatgagttataaaaaatatgcttgcatagttgcacttatgtaacagtttatctccccttgcttatatgcacaaaaactcaaggaaaaaaaaagtgcctagatatttatctagcataaccgctttaaatttcacatgcagaagtgtgattgtgttggcgcattatgaatggtagctttggtgttgaaaagtcccctcatttgctcatggcatttacaattagtaaattaaaatgattgtatcatattaacagtggcacaactaaagtttatagtagtcctctgagggctgtggggggagacaaagcagctgttgctgtttgtttatgcaactcagcaacatatgagcgctggtccctcaatggcgctcggcgggctgggctctgcttgatctttgaaggttgctgctgtttgaacaaacctccctgtgtcccatgtaacaccatctgtctcactaggaatgtgggaagattcagcacaccctagcagttgtcataccgtttctgtgctgtctttttgcaaaaggcttttgtgtcattgctgctagaaaaaggctgacctcctaccttgagcatccagagtggatgactgcattttttttccagaattctaagtcacactgcttttttccccttgttcaaaaaggtcagctgtgtttgattatatctttgctgcttttaacttgtcttttcaggaaactttttttccttttttgtccctactccctagcacactactaaaaaggaaaatgaaaagtcgttgaagtctttcctactggcctgtgataaaactgctcaagcagctataacccaagatgttgtctcttacgtttgataatgaatcaaatctgataggcgacacctcaggaaaaactgggcttatatttgctactagcacaatgaataggatatttaaacatgctcatcatgtaatgaaatatttatagtcaaggtttttttgtttgtgtgtttttggtttgggattgggttttttttcttttttaaattttagattgcttcagtataagatatacttttatgctgatacaaaaaaattgataacttttgttgtgtgggggtggtttttcttgagactattcagaattttcaggaaaatatttttttcttgacagaattgtcacattctagcagagaatgttcatattttagaatttgtggtaaacacgaaaaacaacaaatatctttacagttatacttcctcgtccccaaaggttcaaagaaacattttggaaaagacactacagaaataattctaaagcaagtgttggatgcgcatgtgaaagcacttttttttatttgttccaattttattaccaacattatcacttttattgcaactctgaaagactgagcagataaataagcatgcactcaaaccttttggcctgtctgaaaaacagaggccttttaaaaatatttgtaacaaattttctttgttcctcctgcacaaaactgatgtcagtctttctccttttatagcaccaaatgctaacccaaggagcaggtaatcgcaagttcaaatgcacagagtgtggcaaggccttcaaatataaacaccatctgaaagaacacctgcgaattcacagtggtgagtagcagaggtgctggagctcgcatttgcattttacttaattaggggagttttaaaagattgtttaaaatttacacagtcctatttgtagctttttggaactatctatttatttcatcaactctgtgtgcctgatttgtgttcatgagacttatggtacaaccagtagcactgtcttataaaaagaagcagaatgcttacatgtcttaaaaattacaaatgctttgatttattacaaaatctagaggctcctttttgtccttttaaaaccgcttctccagaataaatatttctgacctgaggaaactcaactggcaaattctgaaagatattaatttttgagacctacccatgaaaaaaagggtgaagaattttggataagagctatgtatgataaatactccctgattcctgagggccgtggatcacagaacagaatcctaccactgagatttcctctttataactagtttgatagctctgccaagcattttattaccaagttggatgctattcaaaggactagttggattggtagaatcaatggaatctccacaaagtttattaaagccatggctacacttgcctttaaatactgtgacatctttattgtgctattgaccacacattagtctgacactctgtttaaataggaggctgccgatggcagacaagatttgggatctcagctgaaaaaggcatagatagcccttaccttccactgtgaacatcttgaattatgtcctcccagggcagataaagttcagaaatggttatggtcacataattctaatctaagtacctagaatgtagaggtaccccattgtgttccttttgtttggtttcacagattcttctcttggtagacaattgcaattgttatctaatcaaggaaatgtaacggtaattttaattatcattttaggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcaggtaaagagacaaatgtttttctgctatgaagaaaagaggtggcaattattttgattatgtgcatgtaggaaaaaaaaatcttagtgaaaaaactcagcagaaacagaagagtttgctttaacatgaacctaaaaccatcagtgggctagaacaatggatgaaacagtggatcactgtactctaagcacatttgctttaaaaacaaaaaggataaagaagaaattaatatttattttgagatgtatttagatggactcatctgcttttaaaattaaactttggtgaaaatatttggtaggacttacctaggtgctagaagttaaagtttataaccgtcacgtgcttttaaagatgtacacaggacaggtgtgatggctcatgcctgtaatcccagcactttgggaggccaacgagggtggatcacttgaggtcaggagtttgagaccagcctggccaacatggtaaaacaccatctgtcctaaaaatacaaaaattagctgggtgtagtgctgggtgcctgtaatcccagctacttgaaaggctgaggcagaagaatcacttgaacccaggaggctgaggttgcactgagcagagatcgtgccacagcactccagcctgagagacagagcaagactctgtcttaaataaataaataaatataaagatgtgcacaacttgcaataatgtatatacacattttaataggtacatttgttttacagagaatggtttattttgaagagtattcttaaaaatatcttccatatttcacatgacttcttaccaaatcttcaaagtagttaataattatgctttatcaaataggaaagcagttatattttaacattatgcagcatataatctttgtttgcaaaataggagcataagtagcagtgcacctctgtaacagctgttccagtattccaatttacagtacatctgccctctttgtaaatgtatttaagcctatttaatcttctctaatattaattagtacaaacatagtctaagaaaactgaactgtgggctagcaaatggaaatgtatgttatcatgcaagtttgcactcctttggatcaagacaaaataaatatcaagaaatttaataatttactgatccacattcattaatgttcaatgctgaaggctgttttaacatagaacattgataaaaagtgttattaatattccctatttcaaattagaaaattaaatataaaaatatagcttgaggcctttagttggtagacatacatttaaatagattgcataataataacattttgtacctaaatataaaattcaattaaaatcgggtttctacagctacagatcatttctaaagttaagcatactggaaaatacacaaatttcaatgttaaattttcacttatgggtatttcttggtataaaggaaatgaaggattttagaaaaatttgtttctctcaccttcagagttgaccatttcctgtccttaaaaaacagtgagatctaccttccagggcagagaagtttatatttttgttgcgtatattgttgcatatactgcatattgagacctcatatattgttcatggaaaaaaaaatgtttaactcaatcaattagtagcaagcaattttgaggttctccaaatgtccccctatgtgaagttgtttggtgtgagcacaaagagaagccactgtattgaactgtgtgattctatcgcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggtatgagtgactttgcctaactggttagagcttcccgtcctgctgtacatttcataatatttaatgagcacacttgtgcaacataagatgtaacatatgctgataccttcaacaaggaagaaataatgcttttgccgagctcagtaggacttttttgttgcctgtttattggatcattcatgtctttatgagtgtgcttgtcttaatatctttccagttattctgtaaaccaaatttagaaattatgtcaaagggacagtcagatggccagggcaatgaaatggcatgacacagccagttattgaaaataccttcaaattcttaagtttcaaagcttaagatgaacctatatatgtaaaaatctaataagaaattcagacagtaatacattagtttcatcatccaaaacaccaagaaagccataatttaggggtaattttgtttgccttttttttttaaattcgccacattttgaaagaactaaaggcattagtgtcataaaagaaaagtaatagatcagatgagctacttgaaaccacctatatttggaagattgaaataaaactttctaaattttaattagtatatttccaattcatgcattactaattaggaacaattacaaagagttgacaagaaaacagcctaattcttcactatgagtagagagatagtgggttaatttttgaaaagaaagatgaagtaccatatgtaatttaatattacttcccacaatccaagatctgcagctctatggttgagctccacttgtgtttcctccctggctccatccccacctccctgaacaataaggtagctgaacctcatccctacccctagcccatctccaattcttctccactggaaatttggcatgctctattagccctggatcgggggggaaaaagtgtaggatctcagtcaaaattttggcacgagggaacaaaaaaaataggggagtataggaaaacaactcattctaaaccaggaagtctagtatcaaacatttcaatatggaggaaaaaaaactagcactttggggggaaagctttttgggggaaaagcgatgatgaggcacaaaagaaaaagaaggaagacagaaaagggaatatgagccaggcgcagcagctcacgcctgtaatcccagcactttgaaagaccaaggcaggaagactgcttgagcccaagagtttgagaccagcctgcacaacatagtgagaccttgactctacaaaatattttttaaaaattagctggatgtggtagctcaagcctgtagtcccagctacttgggaggctgaggtaggaggatggcttgagcccaagaggtcgatgctgcagtgagccatgattgtgccactgcacctcagcctgagcaacagagtgagaccctatctcaaaaaaaaaaaaaaaaaaaaaaaagcgaagggaaggtgaatacttcctgtcatattttgactacctagatacaaggcactcttttctgtcactgaaaactgtccttgggaagtactcgtactcatcatcggctattattcctcactgggcacatgctggaggcagctcaagtgaccagcatcagcctgatagtgtggggagggtttttgtgaagcaacaaggttgataaataacagggttcttactccaaccaatacagttttctttttctttagctgtctgatattcattgttattattttaaaagtttaatgataccttaaagacaacccaatctaaatccaaacagcttttatacttgtgttatataattcaatgtttgaaacatcaaaattttcttttagtgtagatattttctttagtactaagtgctacttaagcatttacaaagtaaagatattttcatacctaaattttactttaattttaatattttaatcaaccttaaatatattttgtattccattattcagctacaataggcacatcactgaaggcatctttccctctctgattggttttattatatgaccatatgcaaactctatcatttactacacggtgagtgtacaacttttattttagtgagggctgtcatacacattgacatccagtcaatatatttacttcttataaattagagaattgtaaccttcataggtctgtagatagttgagaggcccaaaagttgacaaacacaaatatgcataatttatttgaaaaataaacttcaggcctgatgcggtggctcatgcctataatcccagcacttttggaggcagaggcaggtggatcacctgagagcgggagttcaagaccagcctgaccaacatggagaaaccccgtctctactaaaaatacaaaattagctgggtgtggtggtgcatgcctgtaatcccagctacttgggaggctaaggcaggagaatcacttgaacccgggaggcggaggttgcagtgagccaagataaggccactgcactccagcctggccgacagtgtgagactccatctcaaataaataaataaataaataaacaaacaaactttgttttttaaagtaaaaataaactattctgctccttcaagatgtgagagctgctgcctcgaaacattgcctagcaacaagatgctaatcattcaatggttgctctaaacttgtgattaattatcttcctgttggctttccaacttgtcaagtttccagcatgttaactttttggtcacttgaccaaacatctcatgacattactactgtcagtgtattaggttctattcaaatcaagttcttcatggattttctattgatgtgatgtatgtggaaatttagtccatgttcctatcccaattgaacctgtgggatagttcctatcccactagcctttcatttgtttacattaagcactagtaatattttgagaatgcactaagatgaaaattataagtgagaactgtcttgggactgactgattctaaggtcgggaaataaaattgaatcatcatttcattatgcattgattatgaatgtgtccttggtaaagtgtgtttgtgatgtctgtctacaattttacatatagaatcgtttaacttaagaaggaaattatgagctacttattcttgagacccagtgctttttttgcctcaatttatttcctaggcagataccaaagtcatcatgcttcatttttcttaccaatggcttattgcttgcttgcttttcctgggacctgggactgggacagaggagggaaacactatgtaaatgttgacttcaacagaattaattgtcacaaacaaggactgtgaaattaaaaactctgaaactcctgttaggcactgtcaagaactcatttgtattctaaaatttaaatctgacctttattgagtgctttctctgttgagacatcatggtaggtgcttttgaaacccaccttatttagaaaagtaatacaaatgtttctacttttgagtagataagtctaagttttaaataaatttaccagtcaatcttgtttctcagttatatggtaatttttttcataccacaaacctttcatttattattaagttcagttaccattctagctgtcaggtgaatcacaaatctagatattagagaaaatatttaccctaagaaagcttgattcactcagtatcaatttggatgttctgaatcttggtcatgtggaaatttaattctaggacatcttgatttgaatcaggtaaaccagcaaaacaagttaaaaagagatgaatgtccaagtcagttactatttaaattgaatttattaaatgcttaccactgaaacttctggagatcagtagactatttagtgtaaggtatatgtcaaaactctcacctgctcccagattctatcctttgcatggtatcataactgaacattttattttttcaggttgtcaattcataatgcaggattaatatatgcgtattataagcatactgtttattatcgaatgagttctctgaaaattgaatgtctataaccaaggcatatctctaagacagactgcagtttagtgggcatgcccgaagcattgctaacgggccttgaaacctataacagaggatgcttgctctctctggacactgctctgtgttttgttgctttggaaaagaaagccatatcataatgttcattcaaaattattcatacagtctcttccagaagttacctaagtagttgacctttttgtgctcctgagctaatgagacattagtatccaaaagaggttgtaggacagtttgcccatacacgccgtagcaactagagcatcaagaaaattttcatctataatttctcttctctctattcagatttattacttccatgtactctgctcctgctgcatgcgtcctacttagaacttgagaaattattgaacatgtattaatgaataagaataacatgatctaacattaactgactgcctactatgtgcaatccttgtactaaatgctttatataagttgtcttccttattctttatgcccagtccatgagttaggtccccaaatgatcttccttttacctactgatcctgagagaagttaacatgcctgagaatgcacagcctgtcataaatgatggatgtgaacccagataatcatattcatttaacactgcccctatggatgaattgctgcgactagaaacgtcttatcctttctcctgacagcatcctttcctttaaggtccaagtccacacaagtgagaccaaattcataacataatgacatgaagtttcccgggagacaaaacctcttgtctttttcccaaatacacgtctgcttcctcttaaattaccttcctaccacggtgtctttccaaatggaaaagcatgctatctttgcagactcttggcactccattgggattctctgttatccagtttacctcattcaaaacatcttttccaaaagttaaggaatggttcttgtgtggtttgaattatacttgctttcttcagagtatgagctaccttgaagtaggttattagaactgtctttatttcccatataactagtagtcaccaacaaatatctttctgatttccactcttccagttaaataacttctttctactctaatattataccttactacatttatcatcactaaatttctagtggacattccagttaaataaagaccattaatgaaatgacatatagcagtctacagcactttccgaatagtggcatgccctggaggcattcaataacattattaaagatatttaattactgattgagattttatatcaccatataactgaatacctaaagtgtatagaatgggtccctaaacttataacatgacacttagcaaacgaaaatgggattggatctactttgttgggttttaatttaatttgctgaaatgcaagtttgtattaggaaataaagcatacaacttcatatatgttacagtgatccatggcactctacatgacacatttctgactttaactctggagcatcaggctgataatttttttttatcagttctattttggaaataaactttcaagtatggcagctatggaaggtgttgaaggcattccagtgctatttgtggcctggaatcaaccagatgtgtttaggcttggcactggctttaagttccaaacactggttagaaactgcctggaatgccaaaggaaatacagcattccctagctgaagagtattttaacactcaacaagtggctgacatcttatggaaaactttagagggaaaacactatttggaatcagttcagcctccatgatatacaccctcctaatttgtattttctaatggtttcttctctgatttttattcttagactcctatgactgataagacagtcttgacatcctctttcctctgtttcttccactccctcctaacttggcagtttgctcccatttaagacctaagatcccctttcaaagcaactatctcatgatataacaagcagaggatatacatgccaatgccagcgatgatgccatctttatcacttttgtacaagtctttgttttaaaaatgtaaggaagagaattacctgatgaaaacatgtgctagatcactagaaatgtcttgttgaatagaacatttttccaagttttaaaatgagacaattagcaatggaaagcttcctgtctgagaattttcctccagcagctttctaagttcttcttgtttattaactacattgcatcagcaagcattagaaaaccaaattgtgggatggaaatgcatcttcctaactctccatcgattagaccggggtgtgttgatctttcaggcataagtacacacgcttatgcctgagtctggactcgcgtacagaattagtggaaagagacttcatgcaaagacactaatcaccctgtcatcttgttctttctcccaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacagagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttccaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctga

SEQ ID NO: 13002 - DNA, 168394 bp, Human
  misc_feature (1)...(168394): n = A,T,C or G
gagaaatgtgcacatgcacaatggagtttcatgcttctccatgggatccgtgttcaaaaaatgacagcattaatacaatctgagggggcagttttcagcccaatgtgaagcagaggacatgaaaacctttactgcacattctccatagactagccagaaacattccatgatcagtattttctttttgttccaaaccacaaaagagagggataacaccaggtgatggttgatgtcattggtgtaatcttttgaaatgactggtttctttttagccatagggcagaaagcctaatcatagttagtgatggagcgggtatgtgttccacttcctatcctgtcatggccaaaaacttagttttcaagtttactctgggatccccttggccaagagcgtgtccgttcagttaatctaggggcttgggattttatttttattcctcaaatgtaacaaatttaaagaaagaaagaaatttataaaacataagaaatagaagtatagcttagacctccaagcaagttctttaaaggtgacaagttaaacagtagtttttaagataatattttgatgaaatttttaatcatattattacaagattttagaagaagcaagatcttgtgaaaacaaaaccttaatgtccatatctagctctctaaatctatagtcagtctttaaaagagtgacacaaaaatgacacagatccgccctctggttcgctccccatatattagagcctggtaatcttccaaagtttttacagcatgaggcatacacagaatagatgcaaaaaaagtacaccttctgaaatttcctgaatggattcaaacttttactattctaagttaatcaattggtagtctacttactttataggattattgtaaggataggatcaatgaagtgaaatatattttattttcactggtcaattactcgtattaaagcaatttcatgcactttatctccctctcttggaaactggagagtagtactttttgtctggttacttaagattaaaaaaaagacaatatgtcacttttgacttgagtgtcatggtatctatggccttcaacctgcatggttttatcgtttcagtaatcttgggaggaaggtattattaagttcatttgataaataggagactgagcctccacaagggttaagtgaattgctcagggttatacaatgaacacttgatagaaatgattaaatgacactttacttgatttgttgtgggttactaaataaagcataggtgtgcataagtcattcaattattcaagcacattcttcatccctagtcctaatatcgaaagtctttgctcttagtttttataactacaaggatattcatcaaaagacccaagctcaggaataagcctaaagaggtagtcagactagaacaaaagacaattcacagacttaaatgaataatttgcattaatgaagtttgccaggctagtttccacttgaatcttcagatctttcttccttcattgtcttgttaactgtccagatttattacctaggagtttttgaaaactcacatattaggcaatagagtgtattctggaattgagagcctattttaaacttttgactaaaaagtttacccattaaatgtcatagattcaaccatcagactgaaaatcctcagtgtatttgaaggagggtattgtctcaaaaatccagagctcaaagtgaagaagaaaggcaaaatttggaatttagctctaggacaaactcatcagttcaggggtcagagatttatatagttaaaggacaagtgtgtgtttacctgagtttaaagagcaaagttgcctctggaaagaagccctcactggaggctctggcatttgaaatggtgggcaggagcacatgttgcttaaatttctgacagtggctggagattaccgattggttaggggagaggaagtaaagtaaaatatttataaattctccactgggtggagtctgagcagttctttgaatttctcaccctaagatctggcctgtacattttcaaggaattcttgagaggttcttggagagattctgggagccaaacactccattgggatcctagctggtaagcttgaggcgctgataaaaactctctaccctaatgtttactccatgttttttccaaatgaaacttctgtcagctagaatccttgtcatagtgttttagaggtttttttctgctactctcttctttttttatatatattctttttgtaaataaaaatggtatgaccttcctaaaggccccacctttagaaatgggttaaatgaaaagatctttactaatgtaatagaaaagaactgatgaacatagtgcactgaatatggttacatttgacaaaccaaagttagtcctgttcttatttgagtttaagcggtaagattaggtcaaactccagacgagggaaagatattcttaaacagattttaagtcctctgttttctggtaactttaattgtcttatgctgctagtagtcatattaaatatttatttagagaagtgaaaatgcctactcttgaacagagtttcttcccctttcattttatgaaacctaagaaaagaaagttgatacactttttaaaaatatactagattttcttttttcctttctgcttttattttgaggccagtggggtgttatttagtagtaacactgaagcaaatgtattgattttcttaacgtgttcagcaagtaattcatatcctagatatgaaatatacactcgtagcagagtaatgttacccatttctcaatgatatgcttaaagaatcttgctcaatatgcatattgtttttccttttttctttactaatgaaaaactacacgctttctcaacatatttttaagtcaggttctaaactttgaactcctatgtacaatttgcttatttcaggcatgaatgtgaaactgtgtaaagattaactaccagacactcagtcatttatttaactatttagccctaaatcagtgggtgactaggagattctgaattctgtgatttcgttaaaatcaatcagtttttaattattatacaagctttttactttaaagttgtagctgtctaaataaaattgtgaaagcacaatttccaaacctaaatcgaaggcacattgatgctgtccatcagaaggtattgataatttaaaaaaatattacaaactatcttttatctttttataaaggacctaatgtcatttgagcttaaccataatcctttgaagaaagtaaaatttaactttaaataacattgacatacagagcagttaggtgatttgtctgagaccatatggtatgtatgtcccccgtcttgataaaattaacactaaatatgtaacatttgaaaatttgtaaaatatgtaaaagttgaagtttttaaaagtttggatttaagttcttcctttcagaatatgagcatgtcactttatttgcaaactaaacatggcataacattatggcttgtgaacactaattgtcttagctgctggggtgaatgcagaattaagcagcaattagtatgagtgaataaattgcatccttagagtgagtgcactatgctattctgggaactaaagactatatttgagaccatgcgaagttgtgcaagtggtggagtagggcagggtgcagtcatttggaagactatgcccatcaggtatctcaaggtaccccagatgtgacaggcccaggagcggaaccagccactttaacttttgcctggctgaaactggactgggaaggatggattaaaaaggtaaatcaattcatacgtagcttgtggtcctttgcagcttaagtgtaggactgaaaaaagaagccaaagaaaaagggaatgagctgaagaaatacacacacgtacacacacacatcaggaagcaacaggcaaggaaaaataaagtgagaggttcaaggcttcgaggaggaattgagctctgtgcattccattcatgggctttgccaaagaccagcacaatggactcagcatctcaggcatggttaagtaccctactgtgcactctgctatccttttagtccactggtttctactctgtctgtgccaggttttcatctcaatatagaggaaaaggattctgatgcctcaggattattacaagcattaaataagatacagatagaatgacgctaatgagtatcatttttaaaataaggaaagttgaattttattcagaatctgttggtaacaaactaatctctttatttaagtaaccccacttagagtttaaagtcacctccaatcaactcaaagggctgacctcccaaagaaagtctcaaatataaggcaagctctcttgattctgaatttcattagaaatgtttgtctaagtctttctcatatggtcagaatgagagagggtgcccttctagtaatatgtcattatgtcaaataattcatcaaccaattttgtttattctctcgaactgccactttggcggcaggggtactctgtctaaatgagatgtctataaagataaattaaacatgattcaggcccccaggtagagttcagttcagtagggtagaacagcaactcagtccagctaccatcagtaatatgtttgtagtaagactaatctgatagtaaggcagaaaaacatctcatggaattttaggaatagccaagaagatgggtcccctggagacttgcacatagcatgttgcatgaaggattcagtgacttgcaagatgggcttgtcttgtcaccttttcaggagacatagctgttcaatcccttgccattgtgtaactaagtgactcttacttgctgctggaatcacttcatgcttttcatgctttaacaatcagtggttctgttttactttgaaaaatgagtcattctatgacagtattcctcctagaccctagcatttcatagcttctatctatgattattttaaattctagctcctgtatctaactgaatgaataagcacatcccacagctcagattcctgaaagaatttgattatgtactcagctaaacatcatcactgtttggttagagcttttatagcaaataattcacagatctttgatgaaactacattgtctttagtgggtaagtgtccaacagaggtctaataaactatgaccaggcaattgataatgccaagcggtagagacacagtgatctctcttcaaaatgcagtttccttcatcagaaagctatgtgtggggagccatttagaatcaagtttcaggcatagcaaatgtttttgatctttcctatccatacatatgtccaaataaatatagtacctggcagaatgtattattatcgtaagtaaagtacataagtgtgctcttaattgttattggtgttcagaggaagacaggctacttttgcctgagacatcctaacaggcctcttgaaaaaagcattggagcattaggtctttgaaggttggctagaatccaaacaagttgaaggggagcaaaacattttaggcaaaggaaatggcatgagaaaaatcacagaaatagaaaatttcatgtggaggacaaataatacttatggtcagatattgaaagcaccatccatcaatgttgaaatcctacacttttgtacagaaccatggattgaagcagttaggagtcacaactgatatcaaagtaaaaaacatgcaatggtgaaccttggtatctttgtctaggaatataaagaatggcttatcagtggagaccatcgacagttgagaaaagaagaagcccaaaaagtacaagaatgaaaatcgagagtgtaagaagaatgtctgttttactggcattatctaacactcagatatgcaactctttattgccaaacactgtgtgtgttagttaaggtaaaaggtgaagggaggcagaagaatggagattgaattgaattctagagctttagttctgtgtgagtttgggcccccagaagttctagacattaagtacagtctgaattgagaaatattaaacatatcttgtgatccaatattcccctaagttatacactcaaatatccaatgaccagcttgacatttctacctgcatgttcaatacttatttgaaacttaatatatcctaaatataatttttttttaaacagtcatgctctgttgcccaggatggagtgcagtggcacaattagctcactgcaacctcagactgctggtctcctaccccatcctcctcggtagctaggaccacaggtgcatgccagtgccagcacacctggcttttcttttcttttttctttttttttttttttttttgtagagatgacatcttgctacgttgtccagactggtctcaaactcctggcttcaagcaatcccctgcctcggcctcccagtgctggggtaacaggtgtgaaccaccacaaccagcctgctaaactgaattccaatttccctcctcaaaatttttcttccccaggtatttttatttcatcatatttcacatatttgcccatatcccaaagctagaagaaagctcctttcctgtcctcactagaaataatctatccaccagtcctatctactttttctccaaactacatcataaatccacactcttctctctacctttgccctcatcaccaaatttaattcaccaccgtttctctcctgaactactgtgttatccttaatcggtctcccttttcaactttttttttttaattatactttaagttctagggtacatgtgcacaacgtgtaggtttgttatatatgtatatatgtgccatgtcagtttgctgcacccattaactcgtcatttacattacatatttctcctactgctattcctcccccatccccccactccacgacaggctccggtgtgtgatgttccccgccctgtgtccaagtgttctcattgttcagttcccacctgtgagtgagaacatgtggtgtttggttttctgtccttgcgatagtttgctcagaatgatggtttccagcttcatccatgttgctgcaaaggacatgaactcatccttttttatggctgcatagtattccatggtgtatatgtgtcacattttcttaatccagtctatcattgatggacatttgggttggttccaagtgtttgctattgtgaatagtgctgcaataaacatacatgtgcatgtgtctttatagcagcatgatttataatcctttgggtatatatgcagtaatgggattgctgggtcaaatggtatttctgcttctagatccttgaggaatcaccacactgtcttccacaatggttgaactagtttacagtcccaccaacagtgtaaaagtgttcctgtttctccacatcctctccagcacctgttgtttcctgactttttaatgatcgccattctaaccgacatgaggtggtatctcactgtttttaaaactcattacagagctaagtggtttttatttaatgtaaatttatatcacattacttttctactcaaaactccccaatggtatcccattaaacttataaaatttcagttttctttctggctcccaaatttcttttttttttttttttttttttttttgagatggagtctcgctgtcgcccaggctggagtgcagtggtgcaacctcggctcactgcaggctccaccccccggggttcacgccattctcctgcctcagcttcccgagtagctgggactacaggcgcccgccacctcgcacggctaattttttttttgtatttttagtagagacggggcttcaccgtgttagccaggacggtcttgatctcctgacctcgtgatccgcctgcctctgcctcccaaagtgctgggattacaggcgtgagccactgcgcctggccccaaatttctttatgactaccttctgcctttgttttttgcatatcacagtttgtcattcctccttccctctttttccctccctagtgcatttagttgaacaagccaagcccatttccaccccaggaactttgcacttgttgccaggttcctccaggtccaggtcttcacatgatgtagacattctcatctatcactttctcagaaggatgaacatgaccctttaaggtagctcttccacactccagtgactctgtcccattactctgctgtttcctcatagctcttaagtctgaaactacattgtttttctattcttcatttacaaataaattgtacaagggttggcacttatgcactctctcatacactgctgtcctgccattactgggagtcacataataggtaccaaataaatacttgttgaaagagtaaataaatgtataaattaaatgaaatcagcaaaactatatgtaaatctaactagcccaaagaaattttatttcctgtaatatcattttgttcaaaaaaccaaacttaggagaggagaaatataaacaaacaagcttgggtgaagtttaaaacgtatgtgattaaatctccattgtcatttatccttttccaaaaagtgggaaatgttgcatgatgattaaacagaatacaatgtggtttcaagaaacatcacacaatcctgtttgttctaagataataaatatggtgttgaaaggaagaaatttataattactaacagcagcaggtggatgaatctctttggtattcatatgaacaaaatactaacattttaagtaaagttaccttttccatgaatatggttttcactcacaaaaaaggattttgttcaggttcaatatgtccatagttttaaaaccatgatccaagaaccactgggggtgggacagtggagttgggatatggagaaagacaagctaagtgggatgctgcttttcgacactttgacaaagatcatccttaccattatctcctcataagatacctagaggaaaaggtgatgacattatatatatttggaagccacaagtgtggtacatatttctagataataagaatggaatgagctaacatttattgggaacttactctgtcctgagcactattatctaatttagtcctttcaatatctctaagttactattattttgtttctcttttccttttttttttttttttttttttttggtctgtgttttgagacagggtcttgctctgttacccaggctggagtgcggtggtacaatcccagctcactgcaacctccacctcctgggttcaagcgattctcctgcctcagcctccctagtagctgggattacaggcgcctgccaccatgccaccttttcccaacctcaggaataatatacttaaccaaccagcattaaactccatgcatgagtttttctcatatatgaaaagaagaaagagggggggatcctcgtagagtcgcacgggcgagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagccaccatgcctggcctattttcttcttttcatatatgagaaaaactcatgcatggagtttaatgctggttggttaagtatattattcctgaggttgggaaaagggagtcttagtgaaaacaaaaggtgtattacctaaagggctcattttctacaggaaaattatggtggctagattatgttttattattctctttcagttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccaggtaagaatgctgggaaggtttttaaattttatttatttatttatttttgctactgcatgtgtttattataatctttgaaaatcattgttgtattacataatagagctgttgcaattatgtttgaaaagcagaagatccctggtgctctcaatcaacctgtcagcctaccttagcctcaaattatctgttttctcccctcctctgaatgaaatacatgcagggtacttatactgtcaactacttctctgaacaattgagtgactgattgaaaattacaggcagatacatttacttgttctctaagcacttgggattcaaagcaattattttagaatgcagtgttagaatagctcttatattctggcacttagtttataataatatgatgtttgtcttagagaaaatattgttttgtgacctggatatattaggagggatgttatatgaatagccatctttgcatgctgtaaagatggcgagtgtaagagttaccaagaaaagaaacaacaaatgcccaacaaatacatactacattttaaaataatgtagtaatctgactctgttctgggtttgaggaagtcatttaaaaaaataaaacataagtagcaaaggtataacaataaaaaatgattcatcatatttagctttactccattttacattaataaaaaaggttcccaggttgaatggaattagtctaccaaactgggtttcgcatcctttataatagtctgattccatttttattcagattaaataaggtacaattttgggtccagtactcaggagccatgaaggtcagctaatacaattttaggatgtctggtttgtataacactaatatatactatgtaataaatgttaaaaacacctatttgtcttcagctatgtacccaacaacctatagaattctggaagaatgaaagaagagaaatacctgtatctgacttaaaattgtgtagtataagttgagggagatattgatggaaatgacagctagaagagacgaaataaaatgaggctataagtgatctgagaccatagaagaaaaatcttctaggtcattctagaatcgaaaattaaaaggacatttttatttgaattgtaagggataaaatactgctatgggagtgaattgtgaggaaataaaatttaggaaaggaattcttaacggaaatgggagataaggggcttggtgatatgtgcatcacacaatgtggaaacctttagaaacagcgaggacccacatgagacaagtcaggtctggttgatggtggccctgccctgatgtgctctctggcctacagggctcctgtactgagtcagaacccagtttaaaaatagcattgtacagccgggcgcggtggctcacgcctgtaatcccagcactttgggaggccgaggcgggcgggtcacgaggtcaggagattgagaccatcctggttaacacggtgaaaccccatctctactaaaactacaaaaaattagccgggcgtagtggcgggcgcctgtagtcccagctgctcgggaggctgaggcaggagaatggcttgaacccgggaggcagagcttgcagagagcggagactgcaccactgcactccagcttgggcgacagtccgaggctccatctcaacaacaacaacaacaacaacaacaaaatagcattgtacctcactaatcaccaggaaaatgcacatcaaaaccacagtgagatatcacctcacacccttttctatgactactattaaaaagtgcaggatataaatattggctaggatatagagtgattacagcccttgtgcactcttagtgggaatgtaaaatggtgcagccactgtaggaaagagtatggcagtttcctcaaaaaccaaagaatagaattaccacatgatccagcaatctcacttcaggatatattgccaaaagaattaaaagcaagatccccaaaagatattagtacactcatgttcatcatagcattattcataatagccaaaaggtggaattaacccatcatcaatagatatgatggaaccttattaagttttaaaaagaaccatgctctacatggttcacatgaatgaactatgagaacatcatgccaagtgaaataatccagacgcaaaaagaaaaatactgtgtaattccaattataccaagcatctagattggtcaaattcataaaaaccaagtagaatggtagttgtcaggaacttggagagggagaaatgaggagttattgtttaatgggtataaaatttcaattttgcaaggtagaaaaattctggagattggttgcacaataatgtgaatgtacttaactgaattgtacacttaaaattgttaacagaataaattttaggtgcattttagcacagcattttaaatatttatcaaaaataaaaacgttttccccttagagaaaagcagcattgtacatataatcacttctgttatacttaaaagttgacttagtatcctaattataggtataatattgattttgattagttatccaatagaaagtaactgaaggattacaaccttggataagtcattgctgattcttaaagataagagatagaaattggtttaataaagaatttaaatagtttgcttgtttaaaaaatatagttttgctggacacggtggctcacatctgtaatcccagcacttagggaggcggaggctggaggatcacttgagtctagaagtttgataccagcctgggcaacatgacaaaaccccatctgtacaaataatacaaaaattaattaggcgtgatggcatgtgcttttactgccagttactctggaggctgaagtgggaggatcacctaagcccagtagttcaaggctgcagtgagccatgatcacaccactgaactccagcctgggtgacagagcaagaccctgtctctaaataacaataattattctaataattttgaatgatgtaaaactttattaaccccaagtgttcttctacatcagtgattgtcaaaatgtgatcccttgaccaaaagcatgaggttcactagagatcttattaaaaatacaagttcttgtgtcctaactcagaattactgaatcagattgttaaggtgaggcccagccttctattctagatcctctaggataagatggtatcctagagttgggtcaattaattccccttcttactattctcacgccagttgcatcttaatgtctaaggattcatgtattcggcaaatatttaatagtcagttaccctactcgagacacttctgtcagaacggttcagagaaccaaagagcaaagctgtcgcatacttgaacgtgtatctagtatgacaacagataataaccaaacttagaaacaattatgctctaccatcatgtagcactctaaatgataatgagggctgtgaagataagggtgtgaccttacccacagaaatatggtgaggtgccatctgaacaaagatgacagcacagtgaggaagtgagcctcatggagcacaggtgaagctgagcctggtcgtggtccacgtttatgctgaacagaggtaccaactcaggagcacatgatgtaggagcaaaaagataacacatttttcataaccatcacaaggggcatggctgatgtttctataacaaagacaggttagcaagagaaaaacccagggaaaacttgagattttatgctaagttgaatgaaagaaatgaatagatgtgactaaatagaattggaatgaaatatgatctaaccgtaatcaacagacagtggcggggggactcagcaagtcctgtatttttggattcttcttgctccctcggtgtagcatttcttccctctgcatatagggcaggacacctgtcatatgaaagtctatccgggagaagggaaaaggtcagtgcgtgagctttctaggttttaaggcttgctgtaggagaggatttcagtttctttgactcacctggctgcaggacacagggcaggggattggagaagatcagaaagaccttgtttctgaggccctctcaaatctccttcagttccaagtactcagcattccaaggcactgtattttagaatactatgttctgacccccaacggtgttgaaatttccttcttttttgttttgacaagatgtgaattcatcaggaaaccagtgttccctatcttattaaagccttccaagagcatctaaaaatggtaaagcatgttggattatttttggagactagcataacaccaagaaaataaactttctttagcagttctgaacaatgaaaaacagaacagaaataaacaagttttgaacaaatgaaaggatcacaactcccaatatgagatttttttttttaatcttgaagaaagtctacaggcatagcctgtacttttttgatgtttttctattatatattatgttttctctgggtttctaatataaattttattaaaataagtactttcattttctattcttagatggtgcctgagatgttatcagagaaaggggtcaaaaatatttttaatcagcttttgtacttatgttcaacattgtcctaaagagcacagctgaaaaataaacaagcaaaagaaaggaggaagagagagagagaaggaaagaaaagaaagaagggaggaaaaaaggaagagataagaaagaaataaaaagaaaagcaagagaaatgcaaggcatacatgtggaaagatatctttctaaaatttttaaaataataaatattcctgtttgaaacatcctcatacctaaatttctgaaagcatactggatagccccataagatatatggcttttgcacagacacaggacaaagacaatctttttcagagtgtcaaactgccatcccagaaacaagttgtgcaaatttacatttcctccaacagtaaagacaattgcctcactaactttggggatcagtaggattgtttttgtttctgttttttggagacagggtcttgctctgtcacccaggctggagtgcagtggcgtgatctcagctcactgcatccttgacctcccaagctgaagtaatcctcctaccttagctcctggggtagctggaactacaggtgcgtgccaccatgcccagctaatttttgtattttttgtcaaggcagagttctgccatgttgctcaggctggtctcaaactcctggactcaagtagtcctcccgcctcagcctaccaatgtgctgggattacaggtgtaagccaccatgccaggcaggattagcagttttaagaatctttgctcattagataataaaataattattccattcttctttgaatttgcagttcttagacaaccgttggagatagttttcataaactccttggtcattgctttcctttttgtcttaagttgctcataatgtatacatttaattttaaactaaaataaatataagtggtaatgtttcattttttttctcttaaggatataaactccttctctcatatatcttaggaattttaagtgaaaatgtccagttaatatagctggctaatagcagaaccagaaatgggttccaaatattgtgactgctagcccatgtgtcttgactcaatcctgcttttacttttttaaaatcactcaattgaagtataatttatggaccataaaattcatccattttaagtatacaatttaataatttttagtaattgcatatgattacactaccattataatccaattttagaacatttcttcattccatttttttatctctagcctaggcaaacagtaatctactgaacttgctgttattttgatctatatagaagattattaactcaaagaatttttttactattaaactatatttggagaaaaaaaaacggtgctgctttcaatattcttttcatagtcaaataaccctctccttcaatcttaccacacatccaggagagagatcagtaaattgacacccaactttagtagactttagtaagtacttataaaatttaaagttatccaaacaagatcttttataattttgcacatgtaattgtttggactcagataaaattggcatagcaaaataatcatgcttcagtttgtctccagggcttccatataacataatagagagcctcttaaactcaactgcttttaggcttagaaggctgtgacagatatgagttatcagtgcatgaaatacaggaaagcatacttttctctataaactagaatcttttattcaacaacagataaagatatgttaaataaaagattttatccagctataaaaggacatgtatttataactgtaattttgatagtctgataaatctctaactttcataagaaaacaattaagagtattccttagttaaaagtttaattttgtagacattgagacttttttttttttagatggggtctcactctgtcacccaggctggagtgtagtggtgcaattttgactcagagcaacctccaccccctgaactcaaagaatcctccctcctcagccccccaattaggtgggactacagatgcataccactacacccagataactgtttgtatttttggtggagacagggtttcaccatgttgcccatgcttgtctcagactcctgagctcaagtgatctgcccatctcagactccaaagtgttgggattacaggcgtcagccgccatgcctggccaatattgggagcctttcatgttacttaaattctgcatttagtggacatatttgtaaccttgttatttcatttgcattggactgtctgctccctgagtgtaggaactgtcttctttctctgtgaatgtgtgggagtcacctaggcagaccttagtgtggagtgacgtccaatcatgaagagggaacagcatttgcaaacacacaagagaaagcatagttactttgatccctaagaatagttttacatgatcaaagaatgtcatgtaaaaagctgggtattggtaaatggtaaataataaggtacggaatagggaatatagggtactaggatgattggtataatagggtgaagagtaaatgagtgcgtgtgggtacctaacagtaagtctgaagaagtaaatgtaatagaagtggaggtaaaggaaaatattcagtaaatacatgaaatactcattaaataaacctgatttagtagtaggagaggcataccatgagccataatttctgttttaggtgaatagtggtgatattcactgatacaattaacttgttttggaaactattcattgaaagaggaactagttttttatttgtttgtttatctcttgttgccctgtcacctgtggccttgacctccgagtccaagtggcagctgttacaagcagtgagaatcaggcagtgacaaagaagaaaagacaaataatgtgtgtgcactctcccttgagaaaggtttcagtttgcctcatgagttttaacacatatatagacctaagcccctgggccagtgtttggtcatggccctgcctatctgcaaagaagactgagtctaaaacacaatttttgttcttggtggccacatgcaaagctaacaattctatttctgtaaaggaaaaatgaaatgcatgtagggtacaactagcagttgagtttagttagaaggtagaaatttgacagtcatcagcatttaggtaatagttgaaactgtgggtacggatgatattatcttggcatcatacctaagtgagaagaaggtggtagaaacaaaattctaggcattgacaaagaaagaactctagaaagagccagagacacagaagaacaaggaaagtgtcgtgttctaaaaccaagggaagagacatattcaaagaaatcagagggcttgccatcatcagctatcacaaagactgtataagcctttcatttagcagtcaggagagctttattaaattgtcttaactttaacagcttcactggaatgacaggcagggaaactatgtacatttctagatgtcattgaaggagtaaagtatcggaaatgagatttttaggcttcttttccaagaaaccttgctgtaaaaggaaacataacaaggaacaaaaggaaatgaatgaatgcttttttcaagcaaggtgggggcttgaatatgattgtgcattgagaagatggtatgggaaaaaaaagagacagacagacagataacagaggtgaatgtgattttcagccaagcagagtgcatgctggatctgttgtctattcccacctttttcagctcatggagcccaatattctaagataatgcaaattgctgaagacaatctttccctactctctaaggatatattggccccaatgtctaaggtcaacattagccagattgagattttacaaagaaatctcaaggtcccaaccaacttttccatatttttgggcaatatgataccaggcataacatacctcagccacaggacaaaggactgggaatagaaagattcttacaaggagagtacactttcacctttgcctgggacaatgtttggtcttttctgtcttgccatatgaactctttcctcaaggaattttatccacaaaggcgtggaaaatctcttttgaaatcctcgaaatacgaagtgtctctccctcagatgccataccactcatcaatctagacctcagagagaactaatgggttcaaaattaggcaagagtatctaaggagtgtgtgcaagtagactgtagtgatcctacatttttctccatcttcttcctgaaattataggaattatattcaaagtccaagaagcttgttgggagcatagccttgtatggggcatccctattggaaaaaggacatgaatatttcctcagtgcaccaccaggaaatttaatattatgaggtacatagcaacacaaaaaaatcttcactcactaccttctgaataatagtaaaaagaatatacttttttatttagtaaaatgcagaaatcatacatctctacaaattttacaacatgagcacctctgtgtaacaagatcctagatcaagaaacataacattgccagcacttgggaaaactgcctcgtaccccctttcaggaactccttctttagggttaaccagtttttctgtagccagtatgcgagtatcaacttgtggcatgtgaatgccacaacttaatatgtatttaagaaaatatgtttaatagaaaataggtttaaaatgaaaatatgtatgtttccatatatagagagagatggaagaatatatattttcttttttaaactaatgccatagtttaattatttaagccagacagctaaaactgcttctttttgtccaagtatatggctcacccctgtaacccagtactctttggaaggctgaggcaggaggatggcttgagtccaggaattcaacaccagcctgggcaacatagtgacaccctgtcactacacacctttttctgttcatacttctatttaacaagtgatgctggaccatgatgttcccagcattttattttttaatttcatcctaagatctgctcttatcccccattaagaaggattggtagaatgttctctttcctaatgacagaagtatgaaataacttgttcatcaggagagtttattattgatattgttaatatttaaatacacattccataaattggaatattttgttgtacagtctgagatttaacacatgtatagaattatattaacacaccttctctcagtatatagaacaatttcataacccccaaaagactcctttatgctagccctttgtaaccaatctctccactatacctctaatccctgataaccactaatctattttatatccccattgtcttttccagaataacatatgaagaaattatatactgtatttagtctttggagactggtttcctttacttaaggaaatgcctttgagattaagcaaagttatgtcaatgaagtgtttcattttattgctgaatagtattctaccccaagaatggactacagtagtttattcatttgtccactaaaggccatttgagctgtgtccaattttggtgattatgaatagctactattaacattcatgtacaggattttgtgtgagtgtaaattttttatctaaattttttttttaagatcagatagtaaatatttcactcttgacaggtctcatgtattctttttttatttttatttttttagaaaaggtcttgccctgtcacccaggctggagtgcagtggcataatcacagctcactgcagccttgatctccctggctcaagcaattcttccatcttagcctcctgagtagccagggctacaggcgtgcaccaccacaccagtctcattttttaactttttgtagagatgaggtttcactgtgttgcctagtctaatcttgaacaaagctcaagcagtccttattccttggccttccaaagtgctaggattacagatgtgagctactgcatctttccaggtctcatatattctttctcttctttttttcctttgtcttctcctagtttttcttctcccatttataaatgtaaaaacattcttagctttcaggccatacaaaaacaggtcatgggcttgatttggaactcaaaccacagtttgtcaagtcgttttagaatgctataagttgattgctggatcatattataggtatatttttaactttataagaaactggcaaacttttccagagtggctgtaccattttgcattttgcattgccaccagtaatgtgtgggaatatctgttgttccccatattcacccccagttggtattaccagttttttgttgttttgttttttagtcacatatgtttgtataagtatcttattttggtatttatatgcatgttcctaatggctaatgaacttaagcattaaacatttcataagcttatgtaccatccatgctctagagaaatgtctgctcaaatattttgactacttttttttaattggattttttgttttttaattgttgagttttgttttttggggattatggagctttttgtttttttgttttttgtttttttaaagagacaaagtcttgtttcattagccaggctggagtgaagtggtacaatcatagctcactgcatccttgaccttcttgggctcaagcaaatctcctgctaattttaacagacagggtctcgctttgttgcccagactggtcttgaactcctgactttaagatatcctcccactttgacctcccaaggtgctaagataacaggcgtgagtcatgttttcagttttaagagttctttatgcatttcagcgtacaagttgtttgttgaatcaatgatatgaaaatattttctcacagtctgtagctatctttttattctcttattagcgtctatcacagaacacaagattttaactttgaggatgcacagtatatttattttttcttttatggattgtgctttagttaccatgtctaaaacctcctcatctaaccatcagtcttaaagacttctttcgcccataatttatttagaagtgtgttgtttaatttccaagtatttgaacatttcccagttttctttttattactgatttgtagtttaattgtattgtggttagaaaacatttgttaaggtttgtttttgacccaggacaatggtctgtcttaatgactctccatgtgcatttaaaataatatttattctgcagctgtttgctggagtgttctttaaaagccagttacattcatttggttcctggcgtttttcagttctggggattatttgtctgctaataaaatgtagacctagttcctcagaggaccctggtcacagatttatggacataatcataaatcccacttaagcactgttccaaattgctgaaactcaattcaatattaccagcaactgtaacaacacaacaaataaatcacattagtaccacaattattaagattgggaaagttttataattagacagttgtcacccaacaaattcatattagatgcttatatttttcttggtaataccagagatccaaataatcaaagcacaaatgaaacaaacacagctgaaatctttatgctttctattactacttataatacaatcagcaacaatttcaggttcaccaatctgcagaaacattgtatatctttagggatgtgcttttcttctttttccttaaatttttggttaaaaaaaaataagcaacacttaagtttctcaaatgaacagtcataatatgttaacattttaacctacgatatctaaacaggagagcattctaataaaacccctaaactcacctggccttttagtagagtattatctttacatacagatatggaggaaaatatgttaaatgtaaattcttttttcttctctctatcttcatttatttatttatttatttgagacaggatgtccctttgtcatctaggctggaatgcagtggtgctgtcagagctcactgcagcctcaacttcctggactcaatcgatcctcccaccacagcatcctgagaagcagggaccacagacatgcaccaccatgtctggctaatttttaaaaatttttccccaggctcagtgtccagctcctgggctcaagtgatctgcctaccttggcctcccaaggggctggaattacaggcatgagccactgcacacagctgaattcttttcaaaaccagcaaatcatacatttctcatagaagttaacttccacagagatgttttattttctttttctttttttttttcatacttcgaggccaaaaaattgtcatcaagatcctagcaattgctgcagccaatcccaggactttgcttccacagtagctattgagcatcaaatgctctcttagatcatagaccacaactttgatgagctttcattcttagctatgtcttaggattctcctgaaatatgaagggtaggaagttgtattccctagttcaagggaaaaaaaaatcaatttaaattcaatggtattaaaaacaatgaatatttacttcaaaaaattattataaagcaaaatatggtacaaactagtttttccttctaaactcaaatacctagctagtaatattccaaaaataaacattaattatatggaaagaatttttaaatttttgcaatgctgaaattaatcagtgggaatactgacgctcttacctgtgggtctttgttcttagagctcccaagatggggcgggccgctcccaagatggcagcaagccttttgttctctgaccttgggttcttggcctcacagattccaagaatggaatcttgggccatgcggtgagtgttatagctctattagaagctgtgggtcacggaagaaaaccatggaacccagcgactagtgttcagcttgattaggatgaacccaggcacttagctgtgcaggaacaatggtgagcctttagcccgatcgggagcagaaatgggcaccttgctggatcaggagcacagcagacactctgctagatccagaggggtgggagtcaatggtgggtctgagatggtggcaaacagcagtggtggacccgggtgggagtcaatggcaggtctgtaacagcggcaaacagcggtggtggacagtgagcaaaagctcagctcaagccgtaacaaacacagaccagaagagcgtgcagttgcaagatttaatagagtgaaaacagagctcccatacgatgggaggggacccaaagggggttgccactccctgcttgaatgcctgagtttatatcccgatcattgtccccttgttgtgctctcaggcgatatatgatttgactgtttctttacctcctgcttttagcctaatttgtgtttcagtgagccctctttactacccgattggtcaggtgtgagctgagttaccagccctgtgtttaaaggtgggtgcggtcaccttccccagctaggcttaggaattcttagtcagcctagaaaatccagctagtcctgtctctcagtcccccatctcaacagaaaaacccaagtgctgttggggaagttggccgaacaacgctcttaactgcttcctgctgaattggggcatagtaggggtcgtgcagttgagatttcctcaggaggagtgcctttgatgtcatcaacataggagcatgggctaggaggctggtccaggggcccacagtagatcttagtcatgcatctggggctccatttgaagaatgatttgtagttttatagctttgattctggaagacacaaacttaacaaggaggttaaagatacagggattgaaatgtaggcctgaagtgcaggggaatatttctttggcacacgtcacaggccctgactatctgcttgatagttttgaaaaggcctggtccagtaaataatgattcggccatctgatgggtgctatcaatgcctaagtgaaagtgttactggggggttctagctcccagagctcccaagatggtggcaggccccttccaagatagcggcaagcctcttgttctctgacctggggttcttggcctcaaaggttccaaagaatggaatcttgggccatgcagtgagtgttatagctctattagaagccatgggtcacggaagagaaccgtggaacccagtgactagtgttcagctccattaggatgaacctgggcacttagccgtgcaggaacaatggcaagcctttagcccgatcaggagtggcagcgggcgcctcgctggatcaggagcacagtgaacacactgctggatccagagaggtggaagtcagtggtgggtctgcaacggtggcaaacagcagtggtggatagcaagcgaaagctcaggtcaagccgtaacaaacacggaccaaaagagtgtgcagttgcaagatttaatagagtgaaaacagagctcccatacaaagggaggggacccaaagagggtagccattgccagctcaaatgcctgggtttatatcctgatcattatccctccccctgtgctctcaggcaatagatgattggctatttctttacctcctgtttttgcctagttagcattttagtgaactctctttactacctgattggtcagatatgagttaagttgcaagccccatgtttaaagatggatgcggtcaccttcccagctaggcttaggaattcttagtcggcctaggaaatccagtcagtcctgtctctcagtctcccttctcaacaggaaaacccaagtgctgttgagagattggccgatgattgctctaactgcttcctgctgaattggggtgtagtatgggctgttcagttgagatttcctctggagaggtgcctttgatgttattaacttggagcatgggctagcaggctggtccgggtctgcagtagattttagtcatggactgcatctggggctccatttgaagaacaatttgtagttttatagctttgattctggaagagacaaacttaacaaggatgttaaagatacagggattgcagcaggtggagcttgcagtgagccgagattgcaccactgcagtctggccttggcgaaagagcgagactccatctcaaaaaaaaaaaaaaaaaagatacagggattgaaatgtatggcctgcagtgcagggggttatttttttgacacacttcacaggccctgactatctgcttgttagttttgaaaaagcgtggtccagtaaataatgatttggccatctgatgggtgctattaatgcctaagtgaaaggtttggtgaagggttttaagtaatttctattgtttagttgcaggcaaaagtatttttcctttttcggtggctagccattctgaggggaggaaactacgtccttgtgaggttccccgttctatttctcctgctgagtagcagcttgggttcccagaggggattaccccatactaggggtccttctataagcatttttaatggagagttctgccttgtggctcttttagctttaatacccgcttggcagtttccttctatttttctttccttttctttctgatgaccccggcagtgtaagactgccacctctttaggtttctgtacagccaataataatctcctaatggcttcctgatgtttgataggtgttccctcagaagttaggaattccctttttttccatattgctgtgtgggcgtagaggactaggtaagaatactttgagtctgtatgtatatttacccttttccctttttttaattctagtgcccgagtgagggctattagttctgccagccgagagctagttcctggagtgaggggattactttcaagtattccattattactgaccactgcatacctcgcttttgaagtcctttttttacaaaggaattttcattaatatacaagttgagttagggattagtcaagggaacctctagaaggtccctcgagtggtataggtttgaacaattacctgttgacagttatgttttatctttttcattgtttggaagaaatgtggcggggttaagagttgcgcaagtatgcagttgcagcactggccctttaattaatagagcctgatatttaagcaaacgattgtctgacagccacaagtctcctttagcagtgagtatgctgtttacatcatgagatgtccacacagtaagatctcttccctgtattattttaactgctttacatactaagactgctactgccgccactacccgtaaacaatgatgccaaccctttgccactacattaattttcttacttaggtatgccatggtttgcaagctggtcccttgaacctgtgtaaggactcctggagctatttctgttttttgtgacatatgaagaaaagtcttgccccgttggtaagcttaacactgagtcttgggttaaggcctttttttagggcctggaaagctgcttttgctttaggagtccattttactaaatgggtattggctttctgagcttccttaattagtgtatataatggcctggctattttgccgtacctgggaatccatatttggcagaagcctgttatgccaaggaaccttttatttgctttagggttttgggatgaggataagccagtataggctggatacatttcttactgagggccctggtgcctttggataattttagccctaagtatttaacctgctgtaagcagagctgagcctttggtttggaaaccttgtagccacaagtggtgaggaagtttaaaagcgcttgggtggcttgatggcacaaggttttttcaacaggcagctagaagtagattatccatgtaccaaaggacaagactgttcaggtatgagaactgtctcaagtcttgagctaatgcctggccaaatagatgtgggctatctcttaacccttggggtaaaacagtccaggtgagttgagacattgggtttgaagcatctttaaaggcaaataagaattgagaatcagaatgtacagggatgcagaaaaaggcatccttaaggtccaggactgtaaaccactctgcttcctctggtatttgggaaagcagagtagaagggtaaggtacagctgggtatagaggaacagcagcctcactgataatcctgacatcttgtactaacctccactgtctattgggcttctttactcctaaaattggaggattgcaggggctattgcatggttttactaggagtagggcttttaggtccttaacaattttttggagtccttgttgggcctcgggtctaagggggtactgcctttggtagggaaaggaggtggaatcctttagtttaactagaacaggacgggcattatttgctcgtccatattgtccttctgttgcccagactttaggattaattcctttttcaagcaggggacaacaaacgggtgttccttttcctatgttcaggtgtataatggtccctgcttttgttagaatgtctttccctaacaagggagtggggtttttaggcataattagaaaagcatgtgaaaagagtaaagttccccagtcacagcttagtggctgggagaagtatctagtggctgtcccaggaccccttggatagtgacagatctggagacagttgtccaggacaggagagtaagactgagaaggccacgccagtgtccaggagacagttaacctcctggccctcaatggttaagcatacccggggctctgtgagggtgatggcatgggctggcgcttgccccaggcaccctcagtcctgctgctggatcatctggttagtggcttctgactcagaggaccttcgtcccctggggcagtgggccttccagtgattcccttgacataaggggcatggacgaggggggtggcttatttctattagaacaatcttttttaaagtgtccttgtagatcgcactggaagcaagccctattaggcattcaatttgtccagactttccctgttccagagcctccgaagtcgtgcttgcctgagggccatgactaaagtggtggccttttctttatcccgtttatcctgttctgcctgctcctcctgatctctattataaaaaaccgaggttgccaagttcaatagggtttctaagttttgctctgggcctaaggtggacttttaaagtttttttctaatgtctgcagctgactgagtgataaacttaacctttaagattagttggccttcaacagagtcaggtgacagagagtttgcttcctcaatgcctcccttagtctctacagaaaggcagtaggattttcttcctttccttgtgttatagtgaacatcactgaataatctataggcttcttcctagttttccttagtcctttagcaagcaagttagcaaatgtctgtggcaccaattccatgttctgattctgtgtcccaatgagggtctacactgggaactgcctgctggcctgtggggaattgttctttttcctctgttgtcatcctatcattgacctgactgagataccagagatcaccaaactctcaggctgcagttatggcagcacttctctcatttgggattagtgtctgatctagcagtaacattatatctctccatgtcagatcaaaggattgtcctaacccttgtaaagcatcaatatagccaacagggttatctgagaatttacctaggtctattttaatttgcttcaagtctgacagggaaaaaggtacatacactctgacaaggccgaattctccagaatacattttaggggtgtttttgccttggggggaatgttttgccagcacccctagtcattttctgatgagcttagttctacagtgttctctatggtcctttccacggtgtgtaaccacccatggacctctgcttatcggattagttgtgctcaccaatgtagcagtcctgcaccccttttcccgcctttcttgaccacaaagaaagggatccgggctgctggattctagtggtcctttaccagcgtgcccaacattgcctttgtgctcaggggtgagtcctagagctgggctgagttcctgagtctttcataacaacccggctgcccatcaagatgcattcccataaacaacagttcttatgcaaatccgtttcagagagggtgaaggtaaccttttgagtcaggagtgagatggagttctttgcccactagggtctttgtccttctttacttttgtaggaatatgccctaaatattgatattaagctttttgttgccccagattaagtccttttgggtacgaaatatgagagagggatcctgtttatcttatgtgcctttttcctacgaggagagcaaggagaaaaagatgggcttgctggttttgtaggtactttaaggcttggctgagtgcaaacagctcacacgtttgacagaccaacgattagggaattctcctaactcttcttccacaagagtctcactatcaattaatgaatacccattgtggtttttttctcaatcacccgagaggaagcatctatccttgtgtcccgaagggagttcctcctaggtctggtaggacctttgtatggtaattaagatttaaatcccctgttaggaaagctgctaggttaagggaattttcagtggttagtgttaaatcaccgttttctaatagaatagcccgatactttaagatttttgagttagtaagctacctttttgcttttttgacttaggatagctctgaactggttatgtgtgctcacaataaggtttcctctaaaggttatttttctactttcttctgttagcaaagcagttaccgctactgattgaatgcatttgggccatttgtgggttactgggttaagaatttttgataggaaggctacaggttgtcagtggtctcagtgtttctggctatgcccttgtttacactgacaacaaggtagtattggagtattatagggtcacagagaagaccttcgattatcaattataggttttaaatttaccctggcttttaaaggaatagggcacactgtttttctttactacttctatctttctatttctttctctctctctcatctctgtctctctctctctcctctctgtctctttctctcccttttctctctctctgcctctttctctttctctcctctctgtctctctctctctctcatctctgtctctctctctgtctcctctctgtctctgtagatggattttggaaaacagcagaaggaagttcgcttgttgaccccatttgccactataggaatatgtgcctccctttagtttactcaatttgctttcatcctgatctattatgttgttgtagacccagttccagaagttaaagtactaggtcatcagttctaaggccctggccaaggagccaaggcttgaagattgtattgaagattgcattgtggggtggtgggtcgggggatgctgggtagaaattaggggaggagagcatcttacacaatgagagaggaatcctagccatttacaaactcagggcctggcaagagtggtggagaacgggtcccacataactgcccatgtcaaaagttatatacctaaattgggaggggcaccagggacaagattccctggtttcatagcctagatgcctaaggatgcagcatagcgcttccttagatccctttggagatacaacctactctaatacttgggagagaaagtgaaagtctgaagcattagtatctaggaggcagggattggaggaagtagattcagaggtaaggagaattttggggctacactttcaagaaagtcatggttaggacccaagaggtatgggtcagaaggacaggtaggggcgcacacatgggcgactgttgagtagagacttctagcctgcaccatgatctcgaccggccaatgccaggggttcaggacgacagctttctgcctctagttgacccttggcatccctaggaaaattgtgaaagtggaagctggttccaggcagaccaactctcccaacccagaagttgttagaaagccttttcccaggaagcctcacacctgagtctttagtccggtggccatgctaatcgtttttaaccagctgacaggtgcccggtattttcctccaattctaaggtagaggacagaatagcaagcaaaagtggtctgatattactcactgctttggagaatccccatacgaggccaccaaatgttaccagcggatctttgttcttagagctcccaagatgatggtgggctgctcccaagatggggcaggccactcccaagatggcagcaagccttttgttctctgacctgggcttcttggcctcacagattccaaggaatggaaacttgggccatgtggtgagtgttatagctctatcagaagccgtgggacatggaagagaaccatggaaaccactgactagtgttcagcttgattaggatgaacctcggcacttggttgtgcaggaacaaaggtgagactttagcccgatcaggagtggaaatgggtgccttgctggatcaggagcacaacctgccagatccagaggggtgggagtcaatggcgggtctgcaatggtggcaaatagcagttgtggatggtgagcgaaagctcagctcaagccgtaacaaatacggacaagaagagtgtgcagttgcaagatttaatagactgaaaacagagctcccatacaatgggaggggacccaaagggggttgccactccctgctcaaatgcctaggtttatatcctgatcattgtccccccgttgtgctctcaggtgatatatgatttgactatttctttacctccttcttttagcctaatttgtattttagtgagccttctttactacctgattggtcaggtgtgagctgagttaccagcgttgtgtttaaaggtgggtgtggtcaccttccccagctaggcttaggaattcttagtcaacctaggaaatccagctagtcctgtctctcaatacttcaaatattctttacacagacaagccatttaaaaaaaattagagcttacctttgcttttccatcaaaacatattgttacttctaggtttcctcttcaatttgcaaaaggaaaaggaaaatataggtaatttctcaattaaacttacacctgattttcaatatgagtttgtttattgagtgtttgtatatgtgtgtgtttggcagttagaagtatgctgagatttttattcttttagcctttgggggaactggactggcccttcacctctgtcctaatgtagctttttaattttattacaaatgggaaacaatgtaattttctgtatgtttcatctgtgaaaagtattggaaagttttgagttcatatgtattttattattgaattttaaaatatttaaaatgaacttaattaaatcttaaattacagtaaccttatgctgtagtaagttgaaggtaagctaccttctgtgaccttgaataatttaattaaattgagaagtctgttttttttttattatttgttttgtttttaatgggtaaattaaatgccaggcctctgaagtgagttcatataaggaactggttgtgggattttttttaaaaaaaatatgcctatattagagtcctacaccaaaaaaatttagagtttttgactcaaacccaggcactggtatttgttcaagctcctgatgtgatagaccagtatctaagtcctaataaaatatgaaatgatcaattttttttttttgagatggagtcttgctctgttgcccaggcttgagtgcagtggcacgatcttggctcactgcaagctctgcctcctaggttcacaccattctcctgcctcagtctcctgagtagctgggaacacatgcgcccaccaccacgcctggctaattttttgtatttttagtagagacagggtttcactgtgttagccaggatggtcttgatctcctgacctcgtgatccacccacctcagcctcccaaagtgctgggattacaggtgtgagacaccgtgcccagccaaaatgatctattttctaattatataattcaaaaaattgtttcaggaatattattctaaccagttttaaaagtaacatatcaatatatgtatgacattaacattaatggcagtttgtctctttcaaacacagactatctggtacttgtatctaacaatgtatttacaattgtgatcatatatggctagtgttgatgctattaataggatgttccaaacatatatcaagtttttttttttttgtggaagtcattatgataggtaatccatatttgtagaagatataagcctttacacaaagactttaacataattacaattcagattaaaattagctttattgggatgccaacaatgaatatattaaagggacatacaggcataactcattttactgcactttgctgtttgtattttttttttaatttcaacttatattttaggttcatgggatatatgtgcaagtttgttatatgggtaaactgtgtgatgccaaggttttgagtacaaatgaccctgttacccaagtagtgaacattgtacccaataggtagtatagttcctccctttatagctatatgtaccaaatgttagctcccatttaaaaatgagaacatatagtatgcagttctctgatcatgcattaattcatttaagataatggcctctggctgcatccatgttgttgaaaatgacatgattgcattctttctatggctatgtagtatttcttggtgtatttgtaccacatgttctttatccaatccaccattgaaaggcatctagaataatttcatacctttgcttttatgaatagttctgcaatgaatctacaaatgcttgtgttttcctagtagaacaatgtatttttctttaggtatatacttggtaatggggttgctgggtcaaatagtagttctattttaaattctttgagaaatctccacactgctttccacagtggctgaactaatttacattcccaccaatgatgtataagtgttttatttctttgcaaccttgtcaccatctgttattttttgatgttttagtaatagccattctgactggtgtgagatggtatctcattgcagttttgatttgcatttcactaacaattaatgatgttgagcattttttcatatatttgttggctgtatgtatgtcttctttcaagaagtgtctattcatgttctttgcctttttttttttttttttttctttgagacagagtcttgctctgtcccccaggctggagtgcagtggtgtgatctcggctcattgcaatctccacctcccaggttcaagcgattctcttgcctcagcctcccaagtatctgggactacaggcctctgccaccaaacctggctaattttttgtatttttagtagagacggggtttcactgtgtttgccaggatggtctcaatctcctgacctcgtgatctgcccgcctctgcctctattctttgcccattttttaatggggttatttgtttctcgcttgtcgaattgcttaaattccttatagagtctggatattaaatatttgcaaggaatagtttgtgaatatcttctcccattctgtaggttgtctatttactctgctgatagtttcttttgctgtgcagaagctctttagtttaattaggtcccacttgtcagtttggggggtttttgcaattgttattgaggactcagtcacaaatcctttgtcaaagccactgtccaggatgatatttcctaggttttcttctaggaattttataattttaggtcttacattttagtcttatccatcttgagtcaataattgtatttggtgaaaggtaggggtccagttccattcttctgcatatttctggctggttatcccagcaccacctattgaataagagttcttaccccattgcttgtttttgtcaactttgttaaagattagactgttgtagatatgtggctttattctgggttctctaacctgttctattggtctatgtatatgttttggtcccagtaccatggtgttttggttattgtagccttgtagtttgaagtcaggtaatgatgccatcagccttgttctttttgcttgggattgctttggctattcaggctctttattggtcacatacgaattttagaatagatttttctatttctgtgagaaatgacataggtagtttgataggaatagctttgaatctataaattgctttgagcaatatggtggttttcatgatattgattcttccaatccatgagtatggaatgtttttctatttgtgtcatctataatttttctttgagcagtactttggagttctccttgtagagagctttcacctccttggttagatgtatttcttagtgttttactgttttttcgctgttgcaaatgggattgtattattgatttggctctcagcttaaacattcttggcatatagaaatgctcctgattttttaatgttgattttatattctgaaactttactgaaattgtgtagcagttctaggagaattttggtggagtctttagggttttctaggtatagaatcttatcattagtaaagatagataattttttttctatttagattccttttctttctttctcttgactgactgccctggctaagatttccggtactatattgagtaggagtgggagatatctttgatttgttccagttcttaaggagaatacctccagcttttattcattcagtatgatgttcgctgtgagtttgccatagatcgctcttattgttttgcggtatgttcctttgatgcctagtttgttgagggtttttatcatgaagggatattggattttactgaaagctttttctacatctattgacatgatcatatggtttttgttctcaattatctttacatcctgaatcacatttatggatttacatgtgttgaatcaattctgcatcccaggaataaaacctacttgaatgtggtgaaataactttttcatgtgcttctggatttggtttgctagtattttgttgatgatttttgcttcaatggggatattgacccgtaattttgttgttgttgttgttgttgttatttctttggcagattttggtatcgagtgatactggcttcctagaatgagtcggggaggagtcaccccctccttaattttttgggatagtttcagcagtgttggtaccagctcttctttgtaagtctgatagaatttggctatgaattcatctggcacaggactttttttggttggtaagattttatgactgattcaagttgaaactctattggaatgttcagggtcttagtttctacctggtttagtcttgggaggttgtatctttccaggaatttatctatttccttcagattgtctagttttcatggataaagtgttcataagagtctctaaggatcttttgtatttctttttttttttttttttttttttttgagatggagtttcactcgtgttgcccaggctggagtgcaatggtgcgatctcggctcaccacaacctctgcatcccaggttcaagcgattctcttgcctcagcctcccaagtagctgggattacaggcatgtgccaccgcacccagctaattttgtatttttagtagagatggagtttctccatgttggtcaggctggtctcgaactcccaacctcaggtgatccgcccacctcggcctcccaaagtgctgggattacaggcatgagccacagcacccagctgggatcttttgtatttctttcttccttttttttttttttttttttttttgagatggagtcttgctctgtcacccaggctggagtgcagtggcacgatctcggctcattgcaagctctgcctcccgggttcacgccattcacctacttcagcctccaaattagctgggactacaggtgcccgccactgcacctggctaatttttttttgtatttttagtagagacagggtttcaccatgttagccaggatcatctccatctcctgacctcgtgatccatccacctcagctcccaaagtgctgggattacaggctggagccaccgctcccggctggatcttttgtatttctgcaggattagttgtaatgtcatctttgttgtttctgactgtgcatatttgaatcctctgtttttttctttttaatctagatagtagtctgctgattttgtttatccttttaaagaaacagcttttggtttcattgatcctttttatgaatatttaggagttgatttcgttttctcctttgatttcagttatttattctactagcattggggttagtttgttcttgcttttctagttcctcttggtgtgttactaaattgggaattgcagatcattctaacttactgatgtaggtgcttagcactataagttttcctcataatactgtgtttgctgcatctcagagattttggcatgttggttgtgtctctgttttcatttatttcaaatttttttttgatatctgccttaattttattgtttaccccaaagtcattcaggagtaagttgcttaatttctatgtaatagtgtacttctgagagatcttcttggtattgatttctacttttattccactgtggtctgaaagtatggctggtatgatttcaattttttgaatttattgagacttgctttatctccaagcatatggtcaatcatagagtatgttctgttcacagacgagaagaatgtataatctgtggttgatgggtggaatgttttgtagatgtctattaggtcccattggctaagtgttgaattgaagtctaaaatgtctttgttagttttctgacttgatgatctgtctaatgctctctttggggtgttgaaatccctactagtattgttaaccatctaagtcttttcataggtctagaagtacttgttttatgaatctgggtgctccagtgtttgctatgtatatatttaggatagtttagtattcttgttgcattgaacattttatcattatgtattgcccttctttgacctgttttattgctattggcttaggcagtctggccactccttggcaccattacagtagcttctactggggctatggcagctgatgcctagctgctcagggatccaaggcctgtgcggctccactgggcttaagtggtacccctgcaaagattccaggctggtctctgtgttgatttggagttccactgaggtcaagggcttctcccatgcccaggattgcaaaggtccatggcagatgtttggatcccctgggaactctcactcatcaaccctttcctgacttagggaactttccccaggtctgtactggtcccaggtgggcaagtccttggctttgctcctctcttctctgtgagtcctcttgctttcttgttgaatcccaacatgacatcttagatgatctacttgaagtcgtagcatttactcaccactttgttttctctccatgagagcagcatatactagctacttctagtcagccatcttgagcacctcacctgttttccagattggaaaactgcccatatctggggagctctgcatttttctttagagtgcttcacagatactgcattttttacaaattaaaagttagtggcaactccaattccagcaagtctataggcatcatttttccaagaacatgtgctcactttgtgtttctgtggcacatattggcaattctcacaatatttcaaactttttcattattatatctgtaatagtaatctgtgatcagttctctttgatgttattattgtcattatcttggggcaacatgagctatgtccgtataagatggtgaactttatcaataaatgttgtgtgtgttctgactgtgctagagaccagttgtggggatatgtgagggcagccatgttgccaggcacatgtggggacaagaggaagacaagggaaatcaccatgtttggtggacccagtttctaatggcctttatttgcatattaaagcttgcctgcaggctctaagagccggggctttcctgttagacaagaaacatttctggagctgctttaaaagaaacaaaaacttcccaaggacgccttttcatctctatctgcctaaaataatttcttaataactcctataacaaaaatatactgcaaaagggtcatacctgagaagtctgcttgttgagttgtggtaatttttgcataaatattctagaaatatattgtatgaggtgggaagtggtggtagtgagcagatcgtgagacatcagcttaagtattcattaactacttcaggaaactggagattggaggtctccagtgggaaggagattttcatgaactcagaaaaaatacttcataagggaaagagctaaccaaaaagcaccaaagctggactaagattttcttgcctttctttttccactccattggaggaataagaagcagcagcagtgaggaacaagaaaataaattgttaatagacacattcctttgttccaaactgcagtttcctgaacttaagtcaagcatgagctagggctggggagaagatttaaatctgaagtgatgttgatattttgaaactagttcctaggttaagcttcatataaactaaaagagtaagctcataaggtccacagtggtggacatttttgatgcactaaaatgctcctcaagcaataaagtgagttttcagaaccatgagctttatagcaatcatactgtagccttttcaaagaaaggagcattccagaagaatggctctaacactgttgacttaaggactaactggagcaagccctgcttgttaaaagctgaaaatcttgagctcgtaaacaagtttgaagtcaagtgaacttttaagcagagtgctatgggttgaattatgttccctaaaaattcatgtgttgacagcctaaccacctgttcctaatactgtccttacagaaataatcaagttaaaatgagatattagagtgggccctaattcaatatgttgtgatgttcttataaaagggggaaatcgggaaacacacaggcatactgggagaaggccaaacacacaagagatggccatctgtaagccaagcagagaggcctagaacatattcttccatcacagtgcttgaaagtaatcaaccttgtcaacacttgattttggactcagagcctgcaaaattgtaagacaataaatttatgtttaagctacccagaagctttagttctagaagccctagtaaactaggggggcttgttacatgaagcaagtattcccagctcaaggaggatttactgaatgtggagacttggctgatagggggaactgatgaactcttttaacatgcccaatctgtgccagaatttgaagtgtgaccctaagacaaggctcaaaaatctctgccttctttttggaataaagtttttaggatcactgccacatttattttttaattatctatggcttttttaatcctatcataacaaaaaagaggaattgcagcagagactgtatggcttggaaagcctgaaatatttactttctggctttttacagaaaaagtttgccttgccttgcttaaaacaagggtactggttacagatcctgcctgctgggtattaacagaacaaatgcagcaaatgatgctgatctgaacatgaacccacaggatccccagatcatgacacctctcagtgtttactcagagtagatctggacagtatggattaagaggaagaaattgagacaccttaccccccttttcctccctctaataagatcaggctaaattcaatgcaggaagactttccagggaataagaagcaaaggcactaaaagaaagagttggaaaacaatacctacaagaagagtgaactgcggtcttgaagcattgtgacttaaccaaaattttgggatttactaacaggacatgtgttaatcaagcagttcactttgaaaaggaaagttctagtaagctccacggcctttgtgaaaaggccattgaagtgagagagaaaaccaagaggaccattgagaaactgcaaaaaatgtatgccctaattggcaatacctactttaaagaaaaatgtaataatatcacaatctctacaataaatgttttagcatagcactaaacccacaatatgctaaaaaagttgtcagtagaggagacagaaaataatcctaaagaacaggattgactggtgtacattaatcctgacttgcctttgggaaaaaaaggtaaatacaataaatgcttcagaaaggggaccctctcccacttcataagcattaaatactaaacaagatgtgcaacagaatccacacgacattgagttgtgcaagagtcagcagttggcactgaaggactgggaactatggatgaacccagagctcccatattctcaagggttgtgtagagaaagcacaggagccatgaaaactgtggatataatcccaaaggcactaaacttggactcaagctataaggagattatcagtaatgtccaaaccattgatgtgataaccttttattaaaaaaaaaaaaattaaatagagatggagtctcactatgttgcccatgcttgtcttgaactcctgggctcaagtgatcctcccaattttgcctccaaaagtgccgggattacaggcatgggccactgtgcctggctgacatgataaccttgaggatgggaaatggggaggcatatctaatcctagatccaggaaataatggataccttaaccaagaggaatcttctggcacacatgtgtaaacaatatatacatatattttattggtcaggcttaaaagatgccaatgaaaaacaatatctataaaagggatcaggttgaaatagatggtatgtctttaaaaagtctttaaaggtttaattaagtagtctgaagtaaagaccaacatagtacttaatgattccagtgaaatataaacaagaagcttagtctttttttccctaagatataagagaaaactcagtagtttacaaatgtgattgtaaacttgtgactttctggactacgtcttaagcacatggattggtttgtttgcagtgggttaactgtaggataaaaatcatcaaagtttgatttatatgaataagaagtagatgtagaaaacaatctttgcctatacatgtgttagtactatgtgtacgtgtgtatggatatagaatgaaaaaaaccgcataaatccagtacatctacttaagttatgtaaataattatttgcattttttaaaaaaattgccatgtctacaacacaaattagtaccgtgttagtacttgactaaattctggtaatcttcttatacaattagataggctgatgtatttcctaattaaaaacatttgtttttaactcttttctaatgctttggcaattcatgattggaagtagttgctaatttagatttcctcatggagcacagtaaatatgagagatcctcataatagcctctataggtttaaattatattttaaatgtaaatgcaaaagttaattattttttagaggacctgatgtcatccttgggagtaatttttaattactttttatccttcttagagttgattgtattaattatttgtactggcttaacaataccatactgaaaaagcttttattttttttttttttttgacatttcttctgtttcagttgatttatcattagtgaataaagatgaaaatgccatctatttcttgggaaattctcttggccttcaaccaaaaatggttaaaacatatcttgaagaagaactagataagtgggccaaaatgtaagtattattttaaaagctactactctacatctcatacaaaaatttacaaaatcacattaggttgtctaatatttggaaagatgtgtaatagaatcctagtacagtcatcccttggcatctgtggaggattagttccagggcctccctatcattccaaaatccacaatggtcaagtcccttatatacaaatggcatcatatttccaaagaacctaggcctatgccatatactttaaataatctctagattacttataatacctaacacagtataaatgtcatgtaaatagctgttatactgtattgtttagggaatagtgacgagaaaaaaagtctgtacatgtttagtatatatgcagccatccatttttttccccaaatatttttgatccgcagttggttgaatccatagagagggaatccatggatacagagaaactttagctgctcagtagtctcatttgattgatgaaataactgaggatcagaataaggtgacatagcaagctagtggcagaatcaggactaaaaacttttacaatatttaaacgtttaagttcctctcatgtgttgacatctctaaaccacatgtaatcattttattttatttctttagtaactaacagaggagttaatattctgaagcttaatttcttcatgattaggctaaattatcaacacttacttttatgataaccagaaatattttctaattatttgaaactgaaaaatcaatatgaagatgagccaaacttgacagttaggaaaacgtttcagaaagatgaaaccaaaccaaatagaatttcagaggaaaaacatttggctgtcatagaaactcagaatacattctttacctttcttcattcttcatgctactggttttcaaattgggaacaatatccattctttaaagtttagtaggccagtcacaatggctcatgcctgtaattgcagcactttgggaggcagaggtgggcagatcacttgaggccaagagtttgagaccagcctggccaacgtggcgaaacctcacctctactaaaaaaatacaaaaattaggccaggaatggtggctcacgcctgtaatcccagcactttgggaagctgacatggatggatctcctaagctcaggagttcgagaccagtctgaccaacatggtgaaacctcgtctctactaaaaatataaaaattagcctggcatggtggcaagtgcctgtaatctcagctattcaggaggctaaggcaagagaattgcttgaacccgggaggcagaggttgcagtgagtggagatcaccactgtactccatcctgggcgactctgcttcaataaaataaataaataaataatgtttagcttacactgtgcaaatgattacaactatggctattagataacactgtgaagttcttaattttagtgattaagaacgtaatttcacaacttgatgtaagaatgatagtttatataatttattaatcatgttataactttatctgcataacttttatgcataatttgcaaaatacataccaccacatttgctctagcaagttttagtatttaatgaatgggggtcatagttaataaaaatggttaatattcatttttggccttaatgtaagagagggcagataattagattgaatgaatttgaactttatagagtgtccttgcctcttggatattcattcagcaaggttgtgaatttttatcccctaagcatttaaaatatattctgccctgctattctattcatatccttatggtcatccacttaagtaagaaaccggttgattattttcaagactttaaagttgcatttcaggaaagcacctcatgctcttctattgttttgtcttttatatttcaccttgtgatgatggaaaatttcatcattttaattaaaccttcttactgagttttcattagacagatgattcagaaaggctgtatattttaatgcttcaggcaatgtacagtgaattaaagaagacttctaagcaaatggacatctattccatcctcgctttgtttattttagtcttcttgttttaagctgtagtgactcagtcaacatcatggacccgcccataaatgtctgtggtgtttgggatgcctgatcacctgcctctttttcctacctcacccatcgtttttgatcccaaaagtgtttgctcattattattttttacctcccaaatatttagcttaaaatcccacttctgatgttttccagctgaagttctgttgggaggaaactttttctctaccaaatgagtacttaggtcaaagtgattgagggcctgccaattaattgacaacagacaggttaacaggagaaaagtttatttcacactcagatacaagaattctacaaggggtagtttgatgaacagccatgggtaagggtttatataccagcttgactaaagggaagagttttagagcttcagtgggaaaatatgaaagtttctattgggttttttcatcatgatgctaatgggcagtatccttcctagctggaagctcccaagagggagatgaatggcagctgaatttgtacctccaggtgctaaggtccatctacctctgaggatgggtcagtagcagctgtatttttaggaggctttgcttaagtttagataaatttctttctgtggctgctctttgttcagatgtgttcaaagtagtcagaccaggcatagtggctcatggctgtattcccagcactttgggaggccaatgtgggtcactttagcccaggaattaaaaccagcctgagcaacaaagagatggatgcagtggctaccatctgtaatcccagcactttgggaggctgaggcaagcggaccacaaaagcccagtagttccagaccaacctgggcaacattgtgagatctcaactctacaaaaaaatacaaaaattagctgggcatggtggtgcatgcctgtagtccaagccacttgagaggctgaggtgagaggatcatttgcacccagaaggtcaaggctgcagtaagctgtgattgtgccactgtactccagcctgggctacagcaagaccatgtctttaaatacatacatacatacatacatacatacatacatgtagtcttcatgccacttcagtggtctgttggtctcttcagttttcattctcactgttgccttgtttttttgtactaaaatcaaaccctgcatgtgttcagttgcctctacatccagggcctcccattattgtggtaaattttatctgatcacttcttcctctttgcctccctctatgccacttctgctctacttcttggttgatactcaagccaggtcagtgactccctttcttcttgaccaatggaagattatgggaatcactgagtcaaagaggattacacacttattaaatactacaatgcacattgaaagtagttgcttagttgaaaaagataatgttaaaaatgtataatcttgaccaggcgtggtggttcaaggctgtaaccccaggactttgggaggccaaggcaggcagatcacttgagttcaggagtttgagaccagcttgggcaacatggtaaaaccctgtctctacaaaatatacaaaagaaatttagctggatgtagtggcacatgcctgtagtcccagctattcgtgaggttgaggtgggaggatcgcttgagcctggaatgtgggggtttgcagtgagctgagattgtgacactgcactccagcctgggcagcagagtcagacccagtctcaaaaaaaattataatcttaacagtaacataaaaattagagtgcttcaacaaagcaagattttacacaggcatatagatgtcaaatctctgtctatccaagtattgtaaagtaggaaatgccatttggctcacggattccatcttctccagttttatggcctattgcagacatattgcctaccacacctaagtattgaataaatgattttttgtcataatgcagcctgattttgtaattcataaggctaccatctttgatttcttatactaaggaaaagccaagaatagaggtacaactagaaatattttaggatctgtcttggtttgttcccgctgctatacaaaatacctgagtctggataatttatagagaagagaaatgaatattcttacaattctggaggctgggaagtccaagatcaaggtgctggctgacttagtgtctggtaaggtctgctctctgcttccaagatggtgcttcttgctgtatcctcatgtggcagaagaggcaaacacctgcctcccacctgttttacaagggtactaatcccattcatgagggctctgcccttatgactgaatcacctcctaaagactctacctcttaatactgtcacattggcagatcaaattttaacataagaatttgaaggggacacattcagatgatagtagaaccaaatgatttctaaaacttacacttatttaaggaaaactgtgaaaatagttttcttagaatcttttacctctgtgttagttttaaaattctattaccattaatttgcattttcattttcaactctatgggatttctaaagtagattaataacacattgaagaatatatttgttttgcaaaatggcaatatttaggcaattccagtattctgaaatataaaactttttgggtgattatatttatttgatacttaataattataagtaaaaaggttttgtaacaagaagaagcaacaatatgcctgaagcctatgggtctgttggaatgagtaggcaataggcatgaagtatttgggaataatagtttatattaaatatttactaatgacctggattatttaatgaagaataacattggttaataatcataatgccacaattcagctagaacagaaggatatatcagtcctaaagagcatattgtaagctgggagatgggtattatgttcctaaaatagaatcacaatattttaggtcatttacattgtcaaatctgctacataaagggtgttctctctttttcataagagcaaaaacctactacagttttgtctctacagggattcttctaagaactgtgacagtttaggtaagattatttaaagacaaaaatgtccctttgaattaaatatcaggaataaaccacagagtttactttacatggcagtgtgtgtgtgctgacaggacactgataaaacatgccagagagatgtagatgcctccttcagacccctctagtctcatttaatttaaggatttcttccattaaaagcaatagtgtttgaataagagagcactaagaaaatacatagaatggcatgttacaaagatttttcacaacatctttgtttttgtttttctaattaacattctttttttggagtcagggtgtcactctgttgcccaggctggagtgcagtggcgtgatcatagctcactgcagccttaaacacttgggcccaggctatcctcccacctcagtctcctgagtagctacgactataggtacatgccaccaagcctggttaattttttctttaattttgtagagacgacgtctccctatgttgcccaggctggtctcaaacacctggtctcaagggatcaacccaccttggactcccaaaatgctgggattacaggcgtgagccaccgtccctggcctctcaacatctttattggctaatcatcaattggatcatggaaaaaaaattataatgtaatgaaggcagcccatgaaattgtaattatttacttatggaaggaagctttctaaaaacagggccatttttcactttgtgggatggttacagcatggtcctactttaaagaggatccaggtttctattaacttcctaattttacatcctgcaattctaattttgtgagtaaatactcctagtagatgtctcagaaaacacccacttatagcaatgatttattctgtggcagtgagttaactctctcccatgctctcttttcctttccagcatttgtaaaagaagattacatctatgctgcgactattttaagtagctttgtttgaacaatatattttttcttaactttaatactgatgtttataacggcactttaatctacatcaactctttctaatgacaggccactttactttgggtttatttgggtaacactttctaaatacatttcactaccccaggctagtgggctaacaaaatgaagaagcagactctgtgtggtattttaaagggagggagatgccaaaagcattgcaggaagaaacacatccttaaagattattaccacggtgtctaccagagtaaggagtaggtggcataacattctgagatataaattctctgaggcagaacatagaattttactacctaaatgtaataagatgtattgtgctatcagcaaaggccatggagctctatgtgatgaaaataaaaaaggatccaagtatcttcctttaactaccatttaatgataatgatttttgtctttagcatttatattagaaatcaagaaagaggcaagctgcaggctatctaataataatacaaataataataactaacaattgcccctctcttccatccttagttcttagcagcctatgtttattctcaaagaaagtcctcttccttcatcttagtttatatggtaatagaaatgttagtttaaaaattgtgttctacaccacatgctgatgaaggtagttttagcattagatttacattaggaaagaagactcagaaacagggtactatgtaaccgtctctttcacatgttatctcatttatttctcatgggaatcctttaaggtccatattgttacccatttacttgtacaaatgtggaaaatgaagccctatagcttccaataaatgtggtctcatgaccagtactgacctggagctggcttataccagatgtcaaaagccaattattaaatactcagaatttctgttggtagtatgaaatcacccatgatgggagtatttataccttggaaatctgcaaaggaggaaaaacagtgctctagtcctctggtcttaccaccccttttagggagtaccagcccaccagcaccagtttactgacacagattcaacccaggttggtactatacaaaaagcacattttcattcctttctttcaagatgacaaacttttggattcctaaagaattaagaactgttacccagaaaaaatgggttttattcttttggtgagtaacaaaggtctttctggagacatggatgatgctggaaacatcattctcagctaactaacacaggaacagaaaaccaagcaccgcatgttctcacccataagtgggagttgaacaatgagaacacatggaatcagggaggggaacatcacacactggggcctgtggggggtgaggggctaagggagggagagcattaggagaaatacctaatgtaggtgacgggttgatgggtgcagcaaaccaccatggcacatgtatacttatgcaacaaacctgcacgttctgcacatgtatcccagaacttaaagtataataaaaaaaaaagtcagaggaatatatagcaggctcaaatatttatctttttaattgtgaaatcatctttgcaatatttattatgaaataagttttaaaatattgcataattctaaaatatgatttaaaataaattatttctctgtagtaaaaaaaaatagagcaggttttgatcaatagaagtttgattacttggcataagtaaggaggacactgggagttttcacaaaagcagtgtctcccagaggaaaagtgacagggaagttttatggggtgatagggaagaaggtgcatcatctcatgtagaggaagagttccagttgcggagatgcagtgagtaatcacgccagtgcgtagatcgcatcttatggtaatgaagctatagctcctccccagggtggagactttagcatggtaatgaggaaatttcacacagactcgtctatgagttgctggggtctgtcagaagcttgccctaaccaacaaggtgacagcattacacaccaggcttgggaaaaaaacaagtgatagggcaggaggctgtaaaacaggctgatggttcaactttattaaatgttataatccctggagacccccctgcctgcttacagaactatcacattcagggcatcataagatacaacaatgtaacagcactcagaggcgcttcatcttaatcctctgttttaatttcttctatgtttttcaagtgtatttgccttcttcatttcatggaaatttcttgaaagttgaagtactctatgtattttgcatttttctactatgcctcctgggatacttactagaataataaaattgagctggaatgtgacagatgaaattgctagcaaatatgtcaaaccaagtagtattggctttgattattcataaattttgttatttacctataaaatggtatcatgagtataatcacattttatacacttctattaaatttacagattatagctatatttcaatttataatcattttagtctctagccttacaaaatagtatggaagttttagtatagatactacattctacaggtataaaagtagtgttcaaataatcttaaaaattgcaaaataactgagaccaaaaaaattagactctagaatatagcaaaatattaaaataacatatgaacaatctcccccattcctcacaaaaagaaaataaatttaaaaagagaagttaaaagacattaatcccaagtattatatattttgttttaaaaaggcctgattttatataattactaacacatagaaaggtccacatagaaatgtttatttgctaaagctgatatttgaaataatcacacacatgcacataaaagctaagatatgtttatgtccgttttcaatttcagagcagcctatggtcatgaagtggggaagcgtccttggattacaggagatgagagtattgtaggccttatgaaggacattgtaggtaagtacaaaacactgaagtttttccaaatgaattgtaaagatgttatcatttagttataaacacaggctcataaagtcaaaatcttattgaagaacatagtgattttctattttaatctataatagtaaaaaggaagtacactttcaacttaaatttgttaactcaaagattgctatggtgagcataacaaggttatttatataaaaataaaatatatgttatttttttctgtcatactttaaatgtaatatttatcacacatgaaaaacacatacattgtattaatttataattgaatacatttcataaaaatcaactgaaatgaattttctataatttaactatttgatataatgaacattttcacatgctaaaggtgtaaaacaccaatcatgtttttgctcatttcaatttaatctttggtgatctatttaaattttagcttcatgttactgaaaatgacatagctgatgctgtttttagtctaaaatgtgctatcctaaagagagttatatatactatcggtggtatttaagatagttttagatggtaaatgtgttaacattttgaaaaaatttatttaattggcttaaatattcagcattgtttaaaatttaaggtactgaacaaaaaaattaatgatattttggtaattggagtggtgctatttggaactattttaaggacttagggaaaactcaagttttcaaatcctttttgaaagcttattctcttataagcaaacataaaaatatctttattgcttcattccatttgaatcttgaccagtaattagagagaaaatcaacgtggctggaagggaaatggagtggggaaagctggacttatgcatagaaaaaactatggcaactggcaaatcattaaaatctggagactatcttgtttatttaaaaagtaattattgattttttgctatatgtcatgacttgtgggagctctgaggacataaaagtgaataagggctgggcatagtgacacacacctataatcccagcactttgacagtctgaggtgggtggattgcttgagctcaggagttcgagaccagcctggccaacatggtgagatcccatctctacaaaaaaattttaaaaattagccaagcatgctggcacacccgtagtcccagatacttgagaggctgaggtgggaggttagcttgagcctgggaggttgaggctgcagtgagcccaaatcgtgccactgttgttcagcctggacgacagggtgacaccctgtctcaaaaaaaaaaaaaaaaaaaaaaaaaacgaacaacactcaccttccttatcctcatagactgccagtaaaggaagatgcaaataaatccaaaattaatgtacatacataagtaaaatacaaagaaatataaaattaatcacactaccaaagaggcataattttccagttgatttaggactgaacacatgcatgtaactactcttttttctaaaacctcaccaaagaattctgaatggaatagaaaaaaaaattacaaagtctaaactgcagaggacaaaatagaatgccaaaggagatgataataatatctggggagttggctcgctgatagacaagtggtaattgcctttctcaaaaaaaaaaaaaagtaaaccaaatcctaatctcccaatggcaaaaaaataaaaagccagctgctttaccctgctaatcacctgaccatgaaaagagccaaattctgtaaaatatttgaagagtaaatttttctgtaaaatattctgagccaaatatgagtggtcatgacccaaggcacagtctcaagaggtcctaagaacatgtgcccaaggtggttgggttgacaaaagacatcaatctacacatgtgaagtatccataggtttgggggagaggaggggacaggcgcacaggtgggaagtgtagtagtttataggtcataggattatagatggagtcaaagattttctgattggcaatttattgaaagagttaagttattatctaaaaacctggaatcaatagaaaggagtgtctggaggaagataaggggtgatgaaaaccaaggttcttattatgtagataaagtctcataggtggctgcccttacagacaatagatggcaattgtttcccattcatacctgtaaagggttctagtctctcagttcatctcttcaggattggaagggactgaaaagggaaagatttggttatattcttcatattcttgacagatgtaaattttccctcacaacagaaggctttgtagggccactcaaagtatgtcaaagagacatattttggggtaaaatattttgattttcttctttatctgtcatttgatgttacgccagagtaaggttggaaagtaagcttgtcatataggataaaataaaacccatctggtgagattttatggtttgtaggatgttattccccaggcctcttaggaatttgggcaagacagaaaaaaggtcagagtttagtcctcacacctccagaaggtagtgatgaaaatatgaatttttaaaaaagaagatttgttgaaattctgtttaaaatacaattagaatatcagatccccttgccaacttgatgctgcaggtgaatactcccacaccccatttcaggagatgactagaggattaatttccagaaaagggaggagaaagggtctccagactgccatgacaaacaccacagactgggtggcttaaacaatataagtttattttttcgcagtactggaggctagaaattcatgatcaaggtgcaaagtgctgtcagggttggtttctagtaagggttctcctcctggcttctcctcttggctgccttttcactatgtcctcacatggcctttcttttgtgtactggaggaaacagttctctggtgtctctcacacgtcttataaggacacctaaggataccagctctaccatatcaagccctcacccttatgactgcacttaaccttaattactaatttgtaggcctatccccaaatacactcacattggagattagggctttaacatatgaatttggggccaccaactcaattaataatatataccatagttgtaaggtttctgtatcggtttgaaccccgagagcacgtcaatagacaacacgaggtggtgtggagcaacatgctgttttaatgagcgcctgggtgcaggcgggctgaggcctaaaatggcatcagcaccaagtgaggacaagacaaaggttttatagtctcctgtaaacaggaagtgttctagtctgacataactgctgcgttgtacctggatggcctctttctcgatcttcagggttacgtgtcttccggccagggtagctgtctttcggtcggctctcttcctgcttctgatatcttgctggcgcacgccgctgacgtaagtagccttgcgccttcgtactgggcctgagaaggaaggagttattcatctccttaagctttcaggcctcagggagaatcgtacattcccgtctatttggttgtagataaaagggataaggggcctctttctcaataactacttcacgtgtgatatagggggtggtgtgggcaccttggaaaaacaaaaccttaattttttgggtattcttgagagacgggttggtatccacattgtccttgtagtaggagcatcatctgtattgtctggaaacgcgtctgtgcctgcaagacagttatgttgagaggacaaggaggtgtcaacagggagaggtatagcctcatttgctgcttcacgaatgaaagactgtgtctggattaaggaggggaggtaatttctgagtgggttagagtttggtaagggtggaggccctaagataaaagttcggccatacatgattttaaagggactataaaaagaggctgcttttggtgttgtgtggagtctcatgagggcaaaagggagattttttgtccacgactggtgggtttttagagccagcttcgtgagttgcgctttaagtacagatttagttttttcaactttgcctgaagattgaggcctgtagggtgtgtggggaacctacttcatatttagagatgtagagacaccttgaataatttggctgatgaaggccggcctgttattgggctggatggatgttcagagtacgaaatggggaattatatgcatgatgagagtttgtgtgacgacatttgcaccttctgaagttgttgggaacatttttacttacctggagaaagtatggacaaagactagaagatagcagagcggcatgtgagtgaggtttacttgccattcttgccttggtacctggccccaggcttggtcggtaggaaaaggtagcggccagagggagccttggggtgacactgagtggcagatagagccagactgggtaatttctcagacatggctggaaaggtgaggacaagtgagaatagggtggaaaagttgcaagagaggtttgtaaccgacatggaaagagttgtggagtctttggaggtgaggaagattttgagagtgaggaagaacaaagcacctttccttgacataccatggtccttgcttttgaaggttttgggctcagaagtcctgcttttcttctgaggagtaaagaggagagaacaaggacagggagagaaactggccttgcacggatcatagggctatttgtttcactacctgatctgttagcgcatttccagccgatatgtgattgtctggggtttggtggcccctgcaatgaatgatggcaactttctgcaggagcctgatagcttgaaggagtttgttgatgagagagccatttatgacaggagtgttttttgcagctaggaaaccccgttttttccaggtagacgagtgtgactgtactatatggaacgtataatgaatgacaaattgaatatatgttaatttgttgtccggctgtcagtgtgagagcttgagtgagggcaatgagttcagcttttgggaggtagtgcctaggggcagtggattggcttcaatagtatgtgggggcggggggcgggggacactatagcatagccagcatgccggcgtccttgctgtaagaaggagctgccgtctacaaaccaagtaaagaaggggttcatctgttagatttggaaaaggtataagaaaggtttgaacagtgttcacacagaagtgtttagggtctttggcggttgtagcttcaggtaagagcatggctgggtttagatgggagctggttagcatagtgatttggggggtttctatgaatagagcatacagttggaggagtcatggggcagagatgagactagtacactgcagtgagttggcatgtctttgatgttatgggttgaataaactgttaggttggcatggagagatagttttaggcttttaagggttaggacagcagctgccgccaatggtcggaggcaggcaggccatccaagaactgaggctttaagctgtttagagaggtaggcaataacctgaagggtgggtcctttagactgggttagaacacctagtgtaactctatgctgttggtcagtatagagggagaaaggtttggtgaggtctgggagagtgaggacagggctgaggtgagagccttccagagtagacggaaaggttgggtaataggctgtgcagatttttaaggctcatggagtggggctttagcagcttggtataatggtttggcaagtagagcgaaggagggaacctagagcctaaaacatcccactaatcctagaaaagagagagaattttttgcttagtttgcagaggcaggagggattggaggagagatatgcagtcagctgtgagcccttgggttcacggggtaagagctagccctagataggtgactaagggggtgcataattgtgctttcttagaggagacctaataccctcgttttgtcaagaagtttaaaagagagagatagtgtgggtgttgcagtgtttttgagaggggctacacaggagcagattattaacacattgaaggagagtggatggttttagggatagggtactgaggtcaagagcaagggcctgtccaaaaagatgggggctgtctctgaaaccttgaggtagtatgcaccaggtgagctgatgtgaaagtttggagttggggttttcccatgtaaaggcaaagaggttttgggaatcaaggtgtaaaggaattgtggggaaaaaaaagcatcttttaggtttagaacagaaaaatgggtggtattagacagaattacggaaagtaaagtatatgggttaggaactactagacatactgggagtacagcttggttaatgagcctgaggtcctggattaagcgataagtttcatctggctttttgacaggtagaactggtttgttaaaaggggagtttgttgggtggagtaggcgactggtgaggaggcgaaaatgataggctttaggcctatgcgagttgcttgggagatgggatactgcttctgtgataggaactgggtgggctttttaagggcaatgtggatgggggtgtggtgttttgtgactgagggtgtggaagtgtcctaaacagaggggttaactacggatgggggataaggaaaagttgcatgttttaaggtggcaggttggaggagtagaagaaagttagaagccccagaggggtctgggttggtgcgttgggtactatggggaacatggaagtgaagagtagtgtggagctttgaaaggagtggagtttggcatgagggtaggactaagaaagtgagtgaaggaaaaggtgtatagggagcagaaaagtggaggggtggcttggggtttggagacttgtctattaatttctacaatagagacttgggagaactcagtgggtcctgaaaaattaggtaaagcagtgtaggttgccctggtattaattaaaaaacatactggcctacctgccaccatcagggttacccttggctcggatgaagagatggtagttgccagggtgtccatttcagggcaccgtcactcttcagtggcaaggccgatgagatcctaataggaggttttggccagcttcggaagggatgggggcggtccttgtggggtccgctgacagtccaacctccggtggggtcctccgcaaagggggcatggcctggtgggcttacctgggtttgggcattgtctggaccagtagccttcattgccacacttgaaacaggcgccaggtggaggtggattgctaggaggcttccctgttgagctgcagccctgcgggcctggtggaggtaagcatttgagactacctgtgttttgcctttcattttcctcatcacgattgttaaagactttgaaggctaaattaagaaggtctccatgtggggtttgagggccgtcatcaagcttctgaagtttgcgtggaatattgggggtggactgggaggtgaaccaaaggtttaagatagtggttccttttcagctggctgagtttaggttggtgtattttcttatgacttcagttaaacaagagagaaaaagggctggttttcgtcaggaccctgggtgatttctgaaagtttttcatagtttactactctatgggcaccctttttgagtcctgcaaggagacacacaatcatgtggtcttgatggtggcatccagaggccccatcttgataataccagtgggggtcctgattgggaactgcctctgcgccagtaggctgggcaggagtttggtgatgaattgtatcagcctgcgcctgagctagggtccagatatggtcttagtcttctggggtgagggtggaagagaataatgtagaggtcatgccaggttagtttataagactgggtaaggtactgaaactccctaatataagaggtggggtcttctggaaatgaaccgagtcttttgttaatttgagacagatcagtgagggagaagggaacatgaactctagtaataccttcagttcctgctacttcctgaagtaagggtgggtcataggctaaagatggcatctgaaggagtatgggccggagggaaggaaaaagccggaagtggttcctgctgagggtatgaagggggaagggagttgagttgataagcagtggaggatacatacgggcgtaaggtggcaggatgggtttataggcttcaggagagggcgatgaggaaggagaatgagtacaggcaatgctagaattgtcctgatgggacggtgtaggaaaagaagtggatacagctgactgggaaggtggtggctgagaagatgatgactgagaagacaacgaacgggttaaagaaggcgattgagagaaagaggtagtggctgggaggcatggacagcagtctgctggattgaatgaggaaaaagaggtagggttgggaggagaaaggtgatctggatagcaagaatggaagagaaggatttgaacaggtaaacaagaattgtagaggtcgggctgtgatctgagtgcaaaaaacgcctggacatacagaatttctccccatttctccagtcattggcaataattgcttaagttcgttaaaattataaagtcaaatgttttatttgagggccatttagatgcattgtttaatttgtactgcatccaggctatattgtaaaaaaagacggggcacttagggtggatatcttgtctgaggcctaaggtttgcagggttcttttatgaggcagcctagagggctgttttttggaatagaggaccaagaatttcccataacggagggtaggcatgggagaacagagaaaaaggagaccgtcctggacagctggagggagacgataaaaggagtgatcgtcactgctgcctttttcgttcccggaatgggatcagttggcttagaggtgtcccctaagaacagatgatcagcaactgcctggcacacaccagagccttcttggaccaacgctggatttttggaccggagaaaccaagagaggccatgtagatttttccctgttgacagagctcccaggaaacttactggtaggtgagatcagtgactaatgtgcatgcagaggggtgactggaggctgaggagtttcctttgtctggctgctgtggcctactctctggggtggaggggtaggcccaaggaggacacagacttgagcccctcccaggttttggcaccagaacgtaaaatttttgtattggtttgaaacccaagagcgcaacagacaagatgaggtggtgtggagcaacatgctgttttaatgagcgcctgggtgcaggtgggctgaggctgaaaatggcatcagcaccaagtgaggacgggataaaggttttatagtctcctgtaaacaggaagtgttctagtctgtcgtaactgctatgttgtacctggatggcctctttctcgatcttcaggagtatgtgtcttccaaccagggtagctatcttctggccagctctcttcctgcttctgctattttgctggtgtaccctgctgatatatgtggccttgcaccttggtactgggcctgagaagggaggagttactcatcttaaactttcaggccccaggaagaatcttacaatagtgaaaaaaaaagcattaaataaatgtttatccacttgcactcttatttagctaccagtccccacacaggaggctggacaagtctactctgttatctgcacaacctaaagagtctgacatgagggcatttcccagcacgatgggcaaatgggatcaccttacaacaaaccccatcacgtgcagaacacactgttaaaaaaaaaaatcatgagccaaactaaatttaacggagtttaattgagcaaagaacaaatcatgagtcaggcagcctctcaagccagagtaggttcacagactccagcacaggcatgtggttggaagatttgtggacagagaaagtaaagtgatgtacagaaaatggaagtgaggtacagaaacagcctgattgggtacagcccagcatttaccttaatttaacatggtttgaacagttggtctcctttgattggccaaaatgtggtgattagcacaagagtaggttacagtctgcttatgcctccatttaggtaacagttcatgattttcagagaaagctttaggctggacttaaaatatgtaaggaggcaagtttaggctaaagttaatttaacaatctccctttttggtcatcttctcaattttgagagattgaccaaaactttagtcattgatgtaactatcaccatcataaatgtccttatttggtttcaaaacccaccggaaaatagcataatagtggattttgtaagataggaacaaggacttcggtaatttttttttacgggttagagtagagggtacctcctcatgctggaatatcctgtttacaggagaaaaacaaaacctagtctgttctaggatatatctgtttccttgaagtcttattttttattatgtcacatttatcataagtgactgctttttggtttggtctggtctgtggggtcctagtgcatgagctcactccaaaacagtatcctcccataattttgtttaaatctgttaaaagaaaatccttaaccaaattaaatttatccgagtataattgagcaaagaacgattgacaaattgggctgcctcccaagccataatagactcagagatactccaccgcagccacgtggtggaagaagatttatggacagaaaaaggaaagtgacatacagagaagggaagtgaggtacagaaacagccaggttgtttacagctcagcatttgccttatttgagcagggtttgaacagtttctcttctttggccaaaatgcggtgattagcactggagcaggttacagtttgtttacatctccatttaggttatagttcactatgcacagagaaacctttaagccaaacttgaaatatgtaagtagatagctttaggctaaacttgattcaacaacactcatgtttattatacccaaattacaaaacttttcatgaaaatctatttttatacatccatgttgtgtggaaaattttttaaaaaaagaaaaaagaaatctgtttttagtttatgaccatatgaatatgttaacctattaaattttttttaataactttatagggggccaggcatagtggctcacacctgtagttccaacactgagaggccaaagcgagaggatcacttaagcccaggagttcaagaccagttgaggcaaaatagtgagaccccgtctctacaaaataaataaataaataaataagtaaaataaataagagaagaaagaaaaattagtggggtgtgggtggctcatacctgtagtttgagctactttttaggctgaggcaggagctcaggaggtggaggctgcaatgagccatgattgcaccattgtactccagcctgggtgacagactaagaccctgtctcaaacaaaacaaaacaaaacaaacccctcaaacctcaatagaagagttgtaaacaaaagcaaactcaagttcctaccaattattattaatcattacattatacaaatttctattggttttgtgcgactatgttgtagatcagaatatcaacttctagtttaagataacagattgagtctgagagtggtggctcatgcctgtaatcccagcactttgggaggctgaagcgggcagatcacaaggtcaggagttcgagaccagccttaccaacatggtgaaacgctgtctctactaaaaatacaaaaattagccgggcattgtggcacgtgtctgaaatcccagctactcaggaggctgaggcaggagaatcgcttgaacctgggaggtggaggttgcagtgagctgagattgtgccactgcactccagcctggtgacagagcgagactccatctcacaaaaaaaaaaaaaaaaaaaagaaaaaagaaaaagaaaagataacagattgagtacagaccgaaaattctccgttctatgacaaataccgaggagtgactgaaaaaaaaattaacaaacatatagcaacagttaaaaataagtaaatagaaatctgcatagaccagaaatttacaactattattgaagaaaagaacagtaagaaaccagaaagtagtattttgggggcagctcacgtggagtcaggctcagtgtaggacttgagtgaaagactttcccaagaagccccagggctaatctgggcagccctggatgcttaggtctggaacccagggccagaatctttgacagccagatccagtaaaggccaaaaccaagaatctcctcccacaccagtggattctcaaaacacagtgcacttgatcaggctgtcagaattacctagagcagtgcatattctgatggagagaattctctgaacaatcctgaattgcatttaaaagtgtgcgaaatatttgtgtaataaatccttcgtttgtgttcatttgttagaagccaattctaaacattcaaatattctaatatgtaaacaaaaaaactggaaaaagaatttgcatttaatttgaccggagaatatgtgcttctcttagctgtgaattttttttcactttattcagtttgctttcagaacataaactgcattctaatcctgttattttgttcttaatatttatcatcctctaaagagaagttagaatgtttatatagaagccagggaagtggtaaagtgatattattcagtgagatttatttatgaagccaataaatcctgcaaaaagatgtcctttgaccatttaaaagtttacagctctattgcaacttattaaatgtccaagagccttgttgacacataaatacatgtatgacacataaagatcactgaaatttcaaacctgtcacctttcattattgttactaaggaaaaacaaaaaataagagaaagactataaatattcagtcttgtttagaaaactaaagggattaagcttattttaaatttttaaaagaaaatttgtcaaccatagctgtaggggttttctgcctgtctttgaaaaaccacacagtaatataatttatattctggcccacaagactgccgccacttcagatgccagtcaaaaatcctagaaaccacccttactttagacgcaccagctgtaaattcagggatttccacagtgccctttgcaggctccataatttgctagagcaatttcagaactttactttcactttactttatgtttgccagtttactataaagatacaactcagaaacagccaatggaagagatgcatagggcatggaaatgagggagcttccatgccttctctgagcctgccactctcttggtacttaaatgtgttcatcagcccagaacctctctgagtcttactgtttttataaagctcaatcccagccctcctctccctctgggaggtcagtgggtagagctaaaagtttcacctctactccctctgatcacttggtctttttgatgggcagccccccatagtgagatgtctctcagggccccaacttaagtcactttattagcatcaactctcctgtgatctaagggagcttgttatgaataacaaaaaatacttttaccacttggaatatccaagggttttagcagccctgtaccctgaactgagaacaaaaaccaaatatttcttgttataacacacctatgggacaaaattcatttagttttctacatttttgtctttgaatgctgcattagttaaattagatgtgtttggtcccaaaatataatgtgggatatagaagataacaattatttcttaaaatgggcaaagtgagttttgtagacctgaaacttcgtaaagaaaatatttataactttcccaaagcctcaaaccttatatgacaaatgcattgtcacattttatttgaagtcttttcagtggtctgggttgtaaatcagagttaggaagggtgtgatagctcctatggttagggagtttagagccacaggaatttaagagatttgccatgctgaatgggccctgaacccacgacctgacccgtaggtaatttagtttcctaaaccattggatccatctttatcgataaaggagcatctgtttcggtctttcagatcatactattagctccaaaattttttaacttccaaaattaaatacatattagtcagagaaatggtccttacttaagtcaaattgaaaaaatgaataaacgaggcacagtggctcacgcctgtaatcccaacactttgggaaggtaaggaaggagaatttcttgagcccaggagttcaagaccagtctgggcaacatggtgaaactccgcctctgcaagaaatacagatatacaaaaattacccaggcatggtggtacattcctgtagtcccagctattcgaaaggctgaggtgagagagttgctggaacctgggagtttgaggctacagtgagccatgatcatgctgctgcactacatcctgggtgacagaaaaaaaaaaaaaagaaaaaaaaaaaagaaaaatgtgtaacttcactcaaatagactcttttagaatgtgtttttttgtgtgtgttcattttgtttgcaaaccccatgcagcttcccgttttgccttggttactaagaagttctgagaaaaatttgatcaagtttgaagtaacaaaaatatttaataaattctaatttgtttctcatctgcatttattgtgttgctactttctatcattcttcctcaaatagttttgtattacaatttatctgaaaccctctttggaagtaagtgtggtttaaatgatgaaataattaaaataattttgtagtaactgcagtaaagagtagcaaaggccaaatttattttttctacttgctagggttactagcagcaaatccatatgggtctgcagcaacctcggtttttgcctctttagaagaaataattcaactgaggggcgtaaggcaggagagatcaaggcaaattttagagcaggagtgaaagtttattaaaaagttttagagcaggaatgaaaagaagtaaagtatacttgaaagggccaagtgggcaacttgagagatcaagtgcatggtttgacctttgactttgggttttgtattttggcatgcttctggaggcttgtgtcccttctcccctgattcttcccttgggatgggctgtcctcatgcacattggcctggtagcacttgggaggggctgcatgtgcagtgtgtttactggagatatgtgcatactcacttgaggcattcttcccttaccagctgaatgtccctagaaggtcacataagagacattaaaaattggccattttgcctcttaatgtacatgcttgagcccactcacccaaatcctgagatattgggaaactgctgatcacgagtttcaggtttttttctatcttttgggagactgtctttccctggcactggctgcaaccaattattattttagagagacagttaacaactgcctgaccatcacctgacattcctggtgatgggaaggagatgcctgccctgctcatgtctgcctgactacctactgtaacaccaggttgtctaaatgtgccatgagcaaacagacaagttgtatattttgggtcgtgattgagtcttccaggttcttaaaaccacagcctttaatttaccataaaaaattttaaaaagaagttaccaggaggataataaaaattattatgtgtacaaattgatagtgtggatagagaagagaaagaaataataaccatatttattcatagaagtagaaaaaattcaatttcagatgagaagaaaaactgttaatgaaacattttatagagagccaataattcttcaaaacatggaataactttcccttataattaatgtcatattatcaagatggtagaaataaaattgctgaagaatattattaatattattattaagcttacttctccctggatagataaaaatcacacagcgttagctacatgcattcaaggttataaaaatggtgtaatgtgaacataaatttgctttatgaaatccgtggctgaccctcagagaagcaataatccctggaagctatccccccacagctgcagaccctcagtcatgtaccagccacctctaaaggctgctgaaatttgttacttgaaaaatggaatgtaaagttcttggacttagcctaattacaaaccttacagccaaatccacaataacatttgcatctgcttaataaaatatacagaacattgtatggcagttatgagacccgtaatgaaccctcttatccaatggtaaacagcttggggccttgtcatccccactttgcaagagatttgaaattatgttaggattaaaaagacacagagggaagttggttaagatcctcagtctcaagtcaaatacacagagtattttctgtaaacaatgctttaaccctgaaagaacattcttattttatttttcttctacaagacttttggtcagttagttcatctctttgcacatcagtttcctcgttatgaaatgaagagaattagagtaggtaccttattgagttgctatgcatgctgaaataatacaagtcacataattagaagtgctgaaatacttaatggatccataaacattagcttgccagtctttgagaccagaatgcagttgcttgcatttaactaagttttatcttctggtaaagcaaaaatatgatgttcaataaataaataaacaaggaataaataagcagagaagcactctttggattagagcactggctcacactcatctcagaagtgatttaaatcttgacatttattgcagtgagtcatagatgatctgataaagtaaagatcctttcaaaacctgctaagctctccagaagcattttaaaaattttgccccaacataactggagctcttgatgtttccacattaattcaaaataattaggaaaaagtaaaggaatgaagaaaaacaacttgaataaactttggttaacttttaaaaaaaaaagattgttagtgaaatgatgatattgaaacatcttaggacaatattggtttcagaaatctaatttgaaccaaaaaagataggccaattaggtaaataatcttttgaaaatacagacatacctcaaagatattgtggcttggttccaggttgctgcagtaatgcaaatattgtaatcaagtgaatcacacacatttttggttaaacagtacatacaaaagttatgtttacactatactgtagtctattaagtatgcaatagcattgcatctaaaaagcaatgtggataccttaattaaaaaaatactttattgctaaataatgctaacaatcatctgaaccttcagtgagctgtaatctttttgctgatgtgggttgtcttgcctctatattaatggctgctgaccaattgggatggtgttacctgaatgctggagtggctgtggcaatttcttaaaataagatagcaatcacgtttgccatgttaattgagtcttcctttcatggaagaaatctctgtagcttgtgatgctatttgatagtattttactcacagtagaactttcaaaatttgaagcaatcctctgaaatcctgccactgctttatcaattaagttaatgaaacattttaatcctttgttgtcatttcaacaatgttcacagcatcttcaccatcttcaaaatcttaaccatttttctttgcactttcgtaagaggcaacccctcatctgttgaagttttattatgagattgcaacaattcagtcacatcttcaggctccacttctaattctagttctcttgctattccactacatctgcaattatttcctccacctgaagccttgagcctatcagtcatccatgagggttggaataaacttccccagttcctgttcatgttgatattttgacctcctcccaataatcatgaatgttcttagtggcatctagaatggtagatcctttccagaaggttttcaactgactttgcacagatccatcagagggatcactatctgtggcaacaatatcctcacaaaatgctttttttaattgtatttaattttttttttttttggaaaagcagtctctatcgctcaggctggagtgccgtggcacaatctcggctcactgcaacctctgcctcccaggttcaagtgattctcctgactcaaactcccaagtagctgggattacaggcatgcaccaccatccctggctaatttttataattttagtagaggtggggtttcaccatgttgaccaggctggtcccgaactcctgaccttgggtgatccacccactttggcctcccaaagtgctaggattacaggcataagccaccccacacctggccttttttccaaatttttaactttaatttttgtattttgttttttatttttattttttatttttgagacagagtcttgctctgtcacacaggctggaatacagtggtgcaatcagctcactacagccttgatttcctgggctctggcaattctctggcctcagcttcccccgagtacctgggaccacaggtacaagcgaccatgcctggctactttttgtatcattggtaaaaatggggtttcaccattttgctcaggctggtctcaaactcctgagctcatccaatccacctgcctaggcctcccaaagtgctgggattaccctgcccggctgccaaattttattcttaaagaatactacttgaaagtcaaaattactccatgatccatggactgcagaatggatattgtgttagcaaacttgaaaagtttaatatccttgtacatctccatcagagctcttgggcgactatgtgcattgtcaataagcactaaatgttttgaaaatatttctttttctgagcattaggtctcaacagtgagcttaacatagtcagcaaaccatgctgtaaataggtgggctgttgtccaggctttgtcgtttcacttataaagcacaggaagagtagattaagcataattcttaagagccctattattttttgaatggtaaataaatattggcctaaacttaaagtcattagctacgttaatcctgaataagattctgcctgtcccttgaaggtttgtagctgagacctcctttctagccataaagtcctagatagcatcttcttccaatagaggactcattcatctacactgaaaatccgttgtttagtgaagcctgcatcaatgatcttagcttgattttctgggtaacttgctgcagattctccatcagcacttaactgtttcaccttgtactttttgtatttcaaatagccaacttgagacaagtttattagtaatttcatggtacccttttgtgggctgattctcacctcacccttccccaagcaactcctgtgactaatgtcaaacaatatgtccttttgttgcttttttcagccacccttacagacccccaacacaatcaacctggaaatgacctcagtatgtgtaatcttaagtcatcttgctaacgcagacacctctgaggttcccaagaaaacttcagtggagttctctaaactgaaaccttgagagaggaagattttcaagtaggaaccagacaaattcacttaaaactcaccactacacacctgtgtcatagaagcattccattttttctattgcagatgggatttcctcttcaagcttactgtactgtgtctttttaaaaaatagttgaagacatcggaataaaagctaatgtcccaaacagcgcttccctggatattgctgtttctttaaaagcctttttcccagctcttctgagatggtccatgacattgcctttcttgctcattaccttgatcccttgaatgggcccaaaactttggaatgcaaaaacattcattccattgacttggttgagaaagatgataggtcaggttttttttcatctaaagattatcctgggcatacttcatttgggcccaaatgagggattattccaaagaagattgaagaagcaattactccttcccctagtaatatactctttggcaatgattacagtttgcatttctgctgataatgctgtgtgctataattatatgtaagtttataagaaacctggggtaaaaccatggactttctcccttttgctggcatcatctacagaaataccatgggcatcatgaaaggcagtatagctataggctgaaaaaagcagggttcagtttgctgctgtcatgatgccctgttgagagactgctcttcaaagtttcttgtatcattgggtcctccaagtcaggcctgggtgcctctttatttacaaagagtagttgcctctattttctcaattgaaatgaccagatttttaagatctaataattgtgtccaccgaagaaatcatcaataaaaggatctgcatttcatgatacacaagtgcacctggaccctatgcagggagtggcactgctgcaccctggtcactgcctggctcctatgctatgtactcctcttcctgggacctatgtccaccttgaacttctaagtttctttccttaaaccttatgagccaacctgtgctagtttcacacttttcttttacatcttcctcacctctgtcaggcttcaaagaattgaagagaattggggccttgctctggtttaggctttggcttaatggaatgttggggctggtttgatcatctgaccagatcactcaaactttctccatatcagcaataaagcttgtattagtctgtttttagccactgatgaagacatacccaagactgggcaatttacaaaggaaagaagtttaatggagaactcatagttgcacatagctggggaagcctcatgacagtggcagaaggtaaggaggagagagtcacatcttatgtggatggcgacaggcaaagagatagcttgtgtagggaaactccccttttttaaaccatcagatctcatgagacttatttactatcaggaggacagcacaggaaagacctgccctcttgattcaattacttcccaccaggtccctcccacaacatgtgggaattcaagatgagattcgggtggggacacaaccaaaccatatcattccacctttggcccctcccaaatctcatgtcctcacatttcaaaaccagtcatgcctttccaacagtcccccaaagtcttaactcattccagcattaactcaaaagtccacagtccaaagtctcatctgagacaaggaaggtcccttctgcctatgatcctgtaagataaatggcaagttaattattccttaaatacaatggaggtacaggcactgggtaaatacagctgttcaaaatgggagaaattggccaaaacaaaggggctacaggccccatgcaagtccaaaatccagtggggcagtcaaatcttaaagctctgaaatgatctttgattccatgtctcgcatctgggtcatgctatgcaagaggtgggttcccatgtggtcttgggcagctccacccctgtggctttgcagggtacagcctcactcccagctgccttcatgggctggtgttgagtatctgtggcttttctgggcgcatggtgcaagctgtcagtggatctaccactctggggactggaggacagtggccctcttctcacagctccactaggtggtgtcccagtaggtacactgtgtgggggctgccaccccacatttcccttctgcactgccctagcagaggttctccatgaggatcccacctctacagcaaacttctgcctggacatccaggcatttccatacatcttctgaaatctaggcagaggtgcccaaaccttgacttctgtgcactcacaagctcaacaccatgtggaagctgccaaggcttgaggcttgcaccctttgaagccacagactgagctgtaccttggcccctttcatccatggctggagtggctgggactcagggcaccaagtccctagtctgcacactgcaggtgggctctgggtcccacccatgaaaccactttttcctcctagccctctgggcttgtgatgggaggagctgccatgaagacctctgacatgccctggagacattttccccattgtcttggggattaacattctgctcctcgttacttatgcaaatttctgcagctaccttgaatttcttctcagaaatttggattttcttttcatcgtgttgtcaggctgcaaattttccacactcttatgctctgtttctcttttcaaatggaatgcctttaacagtacccaagtcacatcttgaatgctttgctgcttagaagtttcttctgccagataccctaaataatccctctcaagttcaaagttccataaatttctagggcaggggcagaatgtcgccagtctctttgctaaaacataacaagagtcacctttgctccagttcccaacaagttcctcatctccatctgagactacctcagcctggatttcattgtccatatcattatcagcattttggtcaaagccatttgacaagtttctaggaagttccaaactttcccacattttcctgtcttgttgtgaaccctccaaaccattccaacctctgcatgttacccagttccaaagttgcttccacatttttggatatcttttcagcaatgtcccattctgctggtactaatttactgtattagtctgttttcatgctgctgataaagacatacctgagactgggcaaattacaaatgaaagaggtttaccagagaactcacagttccacctggctggggaagcctcacaatcatggcagaaggcaaggaggagcaaatcacatcttacatggatggcaggaggcaaggagagagcttgtgtagggaaactcccatttttaaaaccatcagatctcatgagacttattcactatcaggaggacagcacaggaaaaacctgcccccatgattacgtcccgccaggtccctcccacaatacatgggaattcaagatgagatttgagtggggacacagccaaaccatatgaaggctgttggtctttcttattgttgtgttcactgaagtagcaattttaacttctttcaagaacattttctttatatttacaacttggctgtttggcacaagagacctagctttcagcctacctcagcttttgacatgtctgcctcactaagcttaatcatgtccagcttttgatttaaagtgacaggcatatgacacttcctttcacttgaacacctaaaggccattgtagggttattgattggcttattttcaatgttgagtctcagggaacagggaggctggagaagtgggagagaaatgggggaagggctgatcagtggagcagtcagaacacacaacatttattgattaagttctctgtcttatatgaatgtggtttgtagcatgccaaaataattacagtattaacatcaaagatcattgatcacggaaataataataaagtttgaaatattgcaagaattatcaaaatgtgatacagagacatgaggtgagcacattcttttggaaaaatggcactgataagatcagttgatggagggttgccacagacctacagtttgtttaacaaacaaacaaacaaacaaaaggccaggtgtggtggcctatgcctgtaatcccttcagcactttgggaggccaaggcaggaagatagcctaagctcaggagtttgagaccagcctggacatggtaaaaccctgtctctaccaaaaatacaaaaaattagctggatgtcatgtaacagaggtagaaggattgtttgaccttgggaggcagagtttgcagtgagctgtgatcatgcctctgtactccaacctgagtgacaaaataagacaaaaaacaatgaagtgaagagcaatgaaacaaagtatgcctgtacactaaaaatcagtctgttgtagctatttgatgttaagaacactaaattctttagtgcctttaggtcatatttgtagtaaacacttctgttaatgttttgaaactttactatttgcaccacccccagttataagtgtacacattcttgcatgttggactaaccctgtccttggacaaaggtcagtagcagatgaagattgcattttgtgatgtgctcagttaagtttaatttaaagtggtccattgtacaataatgtttgtatatgtgtacagaaaaattgttcaaatcaggaagggattatttacaaagaattggcccaagtgtgaggaggccattgaaagtgaaatgagggaagctctataccaagtgtaagtgtagtttaattctgcccagcacatctggaggggaacatgtgtgtaggtgcatcacattcccaagccagaaaaattttaggtgattcaaaatgaacactgtattgtttggagaaccaaaatgtccaggaatctgtatcgtgttttgtttgtttgttttgttttttgagacagaatctccctctgtcaccctggctggagtgcactgctacctctcctgacccgccaccttccccaggctcaagcgattctccaactcagccttccaagtagctgggaacacaggcatgcaccaccacatccagctgttttttgtatttttagtagagacagggtctcaccatgttgcccaggctggtcttgaactcctgagctcaaaccatccacctatcttggcctctcaaagtgttgggattagagatataaaaccatcatgcccagcctatatccaaattttctttttatttgtttttgtttgtttgtttgttttcttatttctttctttgtttttgtttttgcttttttttagatgcaggttccactctgtcacccaggctagagtgtggagtgcactggtgcaatttatagttcactggaacctcaagcactcttcctgtctcagcctccagagtagctggaactataggagcatgccactacacctgactaatttttaaaaactgtttgcagagacagaatctcactatgttgcccaggcccatcttgaacacttgggttcaagcattcctcctgcctcagcctaccattatatccattttaatcagaatataatatttaagcaaaaatggaatgtctgagcttctacagaaagcctcctttttcctgcctcttccatttcttgattttatttgtgataattattttttcttttattttctcctcactttattctttaaaatgcttctctttccactaattctgtatttttcttcatattactttttctttcctccttccactcaccctgccattttttttaaataaatggttttccaaatagatgtgtgcaaataacagggagtcaagagtaagatcaagttactttagatagtgtttgttttagaaatagcagtaaaaattcactctataattgttctgtggtcgacaggtttatgcaaacctatcccccaaaccggaggaagctgaaaggcccaagtaagagactgataaatccagtttctcagaaagaaacatttaatagggagtgagaaacagaagtcatgatgtcctggcaattgacaacaacaagattagatagtgaatccccccgtaccattacccaccgcgtatgacttatatgtaaaacatagggaaggattatgtggaacaattgaagtcaacctctcagggaacggcaagaatgctatgtgaatctgcctaagggcaggatttatggtagcagcagttaaaatagaaatcttaaaggcattcccagaataagggttacccagaagtcaacatggcagattaacacccaatatagagttgctttagcctccacaataatgtagggaaataaatataatgaagatggcagtattttttaaaccatatttcaaagaaatcttctctttgaaacatggagaagaaggcatatgtcactatatgcaacataagcttatattcatatctatttagtatatccaggacaaattttatttagttctaggaatatacagtgagatttttcttactgccccttgacgttagatattattcaccttacagtgatcagagatacgtcttttagcatccaccacttgttcatcaaccttgtctgtcaaatggagaaatctatgtggcaaatgcaacaagaagttttccttgacccaataaagatacaggtccttccttaaatggctatgttgaaatataaattcttaaattatatacttatttacatggcttctcccctctagtgaacttatcctggaatctgtcaattagatttattctatgtactgtctattcttttaaaatgggactctctcagaaatatccctctggataaggtacacatctcatttttctcagtgacagtaaaggggcgtaatttctattacacaggtctaattgccttgaagaaacatcataaggactcaaaacatggaaggtattattattgttgtgattatgctttgaattcttaagtaaccaatgtattctctgtctctggatctgtttctagtgtcaaaacccttgttagcaggaattagatcagattatattaataattatgtagtggatatcttacttttgcatattttctcatcagacaatacacgtctatattatcttttatctcagtgtgtatgaataaatgtcagagctatttgggtcataatttgctatgcggctgttttgtcttgttatatatttcactgtaataacagtgagttatgattcacaaagtttgcctccttttataaaaggtgtattttaatttgatgttagaaacaacgaactttaaaaatgtaattggccttaatatctttttagattcctttgaagatatacttaccacaaaaatatgctccttgggaatttgacaattgagctgataataggatatatcatttttagtttacaggcaaaagcaaatgcttcattattttgttgttatttactacatcataaaagaaatttaattttagctagctgtgtgcatctaagtccagatatcatttgataaaatgagtcaagtgggaaaacttccatttctttgtgatgacacatcaaatatgcccttatctctaaagacattaagaatgattgagtgaagtcttcctactttgttttttcagtatctttagacatagtacaaacatctaaattacgatatgtttattttacaggagccaatgagaaagaaatagccctaatgaatgctttgactgtaaatttacatcttctaatggtaagttttctttcccactaatgtttagaacacattcatttacagaatctgatgtttttctatctttaattcatgagcttctgggggtttacttatttaaaaataaattgtgaggttattttcatttttactaggaaatgctggaccatgatataatagcttcttcctaatcatggaagagttgactcttgagaagagctttagaataatgaacagttcttgtctgggaaaataaagaataagagccataatgggtaaataggcaaactacatgcaagcctacaaaacagtgatgtacaatgctagcaaagcactgacctttttggaaagacaattttctaatggcttcagcagagtgagttagtggatcagtatacttttgtatattaatataggttaaaaaagacttggagtattaaatttttaaaaagaggtctagtaccttaaatgagttaatgtgtttaaagtacttcttacatcttactcaataaacagttttaccttaaagtgtcaaatctattatctattagggatattgtgttaatggtgactgcccaatgctttaaagaatcttgacttcattttttcaagtatgttttggaaacatgtctacaagttcagatatccctggatttgactcccagctaaattacataatgcttatttgaggttgaaaaaggcttttggcatctctaagtcttagtattttcctttgtaaaaatgagaaacataatatctacctcaaagatctgcatgagaattaaatgtaataatatgtgaaaattgctttagtaccctggccagtgatcaacactcagttaacagtagctatcatcttcgttgttattgttgtcaatatcactctctaggaactgtgtggagaaatgaaagagcttcactgaacaaatgagctactatcaatacaaataagacatacatagaccataatatttcagtgtcatgccatcaaaattaccatgaaatgctttgggaagataatttgtcaattaacagctttttttgttgttaatcatcagactttaagtttcatcaattaatatataagtaaagtttgaggattcgttatcacattcacattttcccccgagtttgctgtttcattgataagcaaattgagccaatatcttctttctctttgagattcactggaaacatggctaattgaaaaggtagtcctgacaaacacttaagatgttgagttaattaatgtctttaaaatactggagattataaaatgaaagtgtgacataaaatgaacaaatgtataaattgtgtattaatgctttctcaataaatccattttattgcagttatcattttttaagcctacgccaaaacgatataaaattcttctagaagccaaagccttcccttctgatcatgtaaggacttcttcaaattgtatttatgttctttctactcttcctagagcagtgtatcatttgcctgacttgaatgtttactcactaggcttttccaagcaatcttacaataaaaagatctgtcaaatgcttttgattaaattttttaatagattatagctttatttcttttgttaaagtaaaacacgtgttaagggaagagaagatggaataggaacattgatttattagtctttttaaagacattgagcaaaccactgctctaaatcaagtgcagttataaatgttttattaattcttattgctcttttattttatgaaatcaaatcaatacaaaccccagtgcttaaccctttagctaaatagaataggaatataaacttttatttgtccagtgtgttttcatagcatgctagcataaatgttggcccattattatcaaaatattatttattagagattaaaaatatttcttgtgatttactaaaaaaagtcacattactttacttgatgatgagttgtttattcttacttgataagaaatgtaatggtttcagacacaaacacaaataaaagtacaatgtaagtctgggcacagtggctcactcctgctatctcaacacttcaggaaaccaaggcaggaggaacacttgagcccaggagtctgagaacagcctgggcaatatagtgagacctcgtctctataaagtaaataataaataaataaattaattaattttaaaagtacattttatattttagttttggtgttagagaaactttatttctctatattattgctgtcttttactctagcccttgtaattttagggcaagtaattatgtcaaatggaataaaaccctaatatcttactaaaatggatcaaaatcctaatatctacaaaagattccaggtcggtgtgggggcttatccacatgcatatctggtactcttaatgaagtaaacttcttaatgccttttttttagctaacttactcttcctagggtaagccatttctatatcctatgttcaaggatgacaagtccctactattcattttgcttattttgcaaattctggttttgacttagattagatgatttaatttcttattctaaaatctcttataattccttaagtcaaggagatccctctgttttcatctatctcaaagaatgttcagaattctatatgtgaattttattaagtggttcttctctgttgtgtattttgtttaggtgttttaaccttcaccttggatttaatataataatatgcccttatttttactttattatttgttatttcaatgtacttctgtgctctcagcttgatttgataaatacatcatctttcctttttagtatgctattgagtcacaactacaacttcacggacttaacattgaagaaagtatgcggatgataaagccaagagaggtatatgagaaagaaagaaatatttgtcatgctttgtttagtattgatttttttcttcattttcctcaaaagtttattaaaatcttcattactttaatggaactttcaagaaagcatgaaggacctatacttctgttactattagatcattttgcttaaaatagagaataactcagatgtgtatttattttcatttttcaagggctagccatatggcaagcaaactatttttctgttaataccactggattctgccatattcttcaatgggatgggaaaagggtgacaaatttagtatatcattttcaattccaaatgtcatgcccatgggtgccattaaaatcatgctaaagaccagaattatttgttaaaatggaatcgtgactatatttcatgtcccctcttactctaagtatcaaacattttctttgtgtttagactaggatagtggagaaagggatgtggtataatgggaagagctttggctttacagtctggctaatatttccagtgaaatctcagactctccagtttactgggtatgtgactttgggaaagttactttattctctgagactcctttatatttaaacagataacaaaagcatgtgtctaatcaggcttgacctaagatctaaatgtgtactttacattaatagagataaaaggctcacagactttgacatttaaaccctgcagcttgtgtaatttgtcactagtcgaatcatacagaataaattttaggtttcacataagatgctcccagaccgctagtcattgtttggacaattacttctttcaacccagaattactttgaataaattaaagatgtactctattcacttccatttgccaacatacaataaattaatggaataaaaagttctcacatgagaggatataaattgagaggatataaattgttaatttctagcaaaaatgaacatagctgctaataatcacataagtgaccaatattgtggagtttcatgagttactcataatcttgggaccactgttgagcattacctagaacaagtcaacatgagagagggccgtatcctgtcgttgaaaaatgtatttcttatgtgcttaatactgattttttaagatataaattaagtattagtatctataatattttccttaccactttattggaaattatggtgggtaaaccttattagattgttttaagaataaagagttttggattgccaagttatcaattttacttacaattaatgacattcttttctttatataaagtatacttcacttaataattcagatattttaataacaatcccattaatattgggatgccaatttttattgatgcccattttgtaaacaaattcctggtttcttctagtagagagtttatttcacacccacacacatacacactcacacacacacacacgtactctcttaacatggagcagagtaattggcaaataccaagataattaaaaattaaaagtaaactataggataatatcttaatgagcttcccccaaatattaacgtaattaatgatgcattgacctcaaaatcatgtcagacagcactggagaaaattcatggctgggtgcagtggctcacgcctgtaatcccagcactttgagagtttgagacaggcagatcacgtgaggccgggagttcaagaccagcctgaccaacatggagaaaccccatctctattaaaaatacaaaattagccagatgtggtggcacatgcctgtaatcccagctactcaggaggctgaggcaggagaatcacttgaacctgggaggtggaggttgtggtgagccaagatcgcaccattgcactccagcctgggcaacaagagtgaagctccgtctcaaaaaaaaaaaaaaattatgaaaacttcagaattgctaggatacaggatacacataggtactttgtatttaactaatttttttcagctcaagttgtttgcaagaccaaatctaaattcattcacaacctttagtaagtaatcaattattagttgtagtggcaagatataaggaaaaaaccctctattatagtcagttttattgatatttttcttcttgtttgggtcttgagctttagattagtttggaggagattttaatcttaatctaatagaagatattggctaggtaaaactcagataaaagatgtgtaagtgttatgttttctttggtttagtttaatttagtttagtttttttctgagacagagttgctctgtcacccaggctggagtgcagtggcactattctcgtgcttccgccacccaagtagctgggattacgggcatgcaccaccacacctagctaatttttgtatttttaataaagactgagtttcaccatgttggccaagctggtctcaaactccttacctcaagtgatctgcccaccttggcatcccaaagtgccaggattacaggcgtgagccacacacccggcatgttttctttttttggaaaaaataacaggatatcagattgataaatgcaataccaatttctgataatttatcttgctatataatacttcatggacttcttgcactttgtggtgttttattagtcaggaataaggagaaaacaacttatagctgtggaaagagtacaaattaatttttaaaaactggagaataaatcaagcaattcggcttttgaagactttcacttgaaaaaacactttttactttttaattatcatttcttaataataaaaattatgctcaaatgctgctcttatgccagatttttaaagaaccttaatctgaaaaaaaaaactattttataatgcaaaagggctcacggtgaaatttagatcggcaatatgaaattacaaatttattattatcgatatgacctaacttgtgcctaacttgatttagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaaggtatgcacgccatttacttcttcccaccttactccaaacatcactctacttaagagtgttctaattgcatgacttgtgaagtactttagcttgtgtctgagtaaaactatttcaaaagttaaaaaaaaaaaaaaagagtaaaccttgggccaggcacggtggctcacgcctgtaatcccagcacttgggaggctggagcagggggatcacgaggtcaggagtttgagaccagcctgacaaaaatggcgaaaccccatctctactgaaaatacaaaaattagctgggcatggtggtgggcacctgtaatcccagctattcgggaggctgaggcagaagagtcacttgaactcgggcggtggagattgcagtgagccaagatcgtgcccctgcactccagcctgggcaacagagcaagactccatctcaaaaaaaaaaaagcgagtaaatcttacatttttaaaagaaaatctgtaatcttttttgcttcaggcatctctatttaaactgcttttttttttttttttttttttttgccacttctgtggtctcacctccttagtagcagctgctctgtgcatttgcctctagtcagcaggccaggcaagctgtaggtgatgccattggtactcagctggtcagtcaccaggaagcagacaaaatacttaagataggaagtacatgctaggtctattaaaaattcaactcatactttgtcatactataaatcactctataaatgagttttcacttaatgctgagtatctaaagatgaagaaatgcagaattcaattttatcagtagatcaaattttatacaagttactttaaggaggccattttattcctaagactcttgaaaattttttatactgcctgtaatgagagctttttttcctacccactactaaatcacagttaaattgttttgaagtcatgtctctttgtatgtaagtgtttgtaaaaagtgtttttagtatttatttgaaaaaaaaagggcaacattcaacagtcacaatttgtgtttaaaatctttaaatagcacttctatttcattcagcaatcaagccatgtatttaaaaatgtgacaattgaattttattctgaacattaataagttatgggattaatatacatgtgagatctagttaatatattcagttattgaagctaatgaatggaactaattaaaatatatttagcactgttatcagcagtctctaggaatttctaacaacgacttccaactgctttgacggataactctgaaagtggtgcattacaaaagatataaagataatgtcttcttaatttagatgttaaatgttaagcaccaaaataaagggaggccaataaaaaatcatattttaaaatgttatgcaagtaatcagcagtccctgcttccttagtatacacgtatgtctcattaaccttcctagacatgagacagcaagatacagaagaaagaccatgggtttccatcacacaatctgaggttcaaatcttggctaggtcatttaattgttacacaatcttgagcaagttacttgacatctcgctttaaaagtgctaatttaacataacagcacccaccttacaggttcagtgtgagaatgatgaatataaaacaccaaatggattggcacacattctgctattaaatgatggtttccttacctttctactcttctcaattaatatgatattataaagtggttgagagacactttcttttgtttcccattgaaacacaaaataaatttgtttactttaggttttataagtaaatctcatacttaagtactttgattgctaaagccatttgttaaatgttttgcaggttttctttaacttaaaaaatatagtaaatgcctaccaagttagtctcatagaactctcagtcaaataaatgaaggtaggaatgagcagctttaagtgtaactatgaagaagcaatcaatactatgggaatcaaatggggatatagcagatgtagatttatccattatcaagattattctaacaaatttttaccctcttgctgtagttcctcctattatcaaccaaggtgaggcaaagttctttgaaatgtagacttcgataggtctctctggtggtctggtcatctgtgaataaaactgaagagagaggcagagaagaaattaaaggtgtcaatcaagaaagagataggaaattctaagaacaaagggcatgacacagtcactggtagatttggacatgtgaggcaaaaaaacgttttcagaaataaagcatggtgggaatacaaaatgatggtgggatggagcaatgagagtcaatcaggaggttctgaggtaaaatcttcatagtcatgtgataaggaagaagaaacagaaattgtgaaaaatattttaatttaagaaatgtatgtataccaaaaacagcatgaatcataagcaaatagcttcatgagttattttgaggccttataaccatcaccccatcaagaaaaaaaaagtatttccaatactcagaatcctcaatcgtgtcttcttccaaatactacctgttaccttctgtctctgtccacttgggctgctataacaaaataccttaaactgggtaatttaaaaacaacataaatatattgctcacagttctggaggctgggaagtgcaagatcaagatgccagcagacttggtgtctgcttagggctgctgtttgtttcacagatgacgccttgttgctttgcccttcctcacatggcagaagggctaagggagctttctagagcctctaatacaaagggacaaattccattcatgaggaatcacttaatcatgacttaatcatttccaaagccctgacctcctaatactgtcacattgggtataaggttgtgacatataaaattggggtctggggagaccaacatttagaccatagcatccccctttcaaatttataattcccctaacttctaaccacatagtcagctttgtccattttgaactttatataaatgcattattttgtctagttttgaactttatatgaaggtatacacaggttgaatattccttacctgaaatacttgggaccagaagtattttggatatttttggattttggaatatttgcattatacttactgcttgaacacaccaaatctggaaatctcaagtgctccaatgaaatttttattctttgagcattctgtcagtgttcaaaaagttttggattttggagcctttcagatttctgaatttgggattttagatgctcatcttttataaagtttttttttgtgtttggcttatttgctacttttatatgtgtgagattcattcatgcagtacctagcagtacttttgtttgttttttttttctatttcagtgtatttttacatagtatgaaatagatcacaggttttttccgttttatttagggtagatatttggattttattttcatttgagaactactaatataataatacatgctactctaaatattcacataaattttggggggtatacattcatatacatttctgttaagtatatacctagaattagaattcctgaaccataaggtatttgtatatttatttctaatcaataatgccaatcctccaaaaaagttgttcttctaccagcatatattagactttctgtttctctacagcttcaccaatagttactgttttcagtctttataattttagctgttctaagtagtttgcagtggtaatgcgtggcagttttattttgcagttccctgattattgataagattgagaatcttccaaatacttgttgattttctatatatcttttatgaaatgcttgttcaagtgtcttgcccatatttctatatggttagctttcttttcctggtttgattgtaggtggtatagaaattgattttgaaggagagagaaaatacaagatttcaagtggtcatcaaagaagaaaactaattaataaaaagaacaattgataatatgactttgattcacacaatagatttaagatactgaggcttttcttaactgaggaggcctgagattgtagcaagtgggggaggccaaggaaaacaggttagagagctcaataacaagggaaggccagcatgtggcaagagacatcagtttgaagatgcttcttcaagatgaagatgtgccaacccatctttttggagctctgtcttacttccatgtttctatatttttcatattctgttacttgtttctactaggaacttctttcctacacccactaattgtagatgtttctgattgtcccctgcattgtatctctagtgatttttaaccactgccataattcagctaccactgtcaagtgcagactccaggctactcatacaataggaaatagcctgcatcttcccactacatccggatgtcctatatgtaccttgggatcaatatgctccaaagagatttgtgtcatccacaagatgtctctactgtatcatcatgtcaccatctttctggaccagtacactcagcttttctgttcttgacctttttaacctatctcttattaatttcatcctttcagggtctgtctttcttttaatatttctgaatcaaagatgaatgttttcagctacaagaaacaaatgttaaccttgggtgaaaaatgcagatttctttttctcaccacgaaagacttgaggcaaggggctgctggggtccactcagcaactcaattatgtctgagtgccatctcccaagtttccttagagttttctcagactttttccatcacagtcacaagatatttgtctcaaatccagaaatctcatttctatttaaggcagagagaaggaagaagggagaagcagcagggcagcttcatctgtttctttcatcctaagtgctaaatctttcccagaaaaaaacctagcagattcctgctaatgactcactgcttcctgaaatggcagctaagaaagagcatgagtaaggaaatatttcacatctatggccctaaagtagagagagactaagaggaaggggttgggaatgggcttcgggttggctaaatataatatttcttatgttcctcaattataccctcataggatctcattgttcctaacccattttcctctttcgtctttcattgctcctttttcctttttttctatccctttattcttccccctcgctctcctttctttttgttctctcccttgctctctctctttcttttttcttttatcgtctcatttcacaaagcatttgaaacaattcatggaaaattgacaaggtgaaaataagatataaagcaagaggaatcaagactgtatgcctaaatcatcttgaggtatgaatagactttcccacaaatttagattataataagaaataggaaataaataatgaaaaatattttaataagaactcttgatgtgttaggtagaatagttattggttataaataaatacagtcacaaatgtcttcacagtgatagatgtttatattttactcatgcatcgggcaggaattaactttctctccatccattaattcaggtttccaaaagattcatggttgtgtcctttggcttttgtgtccacagcctctgtctggattcagtcaaaggaatgcacactaacttctttaaagtcttagcttagaaatggcaacatttacttccacttatattccattgactaacactcagtccatgaccttttctgggaaatgaagtatcactgcatgctcaagaacagctgttagttttgctacacctggaactagttattgtgtgttcctgatggaataggatacttattctaagatgcagtatggcattttcattaacagaatgtgtagatcaggaagacacagtcagacctggacttgactctaggtctctacattacttttcagcatagttttaattcatttactaatgtgagttattttgtccatttaacaaattaggaaaataatcgtgccaacttcacaggtttgttctaaagagaatgaaaaggtatacattttaaaaatacttagtgcttagcagatggtaagcactcaataaatgttagcagttgtcaacatgttaagaaaaaaaattggactatccaggcttgttggaaaaagaaataatgaagaaatgagattttttaggcagaaagtgaaatatccagaattttttattaaagactgtcactgaatagttccacactagaattaaaaaaaaaaagaaaagaataatctaagcagtttggccaggactcaagagactaaactgaagttttaaaaagttaagagatggaacttacaaaaattttaatagtcttatttttaaaaaactcagcacaaactctttgtactcctccatccctttctaatttcatctaaagtggcttaaagcacatggaaacttaaatgggacctagttgttaggaagagccaaataagtatttgttgaatgaatgaatgaatgaatgaatgattcccttaatttctcacatcttttacacattttagtgtacctaatggatgctggcatatttgttttttttcagcttactaaaagttgaatgcaaatggtggttaaaaagaagaccaaattctgcaaactccaacattgttttattagcttctacttctttgtgtgccatatgatgctttgtttgggtgcaaacgtctcacatctcttagactcaatcataagctgtttaaattattaaaaaataataatcacaatgatagcccaggcagtttgaataaaaatgaattacttctggatccagaataatttaaggcaaaaatcagaaatacgaataaagacatcattaataaaatcatttagtaaaatcacaggtacccaaaccacatttaaatatgaatatccacctcagtgaaccttctatttatcttcagatagtcctaattattttttaaaaacaattttgagtttattttagaacacaccattgagtgatcaagcctcaaatttctacagaaagcttggccgtgatgcttttagtcctgaaaattggaaatcaactgtcgtaatattataatagaataatatctctgtaatatctctattacagtagaatgatatcaataatacatgggatatcagaacttgagcaattaattagctagaataaatgagtactaaacacttttgtgtacaaatataaattagcataatgtatgaaatttttatccataaaaattaacctctttcataaaagtttaatactggaatgttaaataagtcatctttaccagaaattgttgacattagagacattttgctattgtcactggccattcaccgaataggatcttagtgtataagaagaatcctgtcgctattgtttctatagtagaaccatagaatagcatgcatttggatcttttatcagtacatatttggtcagtaaattataataaaggagttgcaaatagaaacacctaacttaacctggattgtcagggtgagaccttcttaaagaagatgagatctgagccaattatagaatatgggtagaagttatcaggtaaaatcccttctagaaagttaaaaatattggtaggattgcagggaagcaagtatttcagtgtaatttgtgtaattttagaaaagggaggacaagtctataaagcagaccaaaggccaactaaagaaggtcccactaagccatttagctttgccctgaagacccatggaaagccattgaaaggttttagccattcaaagagccatatttatattaattttacaaagaaatatcctgcatatggtgatgagaatagattggaatgaaatacaggtggacgaaaagaggcaattgcagtatctttgcaagaatttgaaaactctctgttgcgtgggcgccgtagctcacgcctgtagtcccagcactttggaagcctgaagcaagtggattgcgtgagcctaggagttcgagaccagcctgagcaacatgttgaaacatcgcctatataaaaaattaaaatatagctgggtgtgattgtgtgtgcctgtagtcccagctactcaggaggctgaggtgggagtatcacttgagctcaggaggtggaggctgcaatgaaccaagatcataccattgcactccagcctgctggacagagtgagactctgtctctaaataaataaataaataaataaatatgctctgtcattatgatacagttcaaaagatgaaggtatgaaaggacagatccatttcatgcacacaattttttttatctcaggggaaatcatttttattcatcctcattccctcagtgacaataaaaacaggttacgtataagcatcagaaataaagtatctgtactgaactcctgtagtttaactcacctttggttctattcacagaattcaagaaaaagacatgttaaatacacacaaacacacacatatatatatttgtaaatatttttgggtatgcttatatacgtgtatatgtacgtgtatatatatacttgacacattttcagggtgatagaagatatactatatctgcttatgaaaaatgttgattaaggaatttacacctgtattttgatgtaggggaaaatgacataaagcttagatgcaatgttccattagctaattggtctttactcttcactttggaaatagtggaagattgttttgttcagacagatagtgaacaatctgtagtcttaaatccatgcaggtggaagcctaaaatatgtcaaataagtcaaaatatgttggtgaggatcagtgcccaagaatctgaaaattttgagctgtttctaagaagtcttcatcaggtgtttaatttaagcttttgattaaatagaccatttgagaaataatgattaattctcaatggaaatgaagcctggcctccagatgttgttataggattacagatctgggaaaagcaagcctcctggttgtcaatcaggatctctgcttctgcagccacccttatcaaagccatgagggatatctatttctcctgaattagcctcattcattggcataacagctaaacctagggcctcccgaaggaagtgttacacttaagttttttgtagatgatagatgtttcataaaatacttaagttgcctaaagcccagagtatattcttgaatattccatttttcatgcctcttgactaaccaaggaaggcagatttaagtctttgttaaactgaaaaatgaaagtgttccaatgtgaaatgtacacatcagttctaatttattctaccctccataaaagtggaaaaggaaggctatgtctcatggcaataaaaatggaattccaaaagatctttgggcagaaaaaaaattcccaataaaatatgagagatttcttccacaccattctctgaaattcacttctttcatcagttaaattatttatacaaacaagattagggatgtcaacatgaaaggttagtcgatttgaagagaaaatattttcgcagcagataatctatcttatggaggagggtggtgagcaaagaagataatcatcatattgtctataaaacctggcatcaaaggaagcaatttagaagcagtgtcttcgagaattgtcccatagtgtctatgcaatattatcaaattcagtatgtaaataaatattttaaaataaagtaaatttggttgaggaataggccattcatgttgacacagtaatcagcagaaaaataccttatgggagactgttcctttattttatatctaaatggggctatctccagatataactgtcactagtacgtgatggataaattaaatacttgcttcaaatccactttataataagactagtaggtaaattgatgaataaaggttaaaagtcaccatgtgtctgaaaagtcagttggactttgttgggacagttgtgattggcaccatgttttgcctacttgaatttcctgcatcgtgtttctcccacaggatgaccattgttcctttactgattgtggaatagaatgcaaataacttcagctctttatgattttgcatatgctgaattatcagtatcatattttccactgttctccttcacataacatatatcagctaagccaaaagttgtatatattccctgtctcaatgtcctactttgtgcctccttgtcttcctttttagctttccctccacctacatattcccacaagtgaagattctcctttcctctattcccagtcaaccattacttgcttcacaggttacaacttgtcctagaggtttgctttgtgtaggccctcattgtattagcaaacatggtgtatttttaaaatgtagtcatatgccaacaataggaaatcatgagatttcatataaagactcctggtttcaaatatcttccaaaaaattagaagtttgacaacaatggaccttcattcctataggtggcaacactgggtagcagctctgtcccttagatggggcttaagctcttcgacacaacatccatgtttacccactgagcccaccattgaagccaagtcatcgctggtgaatatatctatatgaataccacaacattatgtgtgtgtgtgtgtgtgtgtgtgtattcatgcttatgatattcttacaatgaagtgtaaaataaagtatttcttgcaggcccaactcgtacattgcttgactgactcttgtagaaacctgcaaatgaaatccttgacttttattggcaacattttctcacttttctgtatcaggatatatctgtcttcctgctatacttccacaccatgatgaaaaatgtatcattggccaccgtttgcactgtcttataattacttctatgcctattttaactctcaaatttaggaagctatgtcagtagagtgttcaatgactgattgagggtagaccttgcaaatttcacagattcatgtgctttgcacatagtctttcatcattaaatacatacctgctagacaagtgaatgtataaatgtgtgtacatcagcagtcaagtggaccaggttgatttgatggaacagtactgcataaaaagcacaactgtattcctgcttaaaaagaatcagaagcttctacagaataacttataatggttaattagtctaaaaaatcaagatgctttttgtaagttttgagttctttttcaaattccacttctattctttgacacacttaggacgtgcagactgctccgttaagtcattaaatattaaatgaactaaattaagcttgaaaaactaccttaagctatttttcccatcttgagtctcagaaataaatcaaacaaactacattttgtgtgaggtccttgctagccagagaaagactgtagaagagaacagcatgactgaatttatttaatttttcttggttttcatacttacttttgacagtaagtaaagacaattatttttttctggtaaaaagaaacagctgaaatttgctctttcaagcatatactttatttaaagtggcgtgattattgtacctgcaaattatacaatggtttaggggctcaggattggtttgcttttcctttcttccaaaccctttactcttatccatccagctgtcagttctctctaataccttctcaattcacacctttcccttaaatttcattagcaaaatgctcattttcttccctcctcttatctctcatctctggatttgacaatcttgccaatgtctactttaagcaagcagagatgaaacagtgaatctagtctctgaaataatgcttcgtaaaaatgtgaatgataatagctacagttgatggcctactgtgtttctggtacttgacatgtatttccaattttcctagcaaccctaacagtaagttttcaccactgctcatttgaggagagtgaatctgagagagtttaagcacttcctcaaggcaatttagctggcaagtaaaggctagaatttgtgtctagctatagctgataccaaagctctctttccacagtattgtcttgtctatatatatatatgnnnnnnnnnnnnnnnnnnnnnnnnnnnnnnnnnnnnnnnnnnnnnnnnnnnnnnnnnnnnnnatgattagtgtatatatatacacacacacacacacaaatcatatatacatctaatatatatttatatataaactaatctcatatatacacattatatatattttgtatgtatatataaactaatcatataatggcaaattggtgtcagcatttagaaacatcaaagaaaaaatatataatctttttcttggtcctttattttcttggtaatctgagacctctgtctctgtagtctacgtaattgtctctcttgagaatattgaaaacccacaagttttactttgctcctaaatgtcaagaaggcatagcctaaatgtcaataagcatcaaaagtctttctgaatgagatagtgccagcattcatcactgttccttctcagaacctcaagcctactctttccaattaccctcatatagggaagccccaatacactggcccctccataccccttttatctccttctggcaggtctcttaggcagttgctccattggcaacagctcccagcaatgatggctgcattactactcccatcctcataccttcagtgacctttggggtgtttgcagcagctttccctctaattaagagcttgcaagcctccgtgtgcttgggaaacacagctgcaaaccactggagagaattccagcaggaagtactcatccctcgctcccattgtctaataccagctgaggtgtacattacactcaagaaattttattctttcagatgtataatgacctctcattttacgtcaggctctgggtttaaaaagagacagacagaaaatagagaataaaagaaaaaaatcccaccatctctgtctttaaagagatcagaatcagatgtgacatagaaatatgtaaagagaatattgctttagactgtgttaagtgcttgacaacgggagacaatagattcactaaggtgtcttagaaaaaacaccctcgacatgttctaacaccacccaaagtatacttatgtatgctccaattcgtttagctttaaagttgcccaaaaccacaaactgaataacctcaaggagagcattcagatagttcagagcattcattcccatagtcaaccaaaaagtatctgagacaagtctcactcagtttagaagtctattattccaaggataagtacatgcccagaagaaataaaaacggaatcacagaaactgtggtctgtgcctttctacaaagataattttgagggcctcagtaaagggaaaagtgggctggaggggaaagaggaagggtatggtaacccacatggtgcaagagagaaggagcaggtaagggaataatcaattatgtattcctctcatgctcagtaaatcagcactttacataaaataaggtgaacgtagagtaggatttaaccttttatctgtagctatctgcttaagaaaaacaggaaaggcagcttctagtatgactcagctttcagctttttccttttggcctagtaaattgaggtcccagtttttattttcctttcacaccactgaagttgagaagctgtcatttccccctgccatctatttgcataactagagggcataacaatggtgccagattctttgccagtttcccccaaggagtaactgactagctatgtaaatcacattgctggaagccttctggaacttaaacaaagagtaacttgagttacatattaattttaaaaaatgtaaaggctctccttcttgtgaaataaacatagctcaagaaggcctatacaaattgtgatagcttggccatcttcagcatcttcaccatcgctgttcaggaatccagggtttttattgaaagacaagcatcagcttgcttctgtccagcctcttctctccaactacccattctgtgactcttttcccacaggacattcccttcatattttcctttagagtagcaatagttataagctactacacttttttaaaatattagggtatggcttgaaatcagtgggtaataaaattctaatgataaagtcaggagccacggaaatactggtagaagaggcacttccccagcagaggcctcaccctcaagcctggagaccatggccctaaatgagaacagttatccctgttttcctgcctaaatgttgttttttccaaaaccaccctggctcaccatgactgctccccccaccaaatcctgtacccataaaaaccccaaactcctctggcagaggagcagagtggcatggcagaaaaggagagaagaagcatctgaacatcaaagaggcagctggacagtcagagaggatttcagctgggacagccaagctccaggggaaaattagctacctactccatcccctttccagttcctcatcccactgagatcccacctccatcactcaattcaccatcctttaagtccctgtgacctcattcttcctgtatgccagacaaggacctcctaggtgccaagagggcaagttgtaaaagactgtcacctgactccacactgagcttgttaacatttggccatccatggaaggcaactgctgaaagagcactaattgtaacatacccctagatgctaccatgggtctggagcccaaaagcattcaccctggccccagcacacactcgcctgcatgctccccctcccacaagcagctgagtaagtgaagcacacccaggtcgcaaatcctctgaaggggtccagggagctctcccatctccctaattctgtgttagcctaatttgcacaagttgataaataaatgaatatatcttgatgaattcatttcactgtttagcttatccttggatccataccagagtttttaaatcactacgtaaacatgtttactctaatttcattctgattccaagttaaagatactcatttttaattcaatgagttccttgattgttgtgcacacttttctcatgatacccattttttgattcagaacactcccttattggatttcttatcttcaaaattaatgtcacaggtgcgactagctggggctcgtcatgggtggtaaaggaatttaccacgacagtcataggtgaagaaaggcagatttattagagaaggtatgaagataccttgcaagaaagcaatgggcattacaacagagaagaggctgtctgcagagaggcaaggggtggagggaagttttatggggttgtgctggagggggccacatgctgaccgaagccatgctgctggggctatgtgtggaaggaggtcactgtgtccacaggttacttgtgattaacatttctcagaacaattattcattattcttccccacctggggccctttctttgttgttgcttacttatcaaggctccacatttaacctttctggaatctcccaagtatattcatggcatccagttctctagcattagcccacctgagtggcatggagaagtgttgtctctaccagggcctgttgtctcctctgtttgtatatattgacacaaatacagtcattcagtagctctaggacaacggggtttttccaagttatttgttgtgtaaaggttttttgtaatgatcgccttctctatgcacttacattttaaaatatttggtaaaagatatatttgaaatctatcattaggtaaattaccttaattttaggtaatttatcagaaggttgtgaactcaaaagtatctgagacaggtcccagtcaatttagaaagtttatcttgccaaggttaagaacatacccatgacacagcctcaggagctcctgatgacatgtgcccaaggtggtcagggtacagcttgcttttatacattttagggagacataatacatcagtaaatacataccagatttacattggtttaatctggaagggaaagacaactcgaagctgaaagcctggggaggagagggctgggcttccaggtcataggtagatttgaaaatatttttggtaactggttgaaagagttattatcaatagaaaggaatggctgggttccagtaaggggctgtggacaccaaggttttatcacgcagatgaagcctccaagtagcaggcttcagagggaatagaatgtaaatatttcttatcagacttatggtctgtgttgatgttaatgttggaaagcataatgaagtatgtccatcccctcttccatcatggcttgaactagcttctcaggttaactctggaatgcccttggccaagaggaggggtccattcagatggggccttagaattttagctgtggtttacaaaattgaggctcaaatattttctaccatctgaatttttctcgtttctgttcctgtttggtgctcaactaaaatgtgagcatttagaattgattttcaggtggctagcttcctggatggaattttgtgtggatatatatatatatgaataatcatattcattttttgatatcttatattaactataagagccataggattaaaataagttggaacagtattctggttttgtcctgcagaaaacgtaagctttggttctggttgccgtgtgacatgatttctactaaatttcactgaagctccacttgaagattgtgtctttttcctttttatttgtgttgattttcattttctattgtttcatgttttaatagtgaggagttgctattctcattgaactatactatactgatataaataaatgaagcttaatacattgcataaaatagtagatagctatattaaataatttttggaaaggaattgtgacctgtagaacttactgactttaagtacagcatgaacataatatgcaaataatgcttagttcctactcataaccagagagttgggaggaaaggaaaaataaagagtgagaaggatttttgaaggccgtggcaaatttagtctgcatgaaaagcagaactttcagaatagaaattcactctgaaaagaggcatttacagagatagtggaggcccctcttatagaaatatttactgttgtttttaacttagcacctaagtatgcttttgaatcataacacttgaatgagttctggaaagttaaatgctccaagactgtggcaaaaaaacctaccagctttcatcttcctcctttccattcccaactttctctagtactattcaaaaactccctaattaggaattcctttgggaaattccaatatcagagttaactagccaacctattattgctaatcatttattcctaccctctatataaagatgaccagcatgtgtgcacacacacacacccagacacacatctccctataccgttttctttttttcgttcattttctttaaatttcccattatactttttaaaaagtaatattgtccaaatttatagcactgtagttcttggattgtttcttattacttttgcatcaagcaaggaatgatattcagaacacttaaagttctgattggtatggtatagaagctgcatttcccacagtcacaaagaaggtcatactccatgttaataccaggtagtatccatcattagcctattagaaggtactgatagtcacctggaattcacctaccataatgatagtggcactggcaaaggcattgtctcatccactggagtctgggccagtccctagcagtgaacattcacaggctgatattcgcagacacctctcatgaactcaagggctgcaaccatggttggttagtcaggtggcttaggacaaagactttttatgtaccttaactattttattattttaataattaataagagcgtatcaatgcataccatctatatatcagccccgggtatagtgacaaatatcttatcttgtataagtactatttttcataccaaatttgctaattattaagagtcttcacagttcacaggatttaatcttggtgaaaaaggaataaactaaataataacaataataatagtccaaaatcaatttgataccaaatcaatcaataaagtgatcagagctttaatgctactaggaaaatacttcagctttaccattttatgtttcatttcaataggcaattaatcaaagttaggaaagagtgagctagcttttctcctggaaatttcagcacaggccctatgtatcatattatttcactaattagaaaaaattttagttttgtgttagtgaagatggcaaagacaaaacacacacgatatttcttgttaattgagaatgattttgaacatattctcaactactattttgcccaagatacttcattctaaaagatgtcatttctgaataaagagcacatgcaataaaattgcatcagaaacagaatccctcacataatattcttacaaatttaacatcactttagagaatagctattgacttttgtaagactttattatttgttcattcatttatttttttattcaacaattatttgggttcatactgtgtgagagaagacagtaagattagaaaattgttacaagagagatatacaaacagggcagtagaataagagagaagagaaagatggttaaagaatcttcactcaaagttatctggtgatcaaaatctgagcttgctaggcaaatggaggagagaaagcacatccccaggaaagggaaaagtttatgtaaatagagagaagtctatatggggtatctgaacaaggggcactaacagatcatacagatctttagtcatacccaggagggctgggtatggtggtttatacctgcaataccagcacgctgggaggccgaggcataaggatggcttgagcccaggagttcaagaccagcctgagcaacgtagtgagaactcatctacaaaaacttaaaaaataaaaaataaatagctatgtcaccagaaaagggctcccaatccaagagaccccaagagagggttcttggatctctcacaagaaaggattcaaggtgagtccataaagtaaagtgaaagcaagtttattaagaaagtaaaagaataaaagaatgtctactccataggcagagcagccccgaggactgctggttgcccatttttatggttattatatttcttgttatatactaaacaaggtgtggattattcatgatttttctgggacggggttgggcaattcccagaaccgagggttcctcccctttttagaccatatagggtaacttcctgatgttttcatggcatttgtaaactgtcctagcactggtgggagtgtcttttagcatgctaatgtattagcttataattagcttataatgctaataattagcttataatgagcttataatgctaataattagcttataatgagcagtgaggatgaccagaggtcactcttgtcatcatcttggttttggtgggatttggccagctttactcaaccagttttatcagcaaggtctttatgacctgtatcttgtgctgacctcctatctcatcctgtgacttagaatgcctaacttactaggaatgcagcccagcaggtctcagccttattttacccaggccctactcaagatggagttgctctgattcaaacacctctgataaccataccaaggactatgagttgcattctgaaattaatgggggctctgtgaacaaaggcagtgagtcttataatcaaatgtatgatttataatgtttctgggaggaaggcaggctggaaataatcagaatggcctgaaaatgattgcaagttttggattgactataaagtaaggtggcatggtggctgaacaatgctgtgctggttgtgtcaatatgagtgtgagctgtgtcagtatgagtgtgattgtatcaacatgagtgtgagcacctgtgggtaattttaaataaaatgtgttgaaaaatacttgatttttattgaaaaattgcataaagtagctactcaagtatagagtgtttgctttcacatatgcatatcatgttacctacatgaggcaaaacaatgaaaataactggatggctgtagaaaggttttggagaaccattagatttttttaatgtttaagatgctgccatctagtgacacttttgtgaaatcactttgcagtgatattcatgtttgtatcttccagttcttttctcaatacattttatattttaataatttatattgtctaccaaccaatggggaaataattacaaatgcattaaacatagtgtagaagtcatacttgatttttcaacgtggtaccacaaatgtggccagaaggattttcataatgggatattgtacataaaggtttgtggtttcttcagtgtgccattctttataagtaattgataatgaaagtgctgctttttctatttcttgagttttcttagaaaaattgagttgtaaaaacaaatctgtgaaaatctgagctgtaaaaattgcttcataaaagttgctttaattggaaatgttgaagagaagaaaagagagtttcaaatttagaataattaacttttttccccatatggaatttcagtattataagtatatcttaaaatataaacaaataaatgtgtgtggaggggtgtgtgtgtgtctgttaaagctaaacattagtctccaaacctaggttgtgatgacctgatgacttctaagttttgatgaagattaattatattcatgtcctattactccttaaacttatattacaatggagcacttgtcttattttcatggtacgtattgctcattttctttggtgaggaacaaagaataaattaatctcccttcctccctcaaaatacagttatattgtgctgatatattgtccttttgtgagatactaactccagtcatactatagtgaatgaggttttaattaattaacttttcagtatattgaggtttctttatgcaaaccaatcctatagggtagaggtaagcacatctttccgtaaagaaccaagtagcaaatattttaggctttgtgggccatatggtccctgttgcaacaactcatttctgctgctgtagcgtaaaagcagccatggacaatatttaaacaaatgagactggccgtgatccaaaattaaatttacagaaacagactatagtttgcatgtctcttctctagggaaaacacctgtatttgtaatttggggttctttttttcttaggaagtgttagaacacttctaaaatttatttaagtatttacttcaaaaactttaattccattgagagttgtgtgccttcagtgttccaaaaaatctagtttggagcaggtatgtgcacttggtaaactaatcgtacacatagtaaactacacttggtaaaccagtcatacacaaacccagaggtaaaatgttttgcaaagttctatcacctgcatttagccagtttttaaattcatgttcatgtacaaagttgtcttaatgtggaatgaatctttatattttctcagtaaacattgcaacattttgatatgcagtaagttaaatgactttgatcatcagcaaataaattagaaacttcctacttgggtacaatttggataatatgtattcattgttccagtttgtgcttctgggaatttagtggaaacagagacttgcttttttaacattgtgaattccactaggcagacacacaaaacacttaaaacctcatgacaagtaaataactaaaacagaatggagtcagatcagaagagactcttagggtacaaagtcaatgtgtatgaaggagacagtagagttaatattaaactttgaaattctctcccaaacaacttcattcttcctctttatttttggataagaatactttttaaaaattaagcaccatataaaacagctggctcacattgaggatctgtactgtatcaaagtatgcatattttgcttaccaaatagtattaagcaaggattgttactcttattctaacatgagaactagaagaactcacgcagtaactgatccaagcctccatcttgtgatcctttggtatcttgtactctttaagaggaatggcaggggtaattcctaagaccaagtaaaggatgtcttggtttttgggagctgagtatatcaattcactcttcccttaaaatgctgtgtaacaaatcatcttgaaacttgttgtcttaaaacaataaccattgattttatggatcaccttggcatcagagcatcaaggtaggacttggctggaggggttctgcaagtctcagctgagctcattcatgtttctgtggcaaactgcaaggggtgaggagggcatggaggagcagctgatccagattgagttcaggtgaggatgattatgctccacatttcttttatcttccatctgggccagcagtttggcccaagcaagtccttctcatagagatggcagagagcaagagggagcaagcttagtcactcaagtacttttctgagactatttttattacatgtgctaacattctgttggtctaaacaagtcacatggctgatcccagtggctgaaacttacaccttacccacagtggaggaactagaacttacatggcaaataacatgggcgcaagagagggcagagaagcagaaccattgatagaatttataacagtgtatatacttgaactgattaaatatgcacatgatgtgggattaaatgctaaacaagaaaactattgactctttcatattactaggatacacttaagcagcagttcagaaactttttagaaaaggaaaccttttacactcttaaaaaccactgagggtcttaggagatttgacattggctctatatctgtatttactgtatttgcaattaaaacaaaattttaaaatgtatttatttgttttagaataacaacaaatgcattacatattaacataagcaaaatattgttatacaaactatgttttctttaaaaaacagtagcattgtttatatatggcaaatcgtattagcacctgacttaataaaagacagctggttttttatacctgcattcaatctctttttttctctttttgaatcttacaaagaaaataggcactcatgaagatatgtaatcagaaaaggcaggagtagttgaatagcctttccgtcaattttgtgtattctttgatactgcatcagaatttgacaagtgagaactttttaggagttctggtatggaatttgaagctgaatcactgaactttctgtactttattatattaaaattcattgactgaacttgcattttgaatagatcctttatcaatgcacaatatgtaacatcgagcattggccattcagaaaatattggttcattgaattatgtgtattttccaaatattgacatatttaatcatataataattagaaattatgtattactactatattcatcagaattatctcaataatgggagctagtcatactcatggaagtggatacaagtttttcaatattctaatttcccctggaaactctaattttatcattggcagcaaatattataagttgttttattgaagtgacactccattttcaaaagaatatctgttaaatacatcacacatgtgaatcgtcattgtttgtcagttgctctttcatgcagaaatggttgtccatgatataaaagtggcaggttcagcttgccactcaaataattgcataaatacattgctttaagatagccatcctacatcagaatgtggtcaagggttttatgtgtacttcccacactcaacattaaaaatatagaattaagatattgagatttaatgaaaattgatcatttttacagttttcacaaggatattttcacatgaaactttcccatgcccccaggtgaaaggctggaaccaatgtaatgactactagtacagttcggtaccgctgccttggctcctgctaaggtggcagctgttttacccatcactgcttttgcattatcaatgcaagtgtcaattcagcaaaaaaggcaaagaatgtcttagcatgatgacaattgctttgatctggtgggccttctgaaagggtcctgggaattatggatcatactttgtgaaccattgcatcaaagagcaaaccataatttatggtacagaagtttgtcaaatgttttcttaaaaatatttgtacttattatttctaatcatgaagcaaacttaaagcttattattgtgttcttccctagggttgttatgttggctttgatctagcacatgcagttggaaatgttgaactctacttacatgactggggagttgattttgcctgctggtgttcctacaaggtacaaacgagttaatacatttacatccctttatttcacattgactttaatctgaaggagaaactgggtctgtgggccaattttaaagatttgagttactttccctatttcttttattgtattttctgctttttgttaatcgagttatatgatggaatagtatgataattaatataattctagtatttctatcaatatagagaaattaattcttcaattccttggctgctatgaaaaagtcaggaggttctgtagaaaaagccctacacttaattcaaattgatcatctttttagtttttttattgataagttgtgaaatttctgcatatataaagataatatttagagaatcaacttagaattcatatttgaaaacagttgacagggagcatgaaaataaaaccaattacaatttacttgctttaaaaatatatttttattattattacaatattttaggacaaaataatttaaatgtatgaatttcaaagccagatctcattaaaactgctttctaccagctggagcaaaattgccccgtaaaagtaatagccatttattctcaacctaataatactattttttatttgtttttctttgaggaaggtgacctaagcttctgttttatcataaatacacaaataatcacacattttgaactgatcaaatgttgtggtttcaattaaaaaattcaaatgactacattgtttagttttgtcatatatttaagtaaacccacataatttaatttattttcaatctagtatttaaatgcaggagcaggaggaattgctggtgccttcattcatgaaaagcatgcccatacgattaaacctgcgtgagtaccatcttcagctaattctttggtgatgaacaaattaatttgcattaataatatgttaaatttacatgagttccttaagatgctatccaataggaattaggattggattataattattttcctactctgctaacaacaatatacttcatttgaaatacatgctttccaaagaattcaattggttgaacaagaaatttaatcaaaaagggaagcttcagtgctaaaaacaagtcactgcaatcatgtaaagcggatggtttaatgcaaagagaccacttgaatattttttttcaaaaattagactttagaaaatttcagattcctcacgttgatgaataaatcaaaggcaaccagagctgtgcctaatagagccttaaatgtggcatgttattattaaaattacatctacctttaaagctgtaaatgttacatgatagcttgtagggaatatcttctgtcctaaaagactttataatccatgaaacccgaagaagctgaacactgaacaacagactgactacataaaaagtaatacttttctgttttatagaactcttcatattttagagcaagtataaatgcaaatgtaatacaccaacaaacttacacatttttatttgactggggaattcataagtgttccttttacttttttctggtatggaaataaagaaataatatgctgggaagaaaaaaaaaaacccttttcatagttgttgtattggagtatgtgtggtgaggagactgtctagactcctaatagataatgtaataatgtttgattagttttctgaatttcctcagccactgactgagtggtaaaatctttacaagaattgaagctgaattagtaataggctttggagcacctcacatttctgaagttctgtgcatataaatcctaggaatttaagatgattttctatagtttctttaattgtgtctaaatttttttcaaggttttaaggttttaaacttaagacaacatttgtcttaagtttaaatatctttggacagatatttagtcaaccagacatcttacttgaatatcattatcagtacattagatttccctccatgtatgtcccaacatctctgagaagattaaaaagcaaatattataagaataccatgttttccacatagacagtatgtaagatattgcttgcttttgtatgatgactcacaaccctggccatttctcagtctccatttatttaaattgaaatagaggatctcatgtattatatcaacccaaagggtgagccagtgcccggatagaaggaggtggggtgggggggaagaagtaatatacataaattctagagaatgtcagtgttcggagttaagctttgacctcctagcacacacaggtcttgtacttgagatttctctcagcatggacaaggaacaaggacaaagggattgtattgtgctcacatatgcctcattttgtggaatttcaaaatcttctagacaatgtttaaatctatgttaagtctaagctcccaagagaaagaccatctaggcagaccaggttcacagttcagcttggtctttcaggggtctgtcacctggagaatcttctatgattgttcagtattctggtctctgagctgaggtagtaccagcccctactcataagcagttattgtgagaataaaatgagatgatgtatgtaaaacactaagtgtatcacttgaacatttaatatggtttggatttgtgtccccacccaaatctcatgtagaattgtaatccccagtgttggagcaggggcctggtgggaggtgatgggacaatggggcctttccctttgctattctcatgatggtgagttcttaatgaaatatagttgtttaaaagtgtgtagcaccttctccttctctctcttcctcctgctctggccatgaaagatgttcctgcctcccccttcaccctctgccatggttgtaagtttcctgaggccttcccagtcatgcttcctgcacagcctgcaaaaccatgaacaaattaaacctcttttctttataaattacccagtctcaggcagttgtttgtagcagtgagagaatggactaatacagcattatatgtgatcaataggtatggggttatatgaaaaaaaaaatccaaaatttacaatatacaggaaaaagatgggtgacattctgtaacaccctagcccaagtattgtttggtaattatttagtactgacccctaagtacttcgttgactcactgagaatgtgcatagtaacatgtagactttgcccagtggagatcatttctcttaagcagaaaatataacctcaaagtttatggtttgtgactttgtaggacattagtttgtaactatcaccaagtttattttagcagacctttgatgagctgactgtagaatataatctccattccttggagatataatctctcttatatgctataagaaagaattctggccttcctaccatcttactgattccgccactatttagtgggttgaatgagatctttcatggctgtttattttgtgtgtgtatgagaaccttgcttttaagttttttggaaaattatatgttattagctgttgttgcattttaacaatttagccatggaaatttatgggacttaaattaggcttgactcatgaaggccacgttaaggaaaaccttggttgtttttctgtttattgttttctcacactcctaagcttctttttaagtgatgtcagtgactgatctcagtgctgtcaacttctagccttggctctctattctgtaccaagtatcttatattgtacttcatttgcattaggagatcggagttctttaattaggaatggaatgcaacagatttggacaagtcaaggacaaggtattttccagtcatcacttcattgtccctgataggaaaagaaatgttttgctgaaacttaactttgtgtcccttagtgtgttttacttttttattcacctgaaaatcaaataccacctgtgagaagagtgataaacaaagaaaagacccaaaagcctacaatatcacgctgctcaaataagtgtaattgttcagatgttacgacaatgttccatacataaaatattgtgaagatggggagaggaagttttcttgtgaataatatttatagttccacggtcaaatccaatttaaactttgagtaaactttagagtctgtatgactactgactctatttgccaattaataattatatttcagttgttagcattccacgattagctggtttaactatgtttaataagccttctgtcatcttacttttctgttctcttagagctttagagagaccaaagagtttttcactgttaaagtgtccagtatgtagccgagaaccatatggagaacatcaaatacagtggaacaaatgtaactgctattgatgtcacactttgtgaagtagtctttgttgcttaaaaagggtgacatctagtggctaaacatgttatttcaaataaataatatcgaaataacatttcttctcatggtccactcattcactctttaacaagtattttgaagtatatatgtttgaattatgtgttcttctttttgacaatttgactatatgttgatagtgcaataattgtgcagtttaagccttcaataaagaggtagaatgtgatgaaaattggaaggaaacctgagggggcattcttagtgcttggttaaacagaaagcttaacagttcatgaaggctggtctaagaaaggaattataagcatgggtgacccacctggtgtagagagtgtatccccagatatataacattgcattttagaagtctaatatttggtatataatttttgaaatagtcctttatgtgatgtttccattagcaaacagcaaattgcatctgtaccaagagatttcacttccttttttgtttaaatatgcattttggacattgttcaaaacctatgacctaaggcttttccaagagccctttgcccataaagagaatgaataaattagaggccagagtcaacgcacggcattaagcatcataactcaagctgttattctcacctagaatttaaccttttcctagttcattattaacttagctcattgcaatgtcatattctaaactctgtctgtacaataaattaggactggtcatgacttcttggatgtttttgccccacttcaaggtagactttaattcagtctacacagttaattattgctctgaaatatgaagggaactactcttaattgtacaaatttgacaatatgaaatgtttcactaaaaacatgcttaaataacattgtaaattttgaatgttttaaaaaaagttacaaatgttaaccctcatggcacactttagaggactatttaacctttcaactttaggggattcaaagctttgtgaatcctttaaaaggattcttctgtaagagcccatacattgcgatttaagataccacctccctctttttttgttaatagagagtctactatgaaaacaggagtggataatatgaggtattacaaatccatctatcatttacttttttatgtgagccagtgaaatcatacatactgaaaacctgctgttcctcactcttcacgctggtgtagcaaacctccacatgtgcccattgtattagattctcctaaaatgcacatttcccttgggatacttttcttctgagcttttttgaatgggcaagaatggggccgactgacaattttgataaaaatacttgaattttaaatcatgccaacacatttccataatcagctagaggtatttgattgaaagttttaaacagtgatgacattttaaaggccttattaagggcttgaattatctcctttattgtaaagagtaatttgctggtgaaaaagaaccagttgaaaaggctggctgacttcagtgcatggttaagaaataagagttgttactatttggcaacaacattagaaaaacaatatgcatcaaacaattcccaggaaagtcccagaaagaataaaaataaacatccagaaatttcagcaaaaagacttaaaaaattataactttataccatgcttgtcccaactgtacagttaacattgtatgaagagatcgtcttttgcacatttgttcaggggaacactgacttatatatttcacttccatatgcttttccaggcaacagttgagaatgccatagcccaaaacttatctataatttaaatcctgttttagttttctaatgatgccttctgaattactacttatcaagtccctatctagtaccagaataaggccttcttgtgcaaagtttgagacaacaggaagcataggtcgcagtagcaagatgtgtgacttcacaacacttctgatgctttcaaatgagatagaccagtaccaatagatttctcagtgagtttttatagaatccccagttgaaatatgacctcggccttctgaggcacctgttctgcttgtttagcctgtatttagccagtgttaatatggatgactttccagctacaacttcttggcttctcagccatatataattggctatctcctttgtctttaatatttgcctcccacatctctaaacttctgtggtaccgttttcttttgcttctgctccaatggatgtgagaactcttctgtattttaaaatgtttactttttcaccttttcattgattctctcaaaacctcagtccttaatcctcttgcccaaaagtatctcatccacagttatttcaacaatatacaactggtgtagaagaaacgaacttttatttccagctttaccacttgcataatttttagcccttattttcatctgattgcaaattgcaagagtttgtcattattcaaacatgatctcagtccccaaagatataaggaaaatattcactaataaactccctgcttgtaaaattagtccttacctgaacatcattttccaagtagcagcatctatctctatgaattactctacaaattcttagtatcttgctgattatataatatcataaatatcagataatacagtgaaaatataatgaaaatgattttaaagtaagatttttcaagggagattcaggatgtcatgatgcaagtgaatttggaaaactcctgaatcacaaaatcatggctaatgataatatgtcagagcagttaacaggtgaagtagaggacatttgacaatgtacttcaaaaggaaataactggaatatcaggcattcaagataaatgataaatgcctcacaaatctatgtaaaaattatctttaaggtcatgctgagaaagttaagtatactataaaagggatgatattttgctaccatatcattttgtcaagaaatataccaaaaaatcaacacaccttatccttattcttaattattagaatattataattttaatctatatttctccaaatcatatattaaattttaaaaataattttaagctctatattttaagatagcatctctgtcaaaccttctgccattgactttaaaattgatttatttaagtggttttttcatattttcatttgtcatcagatattaaggactttggatatgtctgtatatgtgtgtgtatacatacacacacacatacatctttctatctcagaaactaaatatggtaaaacttgcattttatctcacataggtatctttctaaggtaatcttcactttctcatgtaaagagaatgatcctgagtttattaaagagacatgaacaaacataaccaaccaatatttttgtgcaaaaagctttcatagatgaaaaataaatataggctattgcctgcgattttaaaatgttataattcatttggagatatatcttttaaccagttaaataagtgatttaagtcacaggcaacccaagcttagaatatgtgccataaggcagcctctgattaattactgggtgaattctcagactgcttttgccgtaggggcagcggaggtatagcagactgactcagagctgcttgggaagagcttgagcaaggaggtggggaaactcacagatacgaatcttctgtaaaatggaatgcaatactaactaagtgaataaatttactttgttacattgaaaactaaaattgttgcctgtgagagagattcatttcagaagttccataaatttaaggggatataaaaaagaagaaagaattacttaaatggcatttcttaaaggaatatgccaagtgatcttttcctttttattctcctcattagaatttttatggaattggagttattgacttaacattttaaagcctgcctcattatcataaaattgttctttatctttcaacaatattttagccattataaacagtggtaaaatcgtgattgctttaagctctcccttcgctctgggaacacactcttgaagtgggttacacctgtcatcagtcttagtcctcaaatggtgactgtaagggacccaaaagtagacacaccacttgaagaaaactcatctgtggaatcatgacatacaacctaaacctattttcatttagaaaccattttagatcaataatttttaaaggatttttttaaaaaatcttcctggcttgacaatttttactgtgtgaaattctccagataattttcttgtgtagggaatttaagctgtgatcataaaaataacttacatgcattgaggcacgagcacagttaaaaataaattcagtaaataatctgtatttttttaactccagagatgaagtaatcctagatcttaaagaaagccaaaatagtaattatcagtataaaaacatacattaaagctattcttgcttgtaaatcgctactctcagataatgatgaaatagtcattaatttgagaacactgaagtcctttgaaacctaaacatttattttctgttctaaaactgcagtccagtgtctctgaagatatatagggtcaatgaacctttcaggcataaaaagtaaaacttgtcaaagagcttcagctcttgttttaattacttcaagttttatccctaaagtaacctttgaaatctgcagggactttatttttttttcttactattaatcgtgaagagctattgctacattttcatgtgttcttgtttagaacatacatgtatccatctggctttttatgatttccaagcagacagggtggaagtttgttgtaataatccatgctgtgtgaagcagcattgcgagctgcctcagcaacacagaccaggtaccaagtcctggtacttccaacactgaggcaggctaacttcacagtctacacaagaatacttggaatatattactcacaacaaacttctaaaccacgtgatccatattctccatgttcacctgttttgctcttcaagaggagagaatttgattgggtgggaattattcttttgtccagagctagcatctattgtcctcatgaccaactcatgtatagatagcttgctttgtctcccatatcagtccctgctccaatcagctttggtcaggatttaagaagatttcgcacaagccatggcaatttaggcagaaaataaccatgtggcactatgttttttaagggcccaatgatccctatgaaaattcattttagcatgtcttatatggttgcttaataagtttattatagattgaaatcttaattctaaattctttgagtcctgggacattgtcctgttaatctttctttactttcataatctacagtgcccaagaaagtattttttaaatttttgttgttgaatatatggctctgtctttactctcagcataatagacaaaccatcttctagcatatggaagcatttctactttgcaaattattctgaagcgggtatgatttgcaaaatactgtcaaattaaatatgcatttccatatgcttctatgaagaccaaatatatccatgaaaactagctacagacaactttaaaatccttcatgaatttttaatcaacattgatgaacaaaattcaagtcgttctttctaaagtcctaaatctagaaaactttctgttcttggacttggagcatcggtattaactcaaaggattattttaccaatatttcaaaataataagatatttcagaaaagtatattcagaaaatgttcaaaggcttttttgttactaatagtctcatgccaaaaaacatattgacttagctcttataagaacaacatattctgaaactttagaaaacaatttttattaactaaaatttatcatttctggaagtgcttttttatgactatgcttatcatactgttagcttactggacatattagaacaagcctcttacagagtaagatttgaagaggtaattgaatatgtaacagaaccaagtgaagcactaatatttacagatgggtgggcaaatgagaagaaaaaaatgaaactgaattttatgatacatcctaaaactactttctaaaatagcattaagtcagctaacttcgaacaaagcagaacaattgtgattagatgaatattttattaaactaggaattgatagagatctttttaaactaagagtatgttagcaatattgtacctgtttaatggcatggcatgccatgccaagccttctaatgggcatgcttggggaccagttgctggcatcaaggggtgaatgtacagtttatgagctgaagcaatctactttctcagttttcaacactttttctttgtcattagtacctttgaatctgcttttgtcacttagccatacttttgtttttcctaccgctatgctgattaccaactgcctggatttagactctgtttgctccttctctcattgttttttgttttgtgttgttttgcccacttgttttgatgcatatctactgttttgtctgattgtcattttataggcactagttcggtgttctctatatgtgcctgaactactcttatttctgaactcaaatatctgcttgcactgtaccaaacgtgtctctgtttcctaagcctttcttctcactacacatggtagtctagcaacattaatgccctaccgtgggaatatggctgaagatcttgactaggggacttatgaacccatgcagccgtgcccaaatcctaccaaactgaccttactttcttgaagacagaattgtagtatggtcgagctcatgctttttgtagtaggccatccaaattcgattgactggctaaaaaagattgttagtggaggctggaagaaacattttggctgatgatagatgaatagagcttggaacaatcaaaaggaaaagcagaaagtctatacctattcataagaaaaagttagtatgtttaccgaacattatgaaagaattatgacattttcaaagttttaaaattttattttgtagggacggggtctcattgtgttgcccacgctggtctgtttcttgaggatttactatagactgggctgtattcaaagcattggggatacaggcatgaatgagcccccattgtcctgaacttaccattcagtctgggcagtgaaagaagagggatgttgggagaaccttacaaagatgaaatgtaagctaactggagaaatcccctaactttcagtcagactgaaagggaacaggcagtaactgtgggtagccctcttgggcagggtgattttccacatgtgccagtcaggggccagaacattaagatccttatgttccaactaaggaattttgattttattttaaagacaaaggggagccactgactgttcatgaggaacaagattacaaattcaggtctcttcacctctcattaagtcttggtttgcctgtggaaaaaataaatagaccccagtgatctctggaagattctcttccagctttcgaatgctgtcattctcaagtgataaaaatgaagcatcacaattgagtgaactgctggtagtgatagctcagaaactaaaaccagcttgatggaaatctgagcatcaccggctatatcaataacttcagtgaccctcctttccactcctttctgtaataagtgcatgcagtaaagtacagccagttcagacaacttgataacaaatttgctataacattcttatctttttccttttctcaagtatgaatgagtactatgtatatatttcttaaacttcagttgctaaagtttttactgtgaatattaagactatatcaaagttatttaaatggataaatttccaattgttctctaaacaaaacaagatttgtggaagttttgactctatgaaccctgattatttaatgaggaaaataagtaacatacttcagattaggttatagaggatgctaggatgacagacattctaacttatcccaagttgttattacagactttgtttatttttagaataaacaatcatgctgtacccagcatgttccatgtttttgcaatgctatgacaatttgtctgatcagcacattttttaaagccaagaaaacagtaagacaattatatttcattttaagttatagcctttaggaagagagagaagaggaaaagaatgttcgcattcctgaacacaaacttaaattattaaatgtatggtaataagttgccaaattaaagaaacttatgacagcagtcttctatgaaaatgtatgttcttaagaaagattgtgaactatttttattatattttgatttggtgccaaaggggaaattgttctttaacataagctaagaaacagatgtttgttgtttagtttttgtgaggttgaggtgagagataaggggtttaaaggataagttaatgaatgacatatttaggaattcatattgagcattttgctattaaagacttgctgaagagatcaaggagagtttggatatttcatttcataactcctcacatccgaaatcatattcactagatccccagtggctttctcttactgaatctgagtatcatgcttcaaagatgtctttatgataagcgatgctttccatttgataacatttatttgaaactacttttttggaatttatgatgttcaaagaacacacagcatattaatatgtctgcttttattatttactggatctcttccaacacgttacttctctcaaattctgtttatatctccattcttagtaaattaattccctttttgatttttaatttttgatgagaaaacatttgaatttctagtccaagcacaaggagattgtatcttaattgttattgttgacatttagtttttaggaatgatttatgagcccattgtgataatagctacttataaactaattcagtggtttttaattttacttcattagctttcaaatatttgctttttaagaatccaagatttcattacgattgcatttcttttgtgtttggattttacctttcctacattccaagtgatggatcttaaaatgaatttaacttcctcctagattctgtgcaatgtatttcgtgtttaaatgttgttttgaaataatcatttctttatttgctttttaaaaggttttaaacagcgcttatttctgtttgtaaagacttgaacttgtaacagatgagtgatatgcttactcaagttcactaaatcaagtgtctaggatcatgcattttgaagaaaggcaactccttatagagattctaaaagaatagagaaggtcaaaagaacatttgtttgagggagtggacattgtatatactaaaaagaatagcttctgtgaccaggcgcagaggctcatacctgtaatctgacactttgggaggttgaggagggcagatcacaaggtcaggagattgagaccatcctggccaacacagtgaaatcccaactctactaaaaatacaaaaaagttagctgggtgtagtggtgcatgcctataatcccagctactcgggaggctgaggcacaagaatcacttgaacctgggaggctgaggttgcagtgagcagagatcacgtcactgcactccagcctggcaacagactgagactccgtctcaaaaaaaaaaaaaaaaaaaaaaaggaatagcagctctgccatcttagcctattctagtctatcctagcctagcattctgccagccccaaacccggaagtagtctggagaacattgcttttattaaatcactggttcatttttaaaaacctgctcccgatggttttgcattttctttgaatatcctgggtcatgatggtctatatctacatttggactttaacaataaataactgtggaatcttagactatttatcaagaattttagagccttcatttcctcctttgtattataatgtggataatgatagtataattcataggattattttaaaaattaagtgattgctttgaatggtgtctggcttataataaaatctcaattaacatttctttttgttggtctcaatattattaaaacaactaaaagaacctaagtggaagaaaaatcacacatgctctaagttaaacttgtttgattatttttataagaccttagctgagtgtttgaggagtcatcaatcacctagggtcaagttgtgagctagcaattggaagataatatgggaaacaggctctctaatattgttttactaaatgtaattattttttattttcttatttaaattagtaatgtttttcaaaactttagctaaccatgtatcagtatgggctgttacattaaaaatgtaatatcattgatgttgttcgtcatgaaaatattcagaatagcctgaaaaatgtcatacatcatagaagagagccaacatgtctttatttcacaaggggtatgggtaaaaataaattttaataagacagaaatctcatcttcttgttatagtaatccacttaaatgattaaatttcttttatcaaatgattaaatttctttatcaaatgaacatgtagagcattcatcttaccaagttgcaattttttccagaggagataacatttagaatttcattaagattgaagatcaaaaccaccaattattaaaataacaaggtaattattaatactctatatccaaataaagacataaaggaagaaaaacatcatatgaaaaattagtgacagtccgaaataattagctaccaatggccccaggactttatagcacatataatacgaaatattccctcccctacttttctgttgctacatggcagaaaactatgtgagtctgtatttatgactggttgaattgttttgatgaatattttatttaagtaattgctatgaccactgaattcaatgatatcactgttacatcgagatattaatctttatgccatgttttacagaaaattgtattattttccacatccagagtactctgactccctttactactcattgttagagaattataatataaataaactctataaagagcaactattttctttattctattgatcttactcttattgaggtcaaaatagaatacagagacaaatctctaaatttaacattttatttgtgaatcacagaattgcaatttggggcacacatacagatcaggcagtcatcagcatgtctaaagaacaaagaaaatgttggggtatttattttaaagaaatgttacatatccttttgaaagaaatctctctggcactagaaaagcttttggaagctggcatatctctaactggtgagtgacagtggtaggtaaaactagtcttagttatagcaggtatttcagcagatactaagtgaaactgggcttcgggttacagcaggtagtttcagcagctgggcttgtggagaagtcaattcttggagcagtgctatgtgccctgggtgctttttttcctctggcctttagactttgatttaggtgagtatgacaagaatgacccaatttgtataatcagcattcaccctcttctccccttgtaattgcttcaatattcatgtcgataaaactgaaacatcttatcttgagtctctggtttcatatccttcagtgtttcaatccacttattgcctcactcatgatgggatatgtcagcactttgtcttccttaagtactgactatgaaaatatcagacacctagctttgactctattttccttctcttcattctttctatctcactttgtcccctggattgttacttcttggtgtggagtcacagatcctatctaggcaagagggagtgagttagacaaaggcatgaacactaggagggcactttaagagtctgcctaccacaattccattgaatatacttaattaccccctaccccagccatcctcacacccaatagactttaaactattggacagggatggtgggcagagacaatgcctgttttgtcttatgctgtctctctcgggcttctagcaaattgtctcattaactatttttggattattaataagtgaaacataagaaaactctaataagcctccaaaaagaaggataatttaatcaggagcataaacaatagatatagagcccttagtaacaagtatcaactgtagagttgttaaaccattttgctttactcagccctacttttcacctctgctcttccattcagtttccagggaccgagcatctcagcttctgctttcctgctggcttgttaagatactcagttttactccctccttcaactttgttctggttatgctatcttgatcacagcttcttgcttgtggtcagtgttcctgattatttattgagcaggacattggcttaactagctgtgcccctttggatgagtcactcaaccactttaagccatacttttctcaaatctaaaatggtagaaagaatatctacctcaaagtggtgttgtaaaaatttaagtgagaatacaggaaatgactatgcccatttcccagcaaacatgtcttagtttctatccatttttccttagcagctagatgtgcagaagctttgctaaactattccttttgaacaggatttcttattggcacaggagccaataatttgattcgccaggccattcttaaatgttctatgggattttatagcttccatacaggggtaatagatccacaggtaatggggatggggaaagacaatggatggcaaacaattagaatcttcggtggagctggttcaaggtccagatgctctctttgtgtcctttgtacaaagctggcggaaatatataatttcttaagtgaataaatgcaaaaaagagatattagcatgaaataatgagataggcaacttggaaattctttctttgtaaacaatcatattgtacttatactttttcagatataaagcacttttgtaacttcagtaaataaaacattaataaaaccccaatgtcttgaccacagttacggaatcagttctgagttcttttttcctaagaacacattttactcttcgtgtagtcccttgtttctttcatatttgggttatgaaaatgtcatcactattttcaagcacaagttattatttcctcctgtgatactgtttgaacgctaggtctttgatgtttctgtcagatatacccagcaatcatcatcataactcatactcttgaatttttaatatcactccacacacagaagtgtcaagtacccagttctttagtgaatgcacaaaaaatgaaagaaaagtttgttaaataagaagaaagattgaaatactgaaatattcctcctgatttttgttttgatcccattgaaaataaatgggaaatacatgttgctatttttttcattgctctgtctcacagccactgtttgcatcagatttttaaaaaagaaaatgccaagcagtacattttgaatcagtttccacagaaagcattatgtgcataaaatttcatatattatctttgatatgtaaatataggagaaataagtttctttggtaaattttagcatttcttcttttcaaaaaataaaacataaaataatagtcaatggccctatggttgtaaactatggtgaatgcatctgattcatttatgctagaactccttccttatttcctcctttttatgcaaacattatcttaccagccttaatgggggagtcacaataagttcccctcagtactcagcacagggccatccatgcttgcggaaagaatgggctttgaatatacatcatgataaacattagtacattaaataagcaattactttctaagatgattttgtttttctacacaatttaactcattaatatagctcagttatctgttcaaattaacttaagatagctgtccaatcctgattctgatatttaatacaaaaacacttctttacagctggggggggtggctcacacctataatcccagcactttgggagaccaaggcaggggaatcacctgaggtcaggagtttaaggccagcctggccaagatggtgaaaccccgtctctactaacaatacaaaaaatcataataataaaataaaatagccaggtgtggtggcgggcacctataatccccgctattcaggaggctgaggcagataattgcttgaacccaggaggcagagatttcagtgagctgagatcacgccactgcactccagcctgggtggcagagtgagactctgtctgaaaacaaacaaacaaacaaacaaaaaacacttctttacaagactttggtattcatacttcaaaattttgtcattaattttgcttgtctacagaaatttgattttttttttctgtaaaccagatgatatgggttaggttagggtctaactggaatatgaaggaaggagtagataacaaggccattttgaagaataaacaacaaaattaataactgataagactcaaagagaagagggaaataacctaatggtgtccaattcaggtgtctaaaactacctaacagaaagagtggagctgatgaataaatataaagaaaaacatgaatgctgtgtttgacatattgtgttttgggcagaggcagaactagagaatagggcttctgacttctaatcgaagacattctcctattacttgattaagatcttccatgaacaaacatcactttcatttactttaaacttccagaagacagattacttaatatgcctatcattttgactaattcatgaaaatgtaacaaattcattagatgataggcttctacatttccttccccatgcattaattttcaactgtaaggtttaagatgaataccagatatattcaagtagggagggaatctgactaatgtttacaataagcttaccttgacaggcactgtgctagaaacttcacactttgtttaaccataggcctatgaagttatagatgaataaactggtgcccagctctctactggtagaaagttgtgggattgagattcaagtctcaggtccagtaaaatcttccttgtcagctctcaacatggatagttctaaatgtgttgaagctgctagaggaaataaaaaataaaggcagcctggaatggttgctcacacctgtattcccagcactttgggaagccgaggtcagtggatcacttgaggtcaggtggttgagaccagcctggccaacatgaagaaaacctgtctctactaaaaatacaagaattagctgcgtgtggtggtgtgcgccaccactcgggaggctgaggcaggagaatcactttaaccagggaggcggaggttgcagtgagccaagatggcaccactgcactccagcctgagtgacagagcaagactctgtctcaaaaataaaaataaaggcaatattcatttttcctcccgagcatacaatactatctttactatcaccaatgtttcctaaattctagttaaactaggtactactaacttaagcacttagagtgatgaaatcatatctcattaggtgtcacctggagggaagttaatctgccatcaccagtatctaacccccctctactaacggggtcactagtattattttcattggttgggtgccatctgatccaatgcatcaccaatcaaatcacctcaaggctaacataaattgtgttttctctaaataaaaaccaacaaaaatatcttgccctagcttaagctaagagtgaggcttcctgataagtaggtcatccagactctagggatatgttttccccatgttggacggaaagatctaccctgtagtggagatgtgaggtatttgacaagtgtaatagatgattcaagtctgatactagcaaattcattaatactatgatgagactgcagtcacagatggagagatcaatccttcccccaggcactgtctaacactgctttaaagggtagaaagcgaaaatgacctacctggttgtgtctaaagtttgcttagggcagtcacatttcactttaagaagtacctgtagagctctcatataccaggttccatgttaggacctaggcatgcaaagagaaacagaacaaggccctgctcataagagtttccagcgacctagagaaactggaaagaaaatagtctggccctttttgtcaataagtcacgtgcatctataataggagtgagaacttgacgaaaaaataagaagaaaggctcagtcatatgtcagtaaatttcccgggaaagcagaagtatacaaagttgtatgtttgcaatagtataaatatatatagcataaaatagtataaatatacaaaccttgtatatttgaatagtacattatttcccaagtatttttgttatgattaccaaagagaaaaaacctggaactatttaggttggtgcaaaagtaattgtggtttttgccatggaaagtaatgacaaaaaccacaattactttcgcaccaacatgtaatatttctgggtagagaatgatagattattggtttacaaagaccagtctgaatagaaaaggatggaaagcaaggtaaagtttgctgcagtctaaagctacaagtacacattgcttcagttcatgctgtgttccgacaatccatggaagtcctcagaacccaaatcactgaagctgtaagtagagtctagaatactaatggctctgggaggaaatatccaaagtcactgctgattcagctagagaaaatacactggagggaggagccaagatggccgaataggaacagctccggtctacagctcccagcatgagcaacgcagaagacgggtgatttctgcatttccatctgaggtaccgggttcatctcactagggagtgccagacagtgggcgcaggccagtgggtgcacgcaccgtgcgcgagccgaaacagggcgaggcattgcctcacctgggaagcgcaaggggtcagggagttccctttccgagtcaaagaaaggggtgacggacgcacctggaaaatcgggtcactcccacccgaatactgcgcttttctgattgacttaaaaaacggcgcaccacgagattatatcccacacctggctcggagggtcctacgcccatggaatctcgctgattgctagcacagcagtctgagatcaaactgcaaggtggcagcgaggctgggggagggcgcccgccattgcccaggcttgattaggtaaacaaagcagccaggaagctcaaactggtggagcccaccacagctcaaggagcctgcctgcctctgtaggctccacctctgggggcagggcacagacaaacaaaaagacagcagtaacctctgcagacttaaatgtccctgtctgacagctttgaagagagcagtggctctcccagcacgcagctggagatctgagaactggcagactgcctcctcaagtgggttcctgacccctgacccccgagcagcctaactgggaggcaccccccagcaggagcacactgacacctcacacggcagggtattccaacagaccctgcagctgagggtcctgtctgttagaaggaaaactaacaagcagaaaggacatccacaccaaaaacccatctgtacatcaccatcatcaaagaccaaaagtagataaaaccacaaagatggggaaaaaacagaacagaaaaactggaaactctaaaacgcagagcgtctctcctcctccaaaggaacgcagttcttcaccagcaacggaacaaagctggatggagaatgactttgacgagctgagagaagaaggcttcagacgatcaaattactctgagctatgggaggacattcaaaccaaaggcaaagaagttgaaaacttcgaaaaaaatttagaagaatgtataactagaataaccaatacagagaagtgcttaaaggagctgatggagctgaaaaccaaggctcgagaactacatgaagaatgcagaagcctcaggaaccggtgcgatcaactggaagaaagggtatcagcgatggaagatgaaatgaatgaaatgaaatgagaagggaagtttagagaaaaacgaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccgtcaaagggaagcccatcagactaacagcggatctctcggcagaaaccctacaagccagaagagagtgggggccaatattcaacattcttaaagaaaacaattttcaacccagaatttcatacccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcaagactaggaagaaactgcatcaactaacgtgcaaaatcaccagctaacatcataatgacaggatcaaattcacacataacaatattaactttaaatgtaaatggactaaattctccaattaaaagacacagactggcaaattggataaagagtcaagacccatcagtgtgctgtattcaggaagcccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagggacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaacccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacatattcaaaagctagcagaaggcaagaaataactaaaatcagagcagaactgaaggaaatagagacacaaaaaacccttcaaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacagatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcttcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgccgaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccactcctattcaacttagtgttggaagttctggccagggcagttaggcaagagaaggaaataaagggtacccaattaggaaaagaggaagtcaaattgtccctgtttgcagatgacatgattctatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctactaatgactttcttcacagaattggaaaaaactactttaaagttcatatggaaccaaaaaagagcctgcatcaccaagtcaatcctaagccaaaagaacaaagctggaggcatcacactacctgacttcaaactatactacaagcctacagtaaccaaaacagcatggtactggtaccaaaacagagatatagatcaatggaacagaacagagccctcataaataatgccgcatacctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagatttaaacgttagacctaaaaccataaaaaccctagaagaaaacctaggcatggccattcaggacataggcatgggcaaggacttcatgtgcaaaacaccaaaagcaatggcaaccaaagccaaaattgacaaatgggatctaattaaactaaagagcttctgcacagccaaagaaactaccatcagagtgaacaggcaacctacaaaatgggagacaatttttgcaacctactcatctgacaaagggctaacatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaacaggaacacttttacactgttggtgggactgtaaactagttcatccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagcgcaccagcatggcacatgtatacatatgtaactaacctgcacaatgtgcacatataccctaaaacttaaagtataataaaaaaaaaaaaaaaagaaaatacactggttgtccccaaagcggagggtgtccccaagttggaggttctccaaaatacaaaatgtttcctgcgacaaaggagaacagaagaaagcagctatctcagaaggggctctggaccaggcacgatgactcacgcctgtaatcccagcactttgggaggccgaggcgggtggatcacctgaggtcaggagttcgagagcagcctggccagtatgacatagctccatctctactaaaaatacaaaaagttagctgggcctagtggtgcatgcctgtaatcccagctactcgggaggctgaggcaggagaatggcttgaacccaggaaatggaggttgcagtgagccaagatcatgccactgcactccagcctggatgacatagcatgactccatctccaaaaaacaaaaaaaaaaaaaaagaaagaaagaaaaagggactatggagtacaaaggcccatgtgtcatttcccataatatttttcatatttttgttttattttttactgtgtatatttaaggtctataacatgatgtatgggatacatagaagcagtaaaaggtcgctgtagtgaagcagattaagatatccaccttcatgcagttacccattttttttctagcaagaacagggaaaatctactcacttagcttgaatcccaaatataatacaattgtactacccatagtcctcatgctgtacattggagttctggacttgttcatcctgcatatctgctactttgtgtcctctgacctacctgtctgcattttcttccctcacacctgtctttggtaaccactcttttgttctctatctctgtatatttgaattttttttagatttcatacataagtgagatcatgcaatttttccatgtctggcttttttctttctttttttcttattaattttttagagacaaagtctcactatgttgtccaggctggagtgtgatggctattcataggtgctatcacagcacactgcagccttaaactcccaggctcaagtgatcctcccacctcagcctcccacgtagctgggactacaagtgtgtaccaccacacctggctctggcttattttacttagcataaggtactccaggctcatccatgttgtggtaaatggcaagaccttattattttttagggctaaataatatttctctctctctctccctgtctctctctgtttctctgtctctttctctgtgtgtgtgtgtgtgtgtgtgtgtgtgtgtgtgtgtgtccatcatattttcttttccactcatctgttgatggacacttaggttgatcccaaatcttcacaattttttgaatatgctgcagtgaacaaaggagtgcagatatctttacaaggtgctgatttcatttcctttgggtatatgtccagagaaggaattgctaggtcttatggtagctctatttttaatttctagaaatttgatagttttaaagaaaagttgcatatatgaatgttatcaggtcttgaatttaaatgagcaaataattttattttctttgtttttgtctatctgaatttaattctatcctgaacccacatctgtttcttgaaggaaatttggtcttgtaacttctaggtaagcttagtgacttttgttgtttttctcagtaaatttggagtttaagttctgttggttcagcattcttttcctttcctccacagaatgacattgcaaaggtagatgatatacagaacactcaggcataggtaagggagaggcttcggacccacagccatctcctggagtacattgagatgtgcttgtacccttttggtcaactgctctcattaccattacattctccaagatgtgtatgaaactgaaatggcctcatgccttttatcccaaccatcccaaagctccattggagacttggggtctgtcagtcacttctatacctatccctgggggagcaggaatttcaaaatagtctcttgcgtctttagaggatatagtatgaacctgggttttaaatggaggtgctatcacacacaggtccattctcctaacattcctacacaaagattatggcaccaatttggggcatgaagaaattctttacaaacctttggactgccccttagggctgagggaacatggctcaggccatttccatcatcagatcttctcaaacatatgtggagttcccactgacctctcaaccctcccagcctcatcccttggattttatctagtggtatggagtacaacctggctaagtattgggaacctgaatcaggtatgaatctcatccttttctgaggcttctccttccccagcaggagcaaatttggtttaattaatgggttagatccattgtttcttcagttttcttttatatgtgctgtttctggcataaattttatgctgggctatatgtaacacatgatttgagatcaaacatgtctactgcaaatcaaaagtcttggcttttagagagaattgtctctgctataagtttcagaagtttgttttggaactcaaagctaaaaattagaatttttgttctatatgcaccgtttggtgttctccacttaacaaatgatcctgaagcaataaaatgtattgattcactgtggagaagaagaaagttacgggagaccatttataaatgatgagcaaaattcttaatacatttaaagttttatcacctcaaacattttccaaacaataggatatgagtagttgtctctgaatccatacagttttcaaatcagaggaatgacaacatgagatttaatataacatagaaaaacagggacagatttaaaactcatcaggtgtttgtttatttgttttttgggttcgtttagagacagggtctggctccgtcacccaggccggagtgcagtggcgtgatcatagatcactgtaatcttgagttcctggactcaagtgattcttccaccctagtctcccaagtaggtgggactaaaggtgtgtgccaccatgccttgctatttttttgttttttaagagacagatcttcctatgttgtggaggccagtctcaaactcctgccttcaagcaatcctcctgtcttggcctctcaattgatgataagttttctaatcagatttagtgcttttctggaaaaatcattagacaacaattctgaagctaaatattaagtgtgtgcctaaaaatttagcaaacttaatggaagaggtcctcagaactcttttaagatcaaacagttcaatactaaaagtaaaaatttgaatggaaaaagagggtgtggggaaaccaaattacctatcctgtatgcatattggaggtggaatgaacagaccaggggcatcatgcaaaattctcaggcgccaagtagagtgaataagtgtgtggtaattattcacagtgtcaatgcatacaactgaaaataggatcagtacttaaatgctggatataatatattatcaggtcaagactcatgacctgataaagaccatctgtatgtccttaaatgtccttaaatgctagatgtaagcttggatatttgtttatgtttatgtgaatgacattccttctttcttcctgggtttttgtccctcttttattttgttctgtttatggagatgaagttctgcattagataggatcagtgaaatataaacatagatttgtgagcgtataaatgagactacccaaaacatttcccctcaaattaagactttatattttgagacacactggaatcagtgacgtcagtttggaagctcagattttcctagcaacaaatagtgtggcttagacagaacgtcagtttcaacagtgaaattcattgataggttctttgaatttaactcagtggctcaagttcagtttggagtaatgccggaggcatgtctttgccctaagaatagtctatttcctcacacctgaaacatattcttatctcctttcctttttttctccagactgttcaaaatctgtcctttagctgcaagtctaaacaacaaccaattctagaatatagttttctctaaacgttcattctgttgaaatattttagcgagttaacacttaaaataaaacttgctctgaggctttgaaaagtgaaagtggacgtctgtacagataaagtatcaagtttattactatcatgtaaaattttacagtcagtgattatttcctttggaataagatttatgtacttcacctctgaggcaagacctcatattcagctgtatttcaaattctgtttttcacatagatgcacatttcaatatgttaatatgtaatttaggaaacaatttggttgtctctaataggattataaaattctctctttcatgtacacaatgcaggttgagaattttctcagtggacatgaatttttttaaatcattaccagaaaagtctcaagtactttatgcctgtcttctaaatcaattcttaataattttccaagtgaaaatccattatgattagcttgacatctcatacaaacaactgtgtcaaaatttttttctcccagtttacccccactgatgtagttcagttatatgaactgctgtttatattagatttgagaagggttctgacttgtgttctaaccataccaaaaagaaaattagaactttttataattatgactttatggtttagttccagtttgtttatttcttattttttatttttataacttcaccttttattttagattcagagggtacctatgcaggcttattacctgggtatattgtgtgatgctgaggtttggggtcctactgatcccatcacctaggtactgagcacagtaccagtagtttttcaattctcaatcccctccctctctcctcgctttagtagtccgcagtgtctgttgttaccatccttatgtccacgttcccatctttatgtccatgtttagttcctacttatcagtgagaacctgcgatatttggttttctgttgctgcattaatttgcttaggataatggcttctagttgcatccatgttgctgaaaaggacacgctttcattccttattatgactgtatagtattccattgtgtatatgtaccatatttgttttatccaacccacctcggctgattccacgtctgtgctattgtgagtagctgcaatgaacatacaagtgcgtgtgtctttttggtaaaataatttattttattttggatatgtacccaataatgagattgctgggttgaatggtatttgtaaattctttgagaaatatccaaactgctttccacatagctgaaaaaaattacattcccaccaacagcgtataactgttctcttttctccacaggctcaccgacattggttgttttttgaccttttctctctcttttttcttttttcttttttttttttttttttgagatggagtttcagtcttgttgcccaggatggagcgcaatggtgcaatctcagctcactgcaatctccgcctcctgggttcaagtgattcccctgcctcagcctccttagctgggattacaggcatgcaccatcacgcccagctaattttgtatttttagtagagacatggtttcaccatgttggccaggctggtttcaaactcctgacctcaggtgatccacctgacttggcctcccaaagtgctgggattacaggtgtgagccataatgcccggccatttttttaaccttttcatagtagccatcctgactggtgtgaggtggtgtatcattgtgggtttgatttgcatctttctgagtgatgttgagcatttttcatatgtttgttgaccaattgtatgtcttcttttgagaagcatctgttcatgtattttgcccatattttagtgggcaaaatatttagttcaattgcttaagttcaattcttttgagaagcatctgttcatgtattttgcccatattttagtgggcaaaatatttagttcaattgcttaagttccctatagattctggatattagaactttgtcagatgcatagtttgtaaatatttcctcccattctataggttgtatgtttactctgttgatagtttcttttgcagtgaagaagctctttagtttaattaggtctcacttgtctatttttgtttttctcacaattgcttttgaggactcagtcataaattctttgccaaagctgatatccagaatggtatttcctaggttttcttctaagacttttatagttttaggtattatatttaagcttttaatccatctcgagttaatttttctatatggtaaaaggtaggggtccagttttattcttctgcatattgacagccagttatcccaacaccatttattgagtagggagtccttttccgattgcttgttttgtctactttgtcaaagatcagatggctgttatgcagctttatttctggattctctgtcctgtcccattggtctatgtgtctgtttttgtaccagtatcatgccattttgattactgtagccttagagtatagtttgaagtcaagtcatgtgatgccaccagctttgttatttctgcttaggattgctttgtctatttgggctcttttttggttctctctatattttagaatagttttttctagttctgtgaaaaaataatgttggtagcttgatataggaatggtgttgaatctgtagattgctttgaacggtatagtcattttagcaatattgattccatgagcaaggaatgtttttccatttgtgtcatctctgatttcttttggcagagttttgtagttctccttgtaaagatcattcacttcttggttagatgtattcctaggtattttatttatttatttatttccagctactgtaaatgggattgtattattgattttgttctcagcttgattgttattgatgtatagaagtgctactgatttttttacattgattttgtggcctgaaactttattgaaattgtttatcagtttcagggcccttttgaaagattatttagggtgttctggatatagaagtgtatcatcagttaagagagataatttaacttcttcttttcctgtctgaatgatttttatttatttctcttgcctgattgctctgtctaggactttcagtaatatgttcaacagcagtggttaaagtgggcatccttgtattgttcctaccttagaaaaaaggctttcaatttttcgctgttcaatttgatgtaagctgtgggtttgtcatctatggcctttatgttattggggtgtatttcttctataaccaatttgttgagaatatttattatgaaggtatgttgaattttattaagtgccttttcagcacgtattgaaattatcataaggtttttgtcctagattgtgttcatgtgattatgacatttactgatttgtgtatgttgatggctcaagcatgttggatgcaacatcctttcatccctgggataaatgctacttgatcatggtgaataatctttttaatgtgttgtttgaattgagtttctagtattttgttaaggattttagcaactgtgttcatcagggatattgcccagtagttttctttttctgttgctatgtccttgtctgctattggtatcagggtaatgctggcctcatggaatgagtttgaaagtattccctcctcttaaatatttgaaatagtttgagtagaattggtattagttcttctttaagtgtttggtagaatttattagtgaatccatcacgtctttggattttctttaatgggaggctttttattattgcttcaatcttcttactgtttcttcatagttcaaccctggtagatcatgtgcatccaggaatttattaatttcttctaggtttttcaacttgttgcatatagctgtttatatagtctgtaattatcctttgtatttctgtggtatcagttgtaatattcccttttcagtttgtgtttttatttatttgggtcttcttttttcttagtctggctaaaagtttgccaattttgtttatctttaaaaaaaccacagcatttagttttgttgatcttttatatttgttttattctcaattttatttatttctattctgatctttattctatccttccttctactaattttgagtttggtttgttcttgcttttctagttccttgaggtgcatcattaggttttttgtttgaaatctttctactttctacttttttgatgtaggcatttattgccataaactttcctcttgcactgattttgctgtatcccataggttcaggtgtgctatgttttaattttcatttgattcaagaaatttttaaatttccttcttacattcttcattgactcactggttgttcaggagcatgttgcttaatttccatgtatttgtacagtttccaaagttccttttgtaactcatttctagttttattcccttatgatcagaaaagatacttgatatgactgcaacattttaaaagttgttgagaattgtttgtggcctaacatatggtctatcctggcaaatgttctaagtgctgatgagaaatatgtgtatgctaaagtagttgaatgaaatattctgtaagtgtctgttaggtccatttggtagactatagtttaactttgatatttctttgttgattttctgtgtagacaatttataggttcctttcgatcttggactgttactaaaaagatgcactgagtataattatacataatttacttcatacttattcaaatacttttggagattaaatttccagaaatgaatttcgtaggtcaatggtgtttatctttataactttggtagctattgctcatttattttcacagaggtgcatcacattatactctcaaagtaatacatgggagttagcccttacccacagtcacaccaatagagtacataatcagacttttgtatttttgtcaatctgagaggtgaacaatggtatcgcaatgtagttttaatttgtatttatattattagtaactggagagattttctttttaacttttaagaactacttgtttttcttttctgtaaaaggtctattcgtatcctttggccatttttcttagatttttatttttgccttattgatctatatgtactcttgtactagaaagattaaccctttttaatatgagctgcagaggatttttaaaaaatatattgttgtttgataggactttctcttctgattcattggtctatagagttgatcctgagtttctctagctttattaatataatgagttatatattgttttttagagatttcttaatattatttgttttcccaaatgacattagaatcagcttttcttcttcccaaataaaaatctatttttactggtgtgttaggcttttctcacattgctataaagaaatacctggtactgggtgatttacaaagaaaagaggttcaattggctcgtggttctgcaggttgtacaggaagcatggtgctggaatctgcttggcttttgtagaagtgtcgggaaacttacaatcatggcaggaggcaaatggggggcaggcacctcacgtggcaggagcaagagagagcaaggaatgagatgctacacgcttttaaacgaccagaaatcacaagaactcacacactattgcaaggacagtaccaagagggatggtgctaaactattcatgagaaatccatccccatggtccaatcaacttccaccaggccccaccttcgacattgggaattacatttcaatatgagatttgggcagggacacaatccacattatatcaactgagatcatattaaatttgtgcatcaatttaaggataattgacattttcttaatattgaatattgttcaagtatttttattgttcaggaatgcaggtcttgaacacttttttggtaatatatctgtttgttgcaatttagatttcagatatttatttcttatattaattttccaccagactaccatactaaagtatctgaatatttgtatcaaataaaaaaattatgtaacttgaaagtacagtagtaataatttacatcttctttcctatttttatatctgccaaatcttggtattaacgaaaattacttcggtgttgctaaatcagagtttgactttcaggctgaggttgctgtatttcattacattaagtatctttctactattgttttctttagattttttaaaacttaagaataagaatgtcgtaaatgtctttacagggtttaaggagataatcttatttttcctttagctttattaataaaatgaattgtatattcataaatttgctagtatagacccatttttgctctatgtgaaccctactgttcataatgtgttgtttaatatgctgttagaatctgtttgcagtattttatgatgtttgtattaatatttttaagactgaatatgtatgcaatcctaacctagtttaatattaatattataatagcatcacaaaaaatgataatatctcccatacctcttttttgatttggtttttgttttctatgcactgagctagtttaaatagcattggaattatctactaaaaagtattgatagaatttccccatgagattaccttcttttgtgagttttagatgtttaagtcttttctctatttctcctattaaaatctattagtttccattttgttccttgctgggattaggatgaataagtaatattctcccaaaaaattattcaattaatctagatttgtcaatttaagcaatgtctcttttatgatgtgcttatttttccctattttgtgaatatccttctgcatatgtttttcttttcatagctttaccttcttatgttttcttgatcaattggtattcctctccctcaccacaacaaacttgacttatgtatcagtgtaactgtcattttatgttttctaactattaatttcagcttttttctttgttaattgcataccgctgctttattttagatttgtttcatgtacttttataacactttttagtcttattattgatttatttgttttctttctaattttaaaattgatctacagtttaaagctatgaattgttctctctgcactgttttggcaatttcccaaaagtcttgatctggagcttttaaaaatcattcttataaaggaaattttaccaattcagtatgtatttctctttatcctaaaagtaatttcagatcaatttactttaaacttgccaggtaattgagtcttttcattttctgagttttttattgattgttagtcttattggattatactcagataccatggtcagcaatatatactttttggagatattaaagattttgtatagttatagtcaacattttatgagcatttcttttgaaagctataatctttatttcaagtcacagcgttaaacatttatgttagatttaccatcttaattgatatatttgtccccttgatctgtcatggacttaggttaataaaacttctgccacaggatatttctctctccttatagtctctgtaatgtttgctttatgagtgttggtgtggtattgtgttatgaacagcaattcataactgttttatctttactgtgaatttttcaaattattgacaaaactatcaagtgataacagattaggtagaaggaagaggaaagctgctaaatctataattgttcaaggaagagaactaatagaatgaagaaaaagaaaaatttaaaaccttaaatatcaaaataagtactaaataaaaaatgagtaaattactcaaaaaaaaagcaaatcatctcatgttgaaagactttttaaaaaagctttagaaatagaaaatatgacattaaatgacattgaattaagaccagacatatgtgtcaaagtaataaatatcaataggtttaattcacatattgaaagataaagtcatcagattgtactacgaagcaaagacactcaattaaaataaataactcagaaaaaaattgaataaaaggatgagcaaaagtataaatagaaaatgtaaaataaagcaagatgcaatctttatatatgacaaaatggaattcagaccaaaaaaaaatgatgagggatacttttgtcaataattttaactttcttgatattcactttgtattcttagatttgattatacttgttttacctgatctatcatgtttaaattatggatagtgagtaaaactatgttaactcctctatttgtttagttgtttatttttacactttcacatatcatttcctatttactgttaccttaatctccacatttgttcagtctcagtcctataattaaatatattcgatagtcacaatatgtcattttgttatagtttcaccagtcatctcttggctgacttaagttctttttccagtaatgaagaattcatgggaaaaatattagctgaacacttgcttgatcaataccagtaaaacttatacaatttgacttggtcaaacatagcattcatgtatcatgtttttttttctctgagtattgtacaggtatttctatattagtctctgtcattgaatggttgcatttgatacatttgaagccaatctgacatttctttctttattctgacttaaccttttttgagtggaacttcagttttttctctatccttaaaatccaataattttaataggcagtaaccaaaattgaccattctgagttaatcgctcccaactaactcagaggatgttgcattttttcaatgtagattcaaatcatttttatttcctcaaagttgtcttgaattataactttaaaaaatattcttctcaggcttttcttctttggaaactcattttgattatgatagaacttatttatctgcttactaaatttgtcattttctctctaaactattttaaatatatctttttgtttattttttctcacaactatcttttgtcccttgctagtttttccatagtatcctgcctttcttgaagtttttcaaatcttttttcctttcttttatgtgttttgtttttcttttctagttctttcctgatttctgcatgctcattttcatccctcctattgttaagatatgttaatcctattcctacatttttacttggctttttccaaacgcatggaatattatttcattaagcttctgttgttttctttatgtattcattttcattacatttctcatccactttcaggcaatcttttcctcgtgcatatttttcatctgcttgtagatttctcccatttttcatggaaaatctttgtgttggtgctatacccagttcttttttcattgttcgtcactgaatgtgttgaattttcctagattagcaatttgggggaggtacctaagcaggaggctaggggagaaaggatacagtagcccttcagatttttcatttgctcactacttccatcccttaggggtcctgttgattctttctatggatgtgcctcctttttctgcaggatacataatgtaaccactgctctgaaaatggccctgctctcttgtattctatacccttaattgtatcaagggtgtagcttttggaattcaaattgggcaccttatttttactttagataattttttttttaaactggaacttcagtagatattccatcgcttgagcttttaccattctgctctgacttttttcagttcctcctatgcagattccacccaatatcatcaatataggcagaagaaccattggggacaaaaagagaggattattaagtttctcataatgaattacttgaaacgagagaatatatattagaaataaggtttcaaaggtatgcctgggttggtacactatgaattttaataagttagaactgtatgatatttttaagtgatggattttaaaaaattaatcatttgcataattaatcagactctgctaattaattctataaaactatatgcaaaatgcataaaatatttttgaaattaaaatttggactaataaagaggagttaaaatgataattagaaactttctttgatgcaacaacaatatgtgctctttaagaaaaatctggaaaacataggaataaagcataaattaaaatatttaacattttggctatagttaaatataaatgcatacatgttattgttttaaaactagaatcacactcaaaatattgtgatctctattttaatctttttgtatatatattcttttaaataggatttttataatggctgcagagtatctcttcatatgcaaaggtgtaatttgtttttatcagttctccattataagatattcagatggtttcgacactgaaaattgtattgtgttaattgtcctaatgaagcaggatatttccctgaccccttcgcggaattcctgacaggggtgcctcatttactcagccccgctcgctgctctcagctcctcgcgggagggagtgcacgagcgaacgagtacgggagctggaatgaatgagtgctggaatcggctggccacttggcgctggtaggacccaaccccactcactcggacctgcagcgttccacccctcatgggagggagcgcacaggtgagcaggtgtaggaactgaccccacgctttagaaccggcaggattgaactccatgcaggccccacagcagactccaaccgggggtgcctgcgactctcagagccccagagggcacgttacagtgctcttttagctctgctgtccgcagtcccagtccttagtccgcattagtgttaatagctcagtggggcctctgacttttcacatgaggcggctgccttccaccagccagggtgaagagccagtgtgacagccagactcttctcgaagttacgaagttacgccaccaagctgtccctctgaagtcaagccacttctctcctatgcccagctgtatcctgtctactggctgagtctgggattaatataggcacaggatggggcggggtggggccatgagtggtttaggaaaaagcaacatttgagcgggaaaacagggatagaagttctcactttgggctgtggtttcaggcttttcagcttgagggtaggaattcctggggacctactcttttctgcctagattttctgtgcctgctgttccctatcactaatacacaaatcttggtgtacttcaaatagtgtaatccaaatagtgtaatccaatttagataaattggaaggagtaaaatttctgggacagaaaacaatgcatatttcccatatatcttcttaaattgtcctctagaaagattttattacttatttattatcattattcaacagtggttgatttccttttctttgaatctttaatgaaaatatgcataattttaagtcattttgtatatttgatatataaaatatggtctcatctttacattatagtgtgaaacattagtgagattgaggtgtttttgtttgttttgtttgcttctcctgaattcatggggcacagacatttctcctttataaactgcctgtccctgctctgtagctgggttgctcttggtacattgtcctttttctatgtaaaaactcttagtgaaaactctttcatatgggacaaatatcacttctcttccccatctctggtttgccttgcaattttgtctgtctttttaatacagaattttaaatgtttataaatctgttggtatgttcctttgaattttcttctgttttatacttagaaatttctgttttgaaaatcatgagtatgtaaatataattttttcatttttgcattttggaaatgtcataattaagaggtgataattgtgacatgatctgaggactgtttctgtatttaccgtcatatctcatttgtctcactgatgtttctttactagaattagtctcatttatgtactgcattttataatatgcaatattatcatataaagcatataagatactattacaagataatatagcatattcctcactatacttttctattctatataaattttaaaacattttgtcatctcccaaaaaatagtgtcttggaatttttatttggacatcactaaaactaaaatatttagggataattgatcagaagcaacatgatatttctctttctaaattttttatatttttctctaaattgttttatagtctttttcatgtaatatatacacacacgtatgtgattttccctatatattttgtattttatgtctggcttattttacattcttttttttttttttttttttgagatggagtctcactctgtcacccaggttggagtgcagtggctccatctcggctcactgcaacctccccctctgggttcaagcgattctcctgcctcagcctcctggtagctgggactacaggtgtatgccaccacgcccgtctaatttttgtatttttagtagagacggtgtttcacccagttggtcaggctggtctcaaactcctgacctcatgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaatacaaaaaagttagccgggcgtggtggcacatgcctgcaaccccagctacttgagaggctgaagcaggagaattacttgaacccggaaggcggaggttgtggtgagccaagattgctccattgcactccagcctgggcaacaagagcaaaactctgtctcaaacaaaacaaaacaaaacaaaacaaaacaaaaacaatatgaaagcaaccaatttcctttaaaagtatttttaaaactttcaacaattgtatgggctttttgggtacatttctctttagagattctattgtgaaaatattgtattaattgtttgacctttttgagcttttagcttaattttaaaataaaaactgcttaatatttttgttcattttatattaaataaaaaccggtcattaactataactcttaagttgacatttcacacaaaaataataatagagatggatagatttttatcctcattcttttaattataaatattaattaccatatgataccagatagtattttatctgctgaagtatttgatgacttatattacaaatggctttataatgcaggccccagatttctaaattagtagtgtttatttttatagatcaaaatatcatgtccagtcacagtggctcatacctgtaatcccagcagtttgggaagccaaggctgatgaatcacttgagctcaggaactcaagaccagcctggccaacatggtgaaaccctatctctactaaaaagacaaaaactagccgggcatggtggtgcatgcttgtagtctcagctacttgagaggctaaggcacaagaatcgcttgaacccaagaggcagaggtggcagtgagctgagatcacgccactgcactccagcctaggcagcagagcaagactccatccaaaaaaacccccaaaaacctaatgtttttatttatattttagattagtgggatggtttggccatgaactcagcaccagatttaagatggataacagtaagtgtatttattttacctaatgtcatttttattttaactttatttcaatgttcatctgtctttgtattatgtgtaatgtatatgccccagggagagtgcacttcaaaaatgtcactgagaattctcaaataagaaatgacatttccagagtgtaagactaagagtttatagattttagcatgattttgagtctatcccttagcagggagataaaagaaaatgaagtccaaggtaagggtcatgtggcttggtcaggtgccatcaacatagagtgcctgaaacactgggcatggaggacaggaggaaatttggggcttggagtcagatccagaaagacctgggtgttaatcacactttgctgcttaatagttttttgatcctgcacaagttatatcatcttgtgtcattgttttttctttcccacttatctaatgtgaataataaaatctatttaaagatttggttttagggttagtcaagctcaaaacaataagccaagtaggacacagcagtaccttaataaatactcattttcactcctcttttttcctattttccttttgtggcttttgccatgtaccaaagagtgtagcaattcctgtgagcagttaaccccagcagatagaagtgaaactctaccatgcagagcttccttttcctgcatgacctcatttctcaatcacatgggatgcagaaagatcatacgtgctttgagagttcaacataaacttgatccttcagattgctttaaaccctgagatactgttttaaatttgttttcattttttattgactttatttttttgtttttgaaacaaggtcttgttctgtcacctaggccggagtacagtggtgcgatcaggctcagttcagccttgatattcctggctcaagcaatcttctcgccttagcttcctaagtagctgggactagaggtgtgcaccaccatgactggatgatgatgatgatgctgattattattattattatttagtggagatgaggtcttgctatgttgtccaagctggcctgagataatattttatatatataggtgctctttgacttacaatggggttatttcctgataagcccatcataagctgaaaatatcataagtaaaaaatgcatttaatacacctaatctatagaacatcatagcttagcctagcctaccttaaaacacattcaaaacacttacatagcctagagttgggcaaaaccatctaacacaaatcctattttataataaagcattgaatatattatatgatttattgaatactatactaaaagtggaaaacacaatgggcgtatgggtagtcgaagtatggcttctacttaagatgtactgcttttgtatcactgtaaaattgaacaattttaagtcaaaccattgttaagtcagggaccattggtatgcagatttgtagcaaccaaattgcaaaatgggatattccagtcaagtcaggatacctgtattttaccttggctgctaaaataattagatctgttattataccagttatttaaattctttgagatgggttttcttatttggaaataaaggaattgaatttgatcaggggtagcaaactttttctgtgaaaggccagataggaaatattttaagctttctaggctatacagtctctgtggcaaatactcaattccgtcattgtggtggtaaagcagccataggtgatacataagtgaaagattgtggctatgttttcataaaactgtattttaaaaagcagggcctggcacgaagactcacgcctgtaatcccagcactttgggaggcaaggcagatggatcaattgatcacaggagtttgagaccagcctgggtgacatagtgagaccttgtctctataaaaactacagaaattagccaggagtggtggtatgcatctgtagtcccagctacttgggagcctgaggcgggaagatcacctgagcccggggaggtcaaggctgcagtgagccatgattgagccactgcactcaggcctgggtaacagagtgatactctgtctcaaaaacaaaaacaaaactagtgggtcaaatttggcccacaggccatatggccatatattagtctgttttcacactgctataaagataccacctgagactcagtaatttgaaaaggaaagaattttaattgactcacagtttcacatggctggggaagtctcaggaaacttacaatcatgtcagaaggcaaagggaaagcaaggcacatatgaggtgatgggaggtgagagagagagagaaagagagagagtgcataaaaactgctgtttttggccgggcgtggtggctcacgcctgtaatcccagcactttgggaggccaaggcgggcggatcacgaggtcaggagatcgagaccaccctggctaacactgtgaaaccccatctctactaaaaatacaaaaaaattagctgggcgtggtgacaggcacccgtagtcccagctactcggaaagctgaggcaggagaatggcgtgaacccgtgaggcggaggtttcagtgagccaagattgcgccactgcattccagcctgggcaacagagcgagactccatctcaaaaacaaaaacaaaaaacaaaaacaaaaaaaaaaaaaactgctgtttttaaaaccatcagatcttgtgagaactccttcactatcatgagaacggcatgcaggaaactgcccccatgatccattcacctcccatcaggtcccaccctcgacatatggggattacaattcaagatgagatttgggtggggactcagagccaaaccatatcaccatagtttgcttaatcctggatttgataactataaaaaagtcatcaagttttaacattcttttagtcagtcatagtgttaacttatctctgactagctatcttaaccctattgaatttaacttgctacagttcaatctgcttaattctaattagtagagcatctgttattaatttaccttttttatatacttaggcagatcttttttttaaagctccctctattgtgtgtgtgtgtgtgtgtgtgtgtgtgtgtctgtgtgtgttctgtaagagaaaccacttgacctaacaatcctagagctaaaagtcagcttcataggtcatttcattcatatttctgcctttgggagacattacaattacatgccactaaaagctgatgctctctctcattgacatggtttcataatagaatagcaaatgttgagcagaataaggaatcctggcttgggaataggaaggcagagaatgagatccagaaaaacttccagaagaggtcatttttaccttgggtctaagatttctggtgttctgctaagaagttggggacaagggaggtgggaactgctggtaaacgggaaataacgtcgatattttagttccatggagcttatcttaaatatctcagaaatcctacttaggaagaaaagtttaagtcttgctcttttactctccagtactctagtatctttatggacacttttaaagttaccttctatgataatgacatgatattaatttctcagaactgcagttaatccctggggtctgtggattccgaatttcaaatcctcccattttgttggtctgttccttgcatgctagtttagaggtaagtgatgtgtgtttcaaccttcccacatctttgcgttttttcttgatctgtttgtgacaattcatagtactttctctgctacacagcaagatgatacatgtgcactgtgcatgaacaagggacagaaggcagcattcccctttaggacagtgatgatgtggtgagggtctcccttcattcatgtcaccagcccccagcacaatgcttggcacattgttggcacatagtaaatattaaatggaactcttttggggagatacgttttttactccacttagaatctgtttaaacatgaataagttatttaaccttctcttggcctctctttataccaaataagcatgcaatatttagttcttcataaattcgctcattcaacataaatttattgagaaaatattgtgtgcctgatgtgattactagggactgtactttttctagttcattgtaggtgaatgaactgaccaagtaccatgtgacaaagctaggaaagacttacttgaaggaaaaaagaataatcagagtaaaccaaagattaaataaggttgtctcataaggtagggtggttttatgatttttttaaattgggacttctatgccattatgtccatttatagtctccactatcactgactcaatattttcctttaaattaatttatatttttatttaggtaaatttagtctcaccctgaaatgataaatatacataacaagaaaatgaaattgtgattccttagatactattatttagtgttagactaaatgtggccaagtaaaaatatataggttatatagtataaaattcatatataatgtaaatgtataaatatttacataaataatgtaaatatataaagtaattgtatattttgtatacctatatttaagtaaaatatattttaagtaaatgtgcatatatatttctaatagaagttttacatagaactattcaaacaaggatttgaaattttttcatgtctccttctaaaatcatgtagtttatgatattttggcaaaaacttatagaggatttcagcatcaaatgagtgacaggatgaagattcaaaattccttctaatctaaaattgcataattctgtgaacacttacagcagtttctcattctggccactggatggcagcatcaagttcctctgtttttattaaatttcaccactggatagtgatcatcacctcatttcattctgtctcaatttaaagcgcacctactcagtttaaccactagatggagcttgtgttgttttcacttcatggcagaatttttctttaacttggaaaatagacacagtaacgagatttttcagccagtgatatatatttttgacagttttttgagtaaaaatctgcttagtaaatcagataatgatatttgagttgtttttatagtatccattcagataaatattttgtttaaacattttaaaacaaaataaagtttctgcattccttgcaagtttgtatcagcgagatgtgtgacaatatcagaagcaccaggacataccttaggaagagcttgtacctaaagtaatttcctctggtgcccatatctttgcaaataacttctcagacgtacctggaaatttccttttagacgccttcactttggcatactttctgcagtggactggcttttctagtagtattcacccttctcttgtgggaaaggaagcacattcctattcttccagccactgttttcctaccacactgtattagagtcacctagacaaagtttttattttcagttataatctgagaactgatttattttttctttttaatatctaaacttaaacctcagcctcctgagtagctgggactacaggtgtgcaccgctacaccaggctaatttttgtagttttttgtacagataaagtcttactatgttacccagtcaatatctaaacttaaaaccctaaaagccacaagaagaatgatatgcatttctctggatcttctaatcacttacatatttcccttgagcctctttctgctcatttcactgctgagactatgttctaaccaaaattatctttagttaatcaagccttatgttggtaaaagtgttttttcaaaattctttcctactgtaaattgcaaaatttttgaattacaaactaatgcattgaattgcttccctttctctgttaaaatgtcttattttctagacatttatgggtttctcatgtgagtaaacatcagtgaattaactatgcttctattaatacttaccttcctttaagttttatttatttatatttagagatgaggtcttgctctgttgttcagactggaatgcaatagtacgatcatggcttagcatggcctcaaactcctggggttcaagtgatcctcctgcccccaccttccaggtaactgggactgcaggactgcaccaccacacttggctgattattattatttatttattttatttctttatttttgagacagggtccccttctgtcactcctagagtgcagtgatgggatctcagctcactgcaacctctgcctcctggactcagttgatcttcccacctcagcctccacagcagctgggactacaagagtgcaccaccatgcccgactaatttttgtatttttttatagagacaggattttgccatgttgcccaggctgatcttgaactactggctgcaagtggtcctcctgagtagctaagactacagggcatgccactgtgctcagcttatttttaaatttttttagagatgaggtctggctatgttgtccacgttaatctggaactcctggcctcaagcgattctcctgcctcagtctcctgtttgaaatgtttgtttttcagtgctataaagaaatagcacttgaacgcaaatttaatttatttagtaaggccatttttacttcctgcagagaggatacactcgccagcagttttgccatgagagtacaccgaacaaaggagacagggtcatttataacctgacgtgtccaccctactgctgtgtccagttccaatggctggaatgggacctcccattctgtatttgtcccgattggctagtaacttagaactttttaaaagacgtaaaggtagagggtaacaaaggaaggaggaagtaacttgtggaatgctaagaaaggtaaaaacacttttaaataaggaagaggaacaggctgtgacctaatgctgcttggaccagtataagcatgccagggcaaatatttaggctaaattgtgggagctaaaaacataaagtatattgatttatttattacagctagcagatatttaagaatgttagcacaggtctttgaataaattttgcttctaagagaagttactatttattcctaattagacgggaaggaaagtctttgaagaggaacctctactttactttttatactcctaagcagttgggatgacagacgtgaaccactgcactcagccaccttatctttttaaaccagtttattccattttaggagataggtggttgaagtttcaataaacgaaagaagtaaatgcatgaatcaaactgcctctttgttgtctctacttttaagaaatattcaacacagtcaaatacgaactggaggagagattctatacttaagaatcaatcacatataaataagaccttagatttttaatgcaatgactttttaaaaagatattaatatggctttttttaataaatacatgtgtatatggttgattgatataaaaaatagcacattgtaatcagtttcaaactgtccttttgtttatatttttttatctgaatcatttatacaatagttcttaaaatattgtggatcaagggatgaagcctgaggccaggaacctggtggcaagtactctctccctcaatggacacgaagtgtgaccttacacaagcaacaactccctttggatgtatttgccttattttttaaagtaagatgtttggacaagattattttggaagtctcctcactttccaaaatacttaaatttaaacaatacgtatattatattttgagggttcatatttatgtgtagcgataggtagacaatatttagtccctttcagtattctgaattcataatgaaataaatggcttcaaaatacaaagttagagcattcaattaaaatacatggcgagtcagaagactcaacaaagaaatgtactatacgtttcctttcaaatttcctagagagacagttttaagaatttaagagaaaaatatgacaattgaaaacatcacaccaaacttatttttcctgtttaaacttatctagcttttcaagctttgtgttcattttgtcagtaagaaaaaaaatacaagtagttgaaactctgcaaagtattatcttctaagctgaatatttttcaaaccacagttttcattttttctaatttaaaaaaattattttctcaatattgaaagcataacatttatgagaagcaaaaaagaaaatagaatatttatgttacttccctattattctctctcaatatttttatgtgaagctcagaatagacttttaccctctgtgagatgaatttaaaagtgcctcagaatgcagttgcccttattgtggttgtaatggagaaagtaagttttatatttaaaagttattttatgatttaaagagtgttaacattccacagtatattaagatggaagctatttgtcataccaaaaaaattggtttctagttatcaagagaaagcttcaagagcaacattccctacgcccctttaaaaactaaatgcaagtaatattcctccaagttttactaacctatgcacacaaatgaactatcattaaatgtgatacttcacatatcgattgcccccatgtacatattagggcacccatagcataaccacaaaatttcctagaattatttattatttagaatttcttagaatattattaagctccagagagaatcttggaaagattcctcacatagtctttttattccaaacttcacagccaaaccagctgtggcccgtgccttgcctgtccctgctcctctgggagaattttgattcttgtcccttgacccaaaacttggcagtgttcccttgagtcttcattatgccaagtctacctacatttgctttgcccaagaaaatgaaggagatgcctcctaccaagttctgtgtaacctgggtcatctgaatcttggagcactattatttgtactgcagatctctctcgggagcttatgaagccaagatatcagcctctacttgagctgtctctgtagacttcagacattgtctgggagttgtggttgaagagagagacaggcaccattctgtcctgtttttcctctcttgcttagatatcatttaccttcagtacagttcccagcctctccttcagccaatccatagcctctatacagtatagttccaggaaatctatggctgaatggtttgagttttattagagtgcctgcctacacatgccacgtgtacatacaggaataactgttttcatagacttgataaagtctcaatatcaccaaatgaccctatctttgctcttgatatctttgctcatgacacagaaaaggaacattaagtggcaggccagtgcatcacgctctgtttgcagttcatttagttcttatacataggatatatttttacactctacttgaccttaagagataagccagaaaagcacatctgttctgacccctaatattccaacaccagttattgtgtgcccttgtcactcatcttaatataagacatctcagcccacaaatggcagtattttcacaccagtgctagagtttagaaggggggaaatgagagaaaccaagcccaaatgcttcagtaaaaataaatgcattatctaatattatttgctttcctctctgaggaaacttagcattattatttaactgcttgttttcttattgttaaactggaagagatttgggagtcagtaaagcagttataaatatcaccagtaacactgctttacacatttgcacatgtttagatcatattgcacttttttgaggataaacaaactttacatcaaagttggaaaagtcttcttgattatgatttcaaaaagtggttttggggaaaagcttacattgtatgatatttaaatccatttattaaggtatgttttacttgattatactaacttaatttaaaataattttgaaggtatgttcccggaccaaattgagggttgggctgctatttctcatggcccaataacaagatgcagatgaacaggggaggaagagagtttttatttctgtaactggttacagggagaaggcctggaaattatcaccagaccaactcaaaattacaaagttttacaggtgtaagtgtgcattcatctgaagacataagtgattaacttcttttaatctacaactaaggtctgagtcctgaagaccttcctctggagcctcagtaaatttacttaatctaaatgggtccaggtgctggagtgattacccttatcttgtcttctgctaaatcactgaagtttgaggagttcctttagaccttcaataaacttgtttgtagaggcctggagagtttcttcacaaccacagtaaaacttgtttaatcctgaatgggtcctgttaagaattccttcattattctgtcatgctttaaggcccagggaaagcctaggcaaaactcttgataggcttttgttcatcccagcctttgtataagggcactgacttttttagtttttaatatttaatgtaaccactcggtcagtactgaaacagttgtgatggaggcctgcattagtgaaacctggcctgccacaggtacatgatattaacttacattttcttcctttgcaagttttatttaagtgacatttgtacaatttttctgtcatggaaattttaccttcagtatttaatagcaaagcatttaaaggagggcatgattttacacaaaaagattatgtaaagggagatatttattggaaagatcaaatatgggcatttcctttttatgcatgatttactcttaatttttgcttctttgtaaatcaataagacactttaatctgattgtttctcattccacagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggttgtaagtatgtcttgctttgctaccagattttgtctatgggccgcatgttagggataaaatttggactctttggtttattcattgttgcatgttatttcacatcagtcagtcaattaaggataaattaagtgccaactaagccctcagcactgtgctaactgaaaggcatagagatctgtcgtttctgataaaagagaagataccacaaacttggcttataggaatagttttttgtaacttactcattcttttcataacagtttgggcagaaaaaagttattatttcatcatactcagtcaggacattgttttctctagtctgtactacaattcatttattggatgaatggaattaaagatcataccaatttattgaagggttaaaaaagaaagtcttatttagtcgcttgatcaaattaagttattttcaaccttgtcacttctgtcaaaaaagatatatatacacttctcaggagtggtaacattgcaaggaataatttttttttaacccttcagcctatatgaccttcttggtctcttgaagagaactaataaatgtgaactgagtaatttcagggaaaaaagataatgtatctacttccaatgattatgtaattaaggcattgcttggctcatgtttacctgtaggagaggttactcccagatgctggagacacaagtcagaaattcaagtttctaaatcaaactctgctgtcgtcaaactctgtcctctttggaaagttcattaggatctattggcttgaaattttcatccgtatttggggtataaaataaattacctccaagagttgtgattggattgaaatgggacagcacacataaactatatactatattgtctagcctatagcaggtgttttctaaagttaaccatagtgatctctaggcatgtcaaattatctggtgctacttcaggacctacaatgtagcccacttcttatttgtgagatcaaagattagagaattaagttcaaggataatttactaaaactctccagaccctaatgaggttttcattcacttaaattcacccaagaattccagtccttccatggggtccccacgggaaaaaaaaaacaaaatgtatttatggtctattaaatgcttaaggaagatagttgctgaatagatttcaggaatctatcttggctatttatgcaccaatccattcttatttcttaaattattatcaagagaaaagtttcataaaacagaaaaacaccatgttttaaagtaaaaaaattttgcatatatattaatttttagggaaatcattatgaaagtgctttacataagtttatctggaatgtagattttcaacgtgtgaataatgctaacattattgtggctttattttttccccacagtgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttacagaaaatctgatataatttttcagagtctgtggcactaaggagtccacagggctgcctaggtgctttgtgtttgggggaccaaaactgtgttggttcaagtattatctatacagtctctataagctgtcacatttcatggtcattgaaatgttttatgttggtttaatttctgatttaactgacaacttcataatgtatgtgcaattattgtgtcaaatttagaaatattactttagcttcaatttaccaaggagtttctttgaagcattgtagtctgatatatatatatatgtgtgtgtgtgtgtgtgtgtatatatatatatatatcatatatatatgatagtggctttcaaatttttttgggtacaatccacattgctcctgctgatctgtaatatcagaaaccagtatttatgtgaatatatgagaaatattattgattctaagatattttatcatattttaacatctttgaaagaggacccatctttcaattttcgatcaatagtttcttacagtcaccattggccatctttctcgttaccatctatgaaattagcatgcatctcaaataaacagttaccatcttctatttgataaaatagtctaaatagcaaaaataaaagtttttacaattatttgcctgtgctctaataggtactattctattttatctcataagaaatgttggaaactcattatattgatttccttacccactcatgggccctaattcacactttttaagaatgtttctttctttaatgttatcataatctcttactttttaaatgagaacttcccctaatataagagcttagatattatattactatgtttccatagtaaataaataaccccaagatctttttggggattagagatataagaaatatgtgctccatctcttgacatctttatctcaaatctatggacctttcttacccactgtgaaaaacctaaagttacacttagccctgttggacttacctagttttcaattgttgatgccacaatcattatttataagttgacaaaatagtgtagatttgtatacatagtcaacaaaaagagtgacataattattgcctccaattaaacaagtttgaatgaaataaacaaacttagataaacacttcggatggtagacgtaaacaataatatgtggaactccaacatcaacacctaccaataccagtaactactgatatttatcatgtacttaccatgtaccatgtattgtgctacattactcatgttatctcccttaattgagtggctacatactgctttagcaaatcttcctactgtaactaatcctcatagatggaagagttctcaaaaccttaaaactcatgcataagtggattcatatacatatataaaaatatatataaatatatatactttatatatatttatatttatatatttatatatttatattttaatatatttatataaatatatataaagtataatatatataaagtataaatatatatatatttatactttaagttcttggatacacgtgcagaacatgcaggtttgttacataggtatacatgtgccgtggtggattgctgcacccatcaacccgtcatctacatcaggtatttctcctaatgctcaccctcctcttatccccaactacccaaaaggacctggtgtgtgatgttcccctccctgtgttcatatgttctcattgttcaactctcacttatgggtaagaacatgcagtgtttgattttctgttcctctgttagtttgctgagaatgatggtttccagcttcatccatgtccctgcaaaggacatgaactcattcttttttatggctgcatagtattccatggtatatatgtgccacattttctttatccagtctatcattgatggccatttgagttggttccaagtcttcgctattgtgaatagtgctgcaatgaacatatgtgtgcatgtgtctttatagtagaatgatttataatccttag

SEQ ID NO: 13003 - DNA, 54452 bp, Human; identical to SEQ ID NO: 12642

SEQ ID NO: 13004 - DNA, 34855 bp, Human
  misc_feature (1)...(34855): n = A,T,C or G
aaagtgttgggattacaggtgtgagccttttgttttctttttaatagagctggttcaaagctgaggatctgctatgtgcagtggggcaggcctggggacagcacagtgaagttaccagatcatgctcttaaaattagaacattccacaagtaaacagtaggagaagatgctaggggtctgtctgtacaaggaggaggggagcgtggcatgggagagtgaccatcaaggtcagagggggcctttctcaggaggtagtgcttgggttgagctgggagaccagagagcagccaggtgaagctccatggagagctccacgcagagggagaagcagggccagagccctgggggaatgggctcagggtgtttaggaacagagaccaagcactggtggatgcatgcgatgagggctaaggaaagctggagagctggggtccagactgcgaacaggaggaatatgggctctgataatttggttacttgaatcttgccagtaaatatgtttcttatgtggttttttttttttggagacaagagtctcactctgtcacccaggctggagtgcagtggcgcaatctcagcttactttgcaacctctgcctcccagtttcaagggatcctcctgcctgagcctccgagtagctgggattacaggcacacgccaccacgcctggctaattttttgtgtttttagtagagacagggtttcaccacgttggccaggctggtctcaaactcctgacctcaagtgatctgcccgcctcggcctcccaaattgctgggattacaggtgtgagccactgcacctggcctgtttcttgttcttgttatcagcaagtggcctttagaaagatttgtctggtggtgaaattatgacagctgatttgtcctggatattggtcttgcactgaatgcgccaaacactgatcatggctgtaaaaggccctttgcagggtcacatggacttgggcccttatctgcagacttgaattatggatttttttttccttcccttgcagggaagaccactgggatccccatccatgtctttggcacagagactcacatgacggccattgtgggcatggccctgggccaccggcccatccccaaccagccacccacagcggcccacactgcaaacttcctcctcaacgccagcgggagcacatcggtaggttccagcctccccaaaccttacaggaaggaaccatctcatcttttccactaggatacagtcttcttcctctgttccctgggggcatagaggaaatacagcgggagttagtgcatggttggtttgtggatctctgccaatttttttcctgtcctgattaaagtagtataatggaaggacaaaggattttaaaattggatccaagttcaaattgtggccgggcatggtggctcatgcctgtaatcccagcactttgggaggccgaggctggcggatcacctgagctcaggagttcgagaccagcctggccaacatggtgaaaccgtgtctctactaaaaatacaaaagttagccagacatggtggtgcatgtctgtaatcccagctactcgggaggctcaggcatgagaatcacttgaacctgggaggcggaggttgcagtgagctgtgatggcaccattgcactccagctctgagcaacagagtgagaattcgtctcaaaagaaaagaaaagaaaagaaaaacttaaaaatcgttactcttactttttgctgagagagcaaccttagccagtaccttgtccacccagggcctcagtttgctgatctgtaacatgggataatattaattcgtatcttagaggattattagtacttttggaagcagcttataaagagcattgctgtgcataatttttattacgagttttctttggggcctttaaggaccagtggcttttttcccaggtgtgactcttacctcttacactctctccttatctcaccccagacgccagcccccagcaggacagcatctttttctgagtccagggccgatgaggtggcgcctgcaaagaaggccaagcctgccatgccacaaggtaactccctgaggcttcaggcatgttgcagggagtggccttgcggtaccctctgtatctctctcccctttccctttcccccctgggctggcagaggcagatgaacagcggtttgggttttgcaatgggagtgcacctgggacacgaggatggtatgacttgagccttccctgtgggcgctcctgaggcagaggacccacgccgtgcctggtcgcctcaactccccctattctcttctacccctggttcttcttatgggggtgtggactgggcagggaggctgtggaggagatagggttacagaaattccaggaagtggaaagttctctgagactcttctcctgagtggagggcagacaccgggaccccaggacggcagagccagctcatacgacagcagttcccaggccacccccaccatcttggggccctaacagacattccctcctttgaatccccagcaagaaaagcccccgcctgtcagcccatctgtatttcaactaatttttctctccgtgtagatgtgattcctgccggccagcccttgcagccagctctacataagtggtgttagttacccctgggctggtatacctgtgcagcctcttcctgggacacactttgctatggcattttggaaaatagtgacactgtcccaaatcagcatccttgtccatggcacgggtcaaccccatgctggccaatcatctcatagtgtttcatggagacaaaaagggattggcattaagagggtgggactgcgccagctagagagcccagagttcaagtcatccagctgtccctgcagagggcctgggggaggcgctggtgttgagcacatctgcccagcctttgtcctcctcctgccccctctctgcccgtttggtctttgctctttcttgcttccattctgctcatcggtgctttcacctcttctgctggccttactccgttgtccattgcagaacaggagagggatggtgagggctttagccctgaaaggcttgtccatgggacccttccctgttcccaccctctccctccaaagcctccagccatcagtgggtcactcagttgccttggtcattttctttgacagattcagtcccaagtccaagatccctgcaaggtaggatgcccccaccctgcccccactccgcgtgtggctttgttagcgggtgacagttttactgtgtgctctgtttccccctcccctggtgggttgcagtgtcgtctggtctattttctgtccctgccttgatgtggcctgaccccaagtcctaagtcttcgctcttcctcccctcctatccgtgctcagtacgcgccccactcagtcctctcctcactgtgtggctgtttctggctccaagcttgggaaggggtagagattttggaaggagcaagagccagacccacagccctggagagtgtagtggtgtcaaggagagagtgtcgcctgggaaggagggagccatccaactaaatggggagtggcagagagtcgtgggcgtctgtcactgctggggtgcagaaggggagccacaagtcacccctgcttctcatttacatctcctgatgtcattttcccacctttcctgcctcggcttcaccactgccagcttcatcctcaagctccagggaccagtttatctttttctggggttgtggtggaggaacaagagaggtgaagaaggaggtagacggaagcgcagaagggtgtgcagcggatctagtgactgggtaattggaaggggtatgagctttgtctggtgtatgaggtcacattttacagtggatacttctgtgcatgcgcattcacccaccagcctagctgagtagattaattggttcatggcatcagagcgtccatttaactttgacattcacagccgtggaggcggggaagtctttgttgtccccttgctaaggggaggggaaggagtaattggcagggtcgataaccagctggaaaggcctggaatgcagcactgtggccacctggctttaatcctgatgtttttgcctctggaaaaagttaagagcagagtgagcccagtgtggaaagaacagggaccagccctggttctccaggagctctctgtgctctgaaggggaggagggttatgaggaggggggttatccttgttactttctggagtgagagaaataaaaggagggtgtgtcagggagaacagattatggctgagcgagccctcccctcagcgaggccagaggaggcctggtgtagggggcatagcccctggcacagaggttctctgtggagcctctctgctgctggtgggctgaggatacacccttcagctttggtttctctgtgcttgaggaagggccactttacctccacccttcctgctggagatgctggtaggttggtagattccaggctttgtcttgatttctgtagctggcagggtagatagatcagaggcatgtgcacgtgcgtcacctggcgggggtgacatgatgcaggcttcccctgaggatggcgggtcatgaactcacacttatattctccctcctcactttcacagttgagctgcattttaagtgattgtgtaatcctggctctgatgctggatgacctcggacctcaatcatttggcatctctgggcttcagtttcctaggactgggaagtgggagaactggattaggtggctccccttgttctgtgatctcatgtctcagcagaacccggggggtctaggtgacagtaaatcccaggtatttgcaacatcaggaaccttctgtcatgagaagctgtaaggctgtgatggaagaggcaggcctgtacagggatttaatgagaccatgaacttggttagccaagcctgctctagtacagtaggttaattaataccagatgccactgggctagatgcatcattcttcctaggggagctcagaacctccctgagggctgctttcctcctcttggacttgcagggacccagaggggaaagtcaactgcctgaagcgtggtaaaagtcctttccctttaggctaaggactgcacttttttctttttttttttaaatatacttgctgcattaaaattttctttttaaaatttttgtgggtacatagtaggggtgcatgagatattttggtacaggcgtgcaatgcgtaataatcgcatcatggaaggtttttctttgttgtttttttttttgaggtggggtctcactatgccgcggtggctggtttcgaattcctgggctcaagtgatcctcccatctcagtctcctaagtagctaggactcaagcacgcaccactatgcccacctagagaactgcacttctaccagctccttttgttcccttaccctttttttttttttttttttttttgagacagggtctcactctgtggcccaagctggagtgcagtggtgcgatcttggctcgccgcaacctctgcctccttggttcaagtgattgtgtgttggtttcccaagaagctgggattacaggtgcatgccaccacgctaattttttttttttttttttgagatggagtcccgctctgtcacctgggctggagtgcactggcacgatctcggctcactgcaacctctgcctcccgggttcgagcgattctccctgcctcagcctcctgagtagctgggattacaggtgtccaccccaccacacccagctaatttttgtatttttattagagacagcgtttcaccgcgttggccaggctggtcttgaactcttgagctcaagtgatccactggtctcagcctcccaaagtgctgggattacaggcgtgagccaccacacctgacctgcgccttacctcttaagtgcccactggagggtctgtccaagagcactgtcctgagcaggaaagagccacctggtagaagggagaaggacaggaaaaacaggagagcaggttgagggcactggccctgtgtaactagcttgctgctcctgccttgtgcagagccctggccagaaccacagttagcgataaggctgctgtgtcctcagccccggctgcacaaacctcttctttggacctacactgacctagaattcatgctgattcaaaccctgactggagctggttttatgtccagatttacagggtaataagcattgttggaacataagtcctgaacccaccaaaattgggcgagctaagcatttttttccaatgactttaaaaataatttgttaagacctcatttgcatataagctgatgacacaccttgcctgggaaatgaagcaggtcctataggaattatcctgggcatctttgactgtggggcccttctttctccattctttgcagagctacttaccagctagcaggccctcttagcttgatttgctctttctgccaccttcttccagaaaaatcgaggcacctcctccccaagttctcagaattctgtcctcttgacattcctttacggttgtgatgaggcatcaccctgtggacatggggcgtggaggggtctgtcaggcagccctggcccctgcaggtctcccgggggtatgtgttctgggtgcactctctgtgtctttgcccaccaggaaagagcaccaccctcttcagccgccacaccaaggccattgtgtggggcatgcagacccgggccgtgcaaggcatgctggactttgactatgtctgctcccgagacgagccctcagtggctgccatggtctaccctttcacgtgagttaccccatggcgggaaatatctccttcctctgctaagacaaagcttggggctgggcacagtggctcatgcctgtaatcctagcgctttgggaggtcgaggtgggagaattgcttgagcccaggagtttgagaccagccctgggcaacatagggagacccccatctctacagataatttaaaaattagccggatatggtggtgtgcacctgtagtcccagctacttgggagggtgaggcaggaggattgcctgagccttggaggttgaggctgcagtgaactctaattatgccactgcactccagcccgggtgacagagcaagaacctgtctcaaaagaaaaaaaaaaggcaaggcttgaggagtcagtgagctcattccctttgctggggaaggctttgcccatcctagagacagaggcagtcagtattcctgggggatctttgtcccttagatgaaaattctttgagggcacagaccatgccttttctatcttctaggtgaaattcctcccctcagcttccccttccccagtcctgacaggttgaggatatcctaattcttcttttactttctcacagtggggaccacaagcagaagttttactgggggcacaaagagatcctgatccctgtcttcaagaacatggctgatgccatgaggaagcacccggaggtagatgtgctcatcaactttgcctctctccgctctgcctatgacagcaccatggagaccatgaactatgcccaggtagatcactgggctctggagggtggggggtggggaccatgaactatgcgcaggtagatcactgggctctaggggacagagggtggggaagcaggaatggctcctggttgatgtcccgtcactgctgcctgggacaaagggctggggatttgggagtagccagtggtttaggtggaaatggttggagacacatgatcttcagaagtcaggatagtgacttagggcaggtcagtctgggcagaggctgcttatctgggcttacaaagaggctgctcaggcctgggacagtgacttatgcctgtaatcctaggactttggaaggcagaggcaggaagattgcttgaagccaagagttcaagaccagcctaagcaataaagcgagacccattctctacaaaaagcttaaaaattagtcaagccaggcatggtgactcacacctgtagtcccagctactcaggaagctgaggcaggaggatcaattgatcacccaggagttcaaggctgcagttagctatgatcattccatggcactccagcgtgggtggcagagcaagaccctgtctttaaaaaattaaataaagtaaaataaaatatacgctgggcatggtggcttatgcctgttattccagcactttgggaggtcaaggcaagaagattgcttgagcccaggagtttgagaccaacaaagcaagaccctgtccctataaaaaaattaaaaaaaaaaaagaattagctggacatggtggcatgtgctggctgaggtaggatgatcacttgagcctgggaggtcaaggctacagtgagttgtgatcacaccactgcacttcagcctaggcagcagagtgagactctaaataaataaataaataaatgttaaataaataaatgaggtggctcaggctccaccccacccccactatatcctctctgtgctatgcataactggcttgaaaactgggattggctggatgccatggcttgtgtttgttgggcggcagaggcgggggtattgtttgaggctaggggttcgagaccaacttgaacaacacagcaagaccttgtctgtacttaaaaaaggattagccaggcatgatggcactcactagtcccagctagtagggaggctaaggtaggaggatcgcttaagctcaggaggttgaggttgcagtgtgctgttatcatgccattgcactccagcctgggcagcagagtaagtcccagatcctgtctcaaaaacaaacaaaaaaacaaatcaggattaaagcactttattttatgtatgtttgtatttatttattttttttttttgagacagggcctcactctgtcacacagcctccacttcccaggctcaagtgattctcgtgcctcagccttctgagtagctgggattacaagcacatgccaccacacctggctttttttttttttttttttttttgtacagatggggtttcaccatgttggccagactggtctcgaactcctggccttaagtgatccactcaccttggcctcccaaagtgctgggattacaggagtgagccactgcacctggcctattttaattaaaaaaaattttttttttttgagacagagtttcactctttttgcccaggctggagtgcaatggtgcaatctcggctcaccgcaacctccgcctcccgggttcaagtgattcttctgcctcagcctcccaagtagctgggattacaggcgcctgccaccatgcccggctaattttttttttgtatttttagtagagacggagtttcaccatgttggccagggtggtctcgatctctcgacctcgtgatccgcccgcctcggcctcccaaagtgctgggattacaggcgtgagccaccgcgcccggcaaattttttttttttttttcaatcggtcagcttcccaagccagaggaggctcagaaagactccaacatttcattataaaaatattacgtatttattatagaacagtttcaaaatactgataaatactgttttgttgaaaataaatacttgaggtcccatttcagaaaaacatgactgctgctatgacggtatgtccttatctacccccttttctagatttgagcaaagggaataatactgtatgccactcatataatctgctttcttcagttgctctttccacatcagtaagcactaactggcagcatcacttttgcttttgcaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggagcctttctccatcacccaagctagagtgagtacagcggcgtgatctcagttcactgcaacctccacctcccgggttcaagcaattctcctgtctcagcctcccgagtagctgggactacaggcgcctgccaccacgcccagctaatttttgtattttcaatagagatgggattttacctttttgatcaggctggtcttgaactccaggcctcaggtgatccaaccgcctcggcctcccaaagtgctgatattacaggcgtgagccaccacgtccggctgctgcttctttagtttagggcagaggttggcaaactatggcccaaggcaaaacctagcacatcacctagttttagggctgttttttgtttgtttgtttgtttttgttttttgttttttgagacagagttttgctctcattgcccaggctgtagtgcagttgtgtgatctcggctcaccgcaacctctgccttccaggttcaagtgattctcctgcctcagcctcccaagtagctgggattacaggcatgcatcactatgcctggctaattttgtatttttaggagagatgggttttctccatgttggtcaggctggtctcaaactcccaatctcaaatgatctgcccaccttggccttgcagattgctgggattatagatgtgagccaccgcgcacagccaggggtttttgtttggttttaaagagacacacatactgctctgtagcccaggctggagtgcagtgatgcaatcatgcaactcactgtagcctcaacctcctgggttcaattgatcctcctaccgggtctccctgtgttgcccaggctggccttgaactcttgggctcaagggatccacctgccttagactcccaaagtgctgggattacaggcatgagccactctacctggcccctacaatactatcttgaccctttacagaagtttgctggccctggtttagagccaaagagaagtgattcctggatctgtcccatgcccctcccaccccgcctctgggctgagtgtagaagcagctcatttctcttaaacgctgaccctgtcctgtggggatggtgacaagactcggagggtcccatgaagaaaagccttagatagctgctttatgagcaggcacaggaacaggtagacaacaggagggtgtgagcttttgggtgagagtgaacgtagctgctatgactgtagcagggcttccgaaatacctgcctctcttgggtggatcactgtggtgttagctagtggagatcagtttcggctatccaccacttgtgttttcaggagatggttagagtgattacgagcagaggcctgtgggaagaatgagatgcatattggttttgttttttcgttttgttttgtttttgtttttgagatggagtctcgctctgtcacccaggctggagtgcagtggtgccgtctcagctcactgcaacctccacctcccgggctcaagcagttctcctgcctcagcctccctagtagctgggattataggcgcgcaccaccatacccagctaatttttgtatttttagtagagacggggttttgctacgttggccaggctggtctcgaactcctgaccttagaagatccaccctcctcggcctcccaaagtgctgggattacaagcatgagccaccgcgcccggctgatatgcatattgttaacattactttgttcttggaccctggaagaggacatgtggaatgggaggtgggcccttaaacggtgctgtcttgttgccctttctgaggcagagagttaacaggaagggacttttgtcatcctctagatccggaccatcgccatcatagctgaaggcatccctgaggccctcacgagaaagctgatcaagaaggcggaccagaagggagtgaccatcatcggacctgccactgtgagcttcccctccggaaagccttttacgttcgatgctatcttatgaagttcaatgcccttaggaagtttactttttgactcctctatctccctcctaggttgagaagattcaggaagtatgtgttgaaaatcagtctgtccatttttagctttttttttgagacacagcctcactgcaatgcctaggctggagtgcaatggcgcgatcctggctcactgcaacctccgcttccgggttcaagtgattctcctgtctcagcctcccaagtagctgggattacaggcacccgccaccatgtccggctaatttttgtgtttttagtcgagacgggatttcaccatgttggtcaggctggtctcgaactcctgacatcgggtgatccacccacctcggcctcccaaagtgctggagttacaggtgtgagccaccgtgtttggcctttttttttttttttctttgagacggagtcttgccctgttacctaggctggagtgcagtggcacgatcttggctcactgcagcctctgcctccttggttcaagcaattctcctgcctcagcctcccgaggagctgggactataggtgtgaaccaccacgcctggctaattttggtatttttagtagagacagggtttcaccatgttagccaggctggtctcaaactcccaacctcaggtagtctgccccctacagcctccaaaagtgttgggattgcaggcgtgagccaccatgcctggctgaaattattctttgaattattttttgtttgtttttttaagaagcagggtcttgctgtgttgctggagtgcagtggcttttcacaggtgcagttataacacacttcagcagccccgaactcctaagctcaagcaatctccctgcctcagcctcctgagtagctgggattccagaagtgttctccacacctggcttatttttacttcttactgtattaaaaaaatggagctagtatttatttccaaagagctgagattacagacctgagccactgtgccgggccaagtatacgtatctgaacctgaattagtgagccatgctttacaaataaggctctcttttgttctgtatgtctcttgagagagagaggagactttcctaagcaggaaacccagtgggcaagtgtgatttctcttggtcattctctccccagcctggccagaaggggctgggcagtaatgcaggggctttgtgattctttgtggtgaatctggaagtcaccttcctccctgattgtggtttctgcccccacaggttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtaatcagctgggaagccaaggaggggcttcctgctttgagagcagtgggctaggagacgatgctgtgtcctgcaggctgcttgctgcccctgagttccaggcccgcaggaatgctgctgaagtctaaacaatggggcatcactgctcttgtctcaggactgacagagcatgaaatcggaaaacacagaacagggcaacaatgtgcaggaggggcgactgggctttggggataattctgtttgttgtgattggccatagggaggcagcagagtacagtggttaggagggccagttctgaaattggactaaagaggttcaaatcccattttccctctttagtagggggtgggtggcaggggccatcctggtccggttacttaacctccctagacctccatcatttttacacatcaaatgggtaaataatacccccacctcatggggctactggaggaataaatgaattgtaatacatataagtgtctgagccagggcctgcgttcagcaggtgctcagtgagtttttattgtagttaataatagtatcctcattatttttggtagtgggaacactgatcagtaggtcatgaatacagtattatatctcagagtaacgtctggcacttagtaggttcataataaatgttagccattattgtttattattcctactattactactgctgtcgggcttagaaaccaaaagctgttgagatagagtcaccttgttcgtctccctggctctaccacatgatttccgataggatgcctgggtgaggaagaactctcaccaaggtctttaggggtgtagcctgggaatccccagtccttgggtactgcctgaccaaaggctcagggaataagtctaggaaatgctgcttgtttagattgtcttcttagatttataatgatcatatcaaaagacatgaagaggccaagaacagtggcttatgcctataatcccagcactttggggggctgagggaggaggattgtttcagcccagaaattcgagactagctgaggcaacacagtctcgaatttggtagagacccccatctctaccaaaaaaaaattagccggatgtggtggcatgtgccagtagtgccagctactttggaggctgaggcaggaggattgcttgaacccgggaggcggaggttgcagtgcaccaacatcgcaccactacactcaagcctgggtgaaagagcaagacttcatctcagaaagaaagaaaatatgtgtgtgttcttaggttttttttgtttgtttgtttgtttttgtttttgagacgatcaaaaaattcaagcgatcctcccgtctcagccacctgagtagctaggactgtacaggcgcccacgaccacacctggctgatttttgtatttttagtagagacggggtttcgccatgttggccaggctggtctggaactcctgacctcaggtgatccaccctcctgggcctcccaaagtgctgggattacaggcgtgagccactgcgcctggccggaatttgtggatatattttaaaacaactgcaccagggcgtactttctaagtcatctcttactgctgagcgaacctctctgggcttattttgtgcccagtcttttcctttgcaagttaaatagctccaactccttccctctttcttctcttctgttccatttgctaccttcccctgtccattattgctggggcatctctggacccttactggccatccacatccccccaaaatccagtgtacccagtacaagtgtgcttcctaaccctgtacacacttccccaggcctcctcctgatcctgtatcctgatactccctgctctcaacaggtacccgggctccacattcatggatcatgtgttacgctatcaggacactccaggagtcaaaatgattgtggttcttggagaggtgagttactttaaaaaaaaaaattatgattttaaaactgtaatgcatgatctcagttttcaaaaaattaaaacattttggttacatgtaacttaaagggacagtccctggtaatcccatcccctagatgctggggcctcaaggttgtcactattagtactgccatttatgtttcagagaagggagttcttaatctcccagcatcccaaactttagcgccaataagagagaagctctgctctggctggccatggtctctacctggtgggcagtggaaagctggagtaaaaaaagtgcatttttttggccaggtatggtggctcacacctgtaatcctcccagcactttgggaggctgaggcaactgggtcacttgagatcaggagttctagaccatcgtggcctacatggtgaaaccccatctctactaaaaatataaaaattagccaggcatggtggtgcacacttgtaatcccaaccactcgggaggctgaggtgggagaatcacttgaacccaggagacagaggttgcagtgaacagagataacgccactgccctccagcctgggagacagatcaagactccgtctcaaaaaaaaaaaaaaaaaagcaaaaaaaaagcgctttttaaaaaatgtgatgacttttggatagaacggttaaaaaaaattttctaaatactaaaaaatttgggagtcccataaccccatcccttgtttgcacctctgaaggcaggtctaatcctaaatcatgttatatttctagattaggaagggggagtcccagagattcctctaggagacctgctgtttgttcctttagaaatcttccttgtgtccaggctgaaattaaactccttttatttggccaaagcccgtgtcactccattttctatccagtttttacgtcaggatgggctgcactaacttggctttttctcattccccattccttggcagattgggggcactgaggaatataagatttgccggggcatcaaggagggccgcctcactaagcccatcgtctgctggtgcatcgggacgtgtgccaccatgttctcctctgaggtatggctgagatgggtcacttctgggctgggagtggggattgcaagagggggcatttgaggcgaaccaggtaatcatcttattaattcgcagctagttccttcaagaaacgtttgttacttgcttggttactacaaagtccagccagggccctgctctctgggagcttatatccagttggaggagaccaatttataagcagattaaagctacagtcaggctctgagtccctacttggcgtaggtagcaaccagctgtctggagaagttgagatggcatccctgagaaggtgatgtttgaactgtagtttaggggatgagaagggctttgctgatgaaagggaggccaaggagggagaaggacacagcctgggctcagctgggcggggcttggtgagatgttttgtgtggggagaggtggtagaaggaaaggtttgttcttgatgtgttaaaatgataaaatgtacttgaaagtgtctggcgcacctgatggtgttgaatataaacactccttgggcttctgctgtctgctaagcttctgagctatctgtcttctgctgggggatcatacgccagacttcagcccctgtgcttcggcttagagaaccctttaccaccttgaaggtggctcacgtgatgatgatgaaattgaaggaaaagccgggtacctggtgtgtgtacaagaatactctgcagtatcattaacagcaaaaactggaaacaactttttttttttttttttttttttttttttttggagacagggtctcactctgtcgcccaggctggagtgcaatggtgtgatctcggctcactgcaacctccgcctcctgggttcaaatgattctcctgcctcagcctcctgagtagctgggattatgggcgcatgccaccacacccagctaatttttgtatttttagtagagatggagttttaccatgttggtcaggctggtctcgagctcctgaccttgtgatctgcctgcctcatcctcccaaagcgctgggattacaggcgtgagccaccatgcctggcctggaaacaacttacatgcttatcaggaggggactgtcagcatggcatatccacaaactaatggaaaacagggcaggcatgcaaagaaggaggtggaacttgatatgttgatacagaaagagtttaagatacattacctgtaagaaagggcagagttcagtaaatgcttataatatccattttgtgtaaagtgtgtgtgtatgtgggttttattttttatttttccatgtaagtaaaaggggaggagaggtccagaatcctgcccatccctccagggtgagctctgcttgcacaggctttaaaatcagaccttggtagatctgtgtagccagacgtggtggcaggggcatataatgccagctactcgggaggctgaggcaggagaattgcttgaacctgggaggcggaggatgcagtgagctgagatcagatctttaaaatcagatcttggtagacctgggcaagtcatttagcctcttggtaactgtttcctgagctgtaaaatgaggatgccatgccgcaaggttgttgtatgacttaaatgaggaagtaattgtaaaggtctggcgtgcataggtcttagaaacttcttttttttcccatgccttgtcagtccgcttattccatgaagctgttcctgattctccttttttttttttttttttttttttgagacggagtctctcgcctaggctggagtgcagtggtgcgatctcagctcaccgcagcctctgcctccctggtttaagcaattctcctacttcagtctcccaagtagctgggataacagccaccacgcccggctaatttttgtatttttagtaaagacagggtttcaccatgttggccaggctagtctcgaagtcctgacctcaggtgatccacctgcctcggcctcccaaagtgctgggattacagccgtgagttaccgcacccagccgattctctttcttcttgagtgctctcccccaactccattgctctccccccaactctgtactcgcccaacagccaaaaaccagtcaccctcctccattgtttctcctggcttgctttgcattaccagcccctccccctttccaccccacctccccatccccaccatgatcaggacacttctaagagggtgagcacctcgcatttcagtatctggtggcactcatcgccccatgggtggggtgggtccttgaattattttaggtttttgtgtttttttttttttgagacggagtctcgctctgtcgcccaggctggagtgcagtggtgcagtctcggctcactgcaagctccacctccggggttcacgccattctgctgtttcagcctcccaagtagttgggattacagacgcccaccaccacactcggctaattttttttgtattcttttagtagagatggggtttcaccgttagctaggatggtctcagtctcctgacctcatgatccacccatctcggcctctcaaagtgctgggattacaggcgtgaaccactgcgcccagccctttagttttgttttttaaataattcatctcccttttagaaattttgtttttagttttgagaaatccagagttacaagaaacttaacttctttaaacctagggtttctgagtatagactctcttcttcccacccatctgccgatgcagattaaatcctacaaagaacgcattgggaactcacgctttaaggtgtctttcaacctttgcttacagagcagcagttcctaaccttttcacctttttgttctgtttgcatggtgaagagcacaggctgaggccagattgcctaggttcaagtgctaccacatgctacctgtgtgacctgggataaatcactttacccatctgtgctcccatttccttttttataggaaacgatcatagctactgagattgaatgagtaaaactcttagaaaagtgcctgaacatagtgttatgtaaacaggttagatagtactatgattactctctgcaccccatcctaagacaaggctttgcatcagatgtcttgtgggttaatttcctccatcgcttgattaaagactcagtcacgctgggcgcgctggctcatgcctgtaatcccagcagcttgggaggctgaggtgggtgggttgcttgagtccaggagttggagaccagcctggaccacatggcgaaaccctgtctctactaaaaaactacaaaaaacttttagccaggcatacacctgtggtggcatacgcctgtagtcccagctacacgggaggaggtgggagaatcacccgagcnnnnnnnnnnnnnnnnnnnnnnnnnnnnnnnnnnnnnnnnnnnnnnnnnnnnnnnnnnnnnnttccagcctggggaactggagcgagaccctgtctcgaaaaaaaaaagaaagaaagaaaagacacagacaccatttagcacttcttttttttttttttttttttttgagacggagtcttgctcttatcaccctggctggagtgcagtggcgcaatcttggctcactgcaacctcagcctcctgggcacatatctatagtcccagctattgaggaggttgaggtgggaggattacctgagcccaaggaggccaaggtgccagtgaaccgtgactgcatcactttactcctgcctgggtgacagagtgagaccctgtcacttaaaaaaaaaaaaaaaaaaaaggcggggggggcaggcgtggtggctcacacctgtaatcccagcactttgcaaggccgaggctggtggatcacctgaggttaggagttcgagaccagcctggccaacatagtgaaaccccatctctactaaaaatacaaaaattagctgggcgtggtggcaggcacctgtaatcctagctactcgggtggctgaggcaggagaatcgctggaacccaggaggcagaggaaggtgattctggagttgggctgccagtctttgtatcctgacttccatgcaccttagctgcgtgaccctgaggaagctcctgaacttctctgtgctttggtttccttgtctgtaaaatggaaatcatctattgtacctattcagtgagcttgcttgaggcttaaatgaagtgattcatgtaaagtgtttagcacactttacatgggattctatgttcactcttgggggattagcagtaaagctactttcctttgctttccaggtccagtttggccatgctggagcttgtgccaaccaggcttctgaaactgcagtagccaagaaccaggctttgaaggaagcaggagtgtttgtgccccggagctttgatgagcttggagagatcatccagtaagtggaccttggggaggatgccggcctccccctcctttccaaatccctcctgagacagcagcctctcccacacagggacatcatgtattcctggtccctctcggtgtctagcgcagctgtatggatggttcaaaatcctctttctctttggctttccttttgttttatttagtttgtggaggcagtaggtctaggctggtattaaaatgtgttgagtttctgagcctacctatttggctgggaggtggcagccatagatgagagctccacatgaaaatgtttagagagtgttatctatgattgatagagagttattagatatcctgtgatctcttcccatttctacctcttaaacctgcctggactcccggctgtgtccttccttgccatccagagattgggacatgaggtagtagggagcagagggcaggtgcagtcttggctagaacttcttttcatttagttctcagaattcagcaggtaagagtaaactaagaaacctacagtgtttgggttagatagagcattcttgggatgtcttacaggagcccaaaataagaaaatccacatggatgtcttttttttcctgcctcccaggtctgtatacgaagatctcgtggccaatggagtcattgtacctgcccaggaggtgccgcccccaaccgtgcccatggactactcctgggccagggtaggtgccttaaatgtctctaacagtgtgagcaagggagatctgtgggtctatggtggtgggtttcgcgttgatttgccttgaactcttggaaaccaggccttctgtattagtcggggatctcttagagggacagaactaataggatatatatatataaaggagagtttattaagtattaacttacatgatcacaaggtaccacaataggctgtctataagctgaggagcaaggagagccagtccgagtcccaaaactgaagaacttggagtccgatgtttgagggcaggaagcatccagcacaggagaaagatgtaggctgggaggctaggctggtctctcttcttcacatttttctgcctgctttatatttgctggaagctgattagattatgctcactacactaagggtggatctgccttccccagcccactgactcaaatgataatctcttttagcaacacctacacagacacacccaggattaatactttgtgtccctcaatccagtcaagttgacacttttggaggtcaaggtggaaggactgcttgagaccaggagttgaaggctgaagttagccatgactgtgccactgcactccagcctgggtgacagagtgagaccctgtctgtaatttaaaaaaaaaaaaaaaaaaagggctgggcctggtggctcatgcctgtaatcccagcactttgggaggccagggtgggcggatcacctgaggtcaaaagttcgagaccaggctggccaacatggtgaaaccccatctctactgaaaaaatacaaaaattagccaggcgcggtggtgggctcctgtaatcccagctactcgggaagctgaggcaggagaattgcttgaacctgggaggcagaggttgcagtgagccaagatcgtgccattgcactccagcctgggcaacaagagcgaaactccgtctcaaaaaaaaaaaaggagagagagagatagagaacatattcatgttgtttttgtaataaaaatgtaactgtaaagcattttaaaaattcatagaggataattggagaaataggattggactaaattggctgatttgcctcaactctggaaatgggaaattcaggaattcagtccccgtcccctgggtaaaagacatattgaagggctcccccatttcttttttttttttccttttttattttttatttttttgtattgatcattcttgggtgtttctcgcagagggggatttggcagggtcataggacaatagtggagggaaggtcagcagataagtgaacaaaggtctctggttttcctaggcagaggaccctggggccttccgcagtgtttgtgtccgtgggtacttgagattagggagtggtgatgactcttaaccagcatgctgccttcaagcatctgtttaacaaagcacaccttgcactgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctttctacacagacacggcaaccatccaatttctcaatcttttccccacctttccccctttctattccacacaaccgccattgtcatcatggctcgctcacaatgagctgttgggtacacctcccagacagggtggtggccgggcagaggggctcctcacttcccagtaggggcggccgggcagaggcgcccctcacctcccggacggggcggctggccgggcggggggctgacccccccacctccctcccggacggggcggctggccgggcggggggctgacccccatctccctcccggacggggtggctgccgggcgaagacgctcctcacttcccagacggggtggctgccgggcggaggggctcctcacttctcagatggggcggctgccgggcagaggggctcctcacttctcagacggggcggttgccaggcagaggatctcctcatccccacatctcagacgatgggcggccgggcagagacgctcctcacctcctagatgggatggcggccgggaagaggcgctcctcacttcctagatgggatagcggccgggcagagacgctcctcactttccagactgggcagccaggcagaggggctcctcacatcccagactatgggcggccaggcagagacgctcctcacttcccagacggggtggcggccgggcagaggctgcaatctcggcactttggaagggcaaggcaggcggccgggaggtggaggttgtagcgagctgagatcacgccactgcactccagcctgggcaccattgagcactgagtgaacgagactccgtctgcaatcccggcacctcaggaggccgaggctggcggatcactcgtggttaggagctggagaccagcccagccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggctcggcatcagagggagaccgtggggagagggagagggagaccgtggggagagggagagggagaccgtggggagagggagagggaggggggctcccccatttctttagccacgtatctcgtcccccctttttttttttttttgagacggagtttcacttttgttgctgaagctggagtgcaatggtgcgatctctgctcactgcaacctcctcctcccagattcaagcgattctcctgccttagcctcccgagtaactggggttacagacacataccaccacgcccagctaatttttgtagtttcaatagataatggggtttcaccatgttggccaggctggtctcgaactcctgacctcaagtgatccgcctgccttggtctcccaaagtgctgagattacaggcataagccactgtgccctgccccattacgttattgttatggttggcagctatatctgaagtgtatgtaagattttccctttggattcattttaccatttcttacccaggtgaccttgggctggttactgagcctctctaagcctcattttttttttttttttttttgctataacacaaggaatgcttctcctttgtgaggttaaaatgaagcaatgggctggatgcagtggctcacgcctgtaatcccagcactttgggaggccgaggcaggcggatcatgaggtcaggagattgagaccatcctggctaaaacggtgaaacctcatctctactaaaattacaaaaaattagctgggcgtggtggcaagcgcctgtagtcccagctacttgggaggctgaggcaggagaatggcatgaacctgggaggcggagcttgcagtgagctgagatcgtaccactgcactccagcctgggcgacagagcaagactgcgtctcaaaaaaaaaaaaaaaaagaagcaatggactgggtctcacgcctgtaatcccagcacttggggaggccgaggtgggagaactgcttgagcacaagagtttaagaccagcctggacagcatagcaagaccctgtctctacaaaaaaattttaaaattagccaggcgtggcggtgcgtgccttgttgccccagctactgggaggcatagctgggcagatcgcttgagcctagctaggagtttgaggctgaagtgagctatggtctcaccagtgtactccagcctgggcaacagagagactctggtccccctccagaaatgaagcaatggatatgaactgcttaggctatttcctagcccagcaaatgctcagggaaggatagaaatagagctgatagtgctgatgccaagtggtgtcatgggtcctcctgttttctatgtccaaaatgatctaatgaaagggcttttgcacttctttcttgggaaaactttgagagttgttacttggctgccagagtttacgacattcctggggtgctttggttctgagagtacacacagcagggcagtcctggaaaaatctgtggtggtcaccagggccctgcttccctcttccccatctctgcccaggagcttggtttgatccgcaaacctgcctcgttcatgaccagcatctgcgatgagcgaggacaggagctcatctacgcgggcatgcccatcactgaggtcttcaaggaagagatgggcattggcggggtcctcggcctcctctggttccagaaaaggtgagcatggagggcagaagattacagggccctgcagctcagagttaatgattttcccccaacaaaggggtgggagtggacaggcctggggagtgtgtccaagatcaatctttggggccacaggtcaattgagcggccagaggaaggacacataaactattcctaagtcttccaaggacagaaagtccagtcacatgagccactgcacccaaccaaatgcagatctcttgacagcaagatagaggttaggcaggagagaactggaaagatgtggtggcctaaggagtgtgggcctggtggagctgctgaacagatagaaagtaccttatgggctaggcgcggtggctcacgcctgtcatcccagcactttgggaggccgaggtgagtggatcacctgaggtcaggaattcaagaccagcctggccaacatggtgaaaccccatctctactaaaaatacaaaaaggtagccaggcatagtggtgcacgcctgtaatcccagctaatcaggaggctgaggcaggagaatcacttgaacccgggaggtggagtttgcagtgagccaagatcacaccattgcactccagcctgagcaacaagagcaaaaatattccgtctcaaaaaaaaaaaaaaaaaagtaccttgtgttcactttgcaaatttgtttctcccatcagcttgaatgttagaaaaaattggttttctctgcaactcccaatcttagccctcccgtgggactgacggctgggcaggggagccagtgagtatgtgattcacagagccctgggcttaatgtgatgctgggcagaaggccaggtcaatgtctttggttgtgtcatgccctcacctgcagagagatgggtcttggtcctgctttggacccttcctgggaaaagttcacgggttataacacctgagcaggtctctctctgtctgctcctgcctcccacctctccatactttgttcctgattcttagttgggaggttgaatactacaggaatgaggcatggggcctcctacactgtgaagggacagggttctcacctcctgtcagtctggcacatggagcatagccacaaatacaggtcaaatcctggtacaggcaactcatgctgaaaatcactgatcaaagaatagattcaaaactctggtttcaaactctgttttacaaacagtatttggggccgggcgcggtggctcatgcctgtatgtaatcccagcactttgggaggccgaggtgggcagatcacttgaggccaggagttcgagatagcctggccaacatagcaaaatctcgtctctactaaaaatacaaaaattagcctggcgtggtggtgcgtacctgtagtcccagctacttgggaggttgaggcaggcaaattgcttgaacctaggaggtggaggttgcagtgagccaagatcacactactgcattccagcctaggcgacagaatgagactctgtctaaagaaaagaatcaggaggttttgccttacagttgtgtggtagtattagacttggactggtagttacccttcttggatttgaatgacttgtttagggagatgggggaaagtacgagcatggccttgtcgaccatctcctggcctttgatccccccactccaggttgcctaagtactcttgccagttcattgagatgtgtctgatggtgacagctgatcacgggccagccgtctctggagcccacaacaccatcatttgtgcgcgagctgggaaagacctggtctccagcctcacctcggggctgctcaccatcgtaagtactgtcatcatgggaggtgaacagtggggacactgggccttggcctcatgctgctttgccacagcagggccctagaaggagcccctgagtgtaaaacccagtgctcagggccgttcgggacacactgggttggtttgcccagctgaaggaaactcttaaagctcaaggcaacacgcacttgtttctcctccagggggatcggtttgggggtgccttggatgcagcagccaagatgttcagtaaagcctttgacagtggcattatccccatggagtttgtgaacaagatgaagaaggaagggaagctgatcatgggcattggtcaccgagtgaagtcggtgagttgttactctcctaaaaaagtgggatggaggccaggcgcggtggcccatgcctgtaatcacagcactatgggaggccaaggcaggtggatcacttgaggtcgggagttggagaccagcctgaccaacatggagaaaccccgtctctactaaaaatacaaaaaaattagccaggcgtggtggtgcatgcctgtaatcccagctactcaggaggctgaggtaggagaattgcttgaacccgggaagtggaggttgtggtgagccgagattgtgccatggcactccagcctgggcaacaagagtgaaactccatctcaaaaaaaaaaaaaaaaaagtgggatggatctactgggtgggtggtgatagtgggggcattaatttatttgggagaatacctaagctttcaactccaacatacaaagctttggatgtgttgacagatgccaaatacaaagcagctattttttccatgttataatacagattgcccttaacagtttttctgtcgttcgcttgcagtatggaaatagcagttgaaatgagatggaaaacttggtaactttggtttcccaaatgaatcttatgggtaaaagggccaaggtcaggttgaggggacatattggtcaccttcggctagataatacctcattccgcagtaacagacaactccaaaaatctcagtggcttaccacagcaaaggtttatgtctcattcacactacatccactgagggtttgctgtgcctgttctctgccatctgtgccgaaggaacagccgccgtctgggatgtgctggcctcacgtcagcaggataacagcaatggcaggaccacgtgcaggctcttaaagccttacatgattcaccttcactcacatttcattggccaccgcaagtcaagtggttatttgtgacatcactggggcaggaagagtgacaatatcaaggcatatctgattgggagagaccagtgggaaaggacagtaaatatttgaaacagtttatatagtctcacacagggccggtcatttctatgtccttatattgtgctttggttagaaaccaaagagcaagagatgaggtcactggcagctgctcagggccttatggggacagctccttagcagatccctttaccctgggctccttggctctgtagctccagcaacctcatttatttggtcactccactggcctaggtggggagtattaacatgaaggtcatgcatgtgattcaggacaccaccttctaggcagccaaacacttggccatctcaggtgatacccagaggttgcttgatgagcaaggaccagctcagaaccaagcagggaaggtgggtggctctgagggacattccatccaggacttgcttgactttgctcagccagccccagctcctgagcatataacaacatgcctatgtacagcacagagcctctttctaagataatgctagacttgcactccacactcactcattcactctttgagctccccgctttctagaggatgtactgacccagctatctcttttgctgagggctgaagttgctttggtattcgatttggtatgtccctagatcatcttcctcccccactgacaggtggttaatttcattcacagcaggtctagagttttccctaaaattttgggaatactttgcctccccacactaaacacgtgtttgtttagtgttgaactttgtcacagcttgagtaggcacagagctggcgggggcatggctggaggctggaacctaagactcttgagttggagagtggttaactttcagacctctgctgctcaacactgtaggacctggccagttccctgaacatctcagggctcagtttcttctttgcaacttaaaagtgagaacctaccaaggttgttttgtgtcccaattgagatatgagaggacttcaaaagccagcctcatggcattagcacaattggtgccacatggaatggtacacgtgggccaggttcctgaatcgccgctgggatatgtccagttctacctacctgtaacacaagtatgaacaaacacatcccagcagtgtgtgagtgttcctctgtaccgttgggttcatttctagataaacaacccagacatgcgagtgcagatcctcaaagattacgtcaggcagcacttccctgccactcctctgctcgattatgcactggaagtagagaagattaccacctcgaaggtaacaaagaaaaaacttcctaattccctcacgttggacaagtttattggaggaaataggagccacgttacattttgattatgcagctaaaagcaaacctagttttctagaaatgttatttttgtttcataactaaatttaacagacatgcactaaatgtcaactaggtgttgggtactttgctagatgctgggaattgaactgagtcagacacagtgtcgaccagtggggctggtagaaggtttttaaatgatggtcacaattcgtagtaatggtagtgacagtggaaaattatgaagaaaaaatgagaaataatgataaatgctttgaatttttttgccttcccagaagccaaatcttatcctgaatgtagatggtctcatcggagtcgcatttgtagacatgcttagaaactgtgggtcctttactcggtgagcattgcagctgttttcttcttcattaagtttgttgatttttgttgtttcctccaaactataaaagtaatgcatactcataatagaatatttgaaaaataaggagaggtataaagaagaaaacaaaaattgcctgtaatgctaccacccagagcaccccttttcttctcattcttgggcagtagtagtactgtctgtggggaggagggcagtcacgtgagccttttaaaactacaagttgatgtgtgttgcagggaggaagctgatgaatatattgacattggagccctcaatggcatctttgtgctgggaaggagtatggggttcattggtgagtccattcgttgttgttttaagtgtttttttttaaaccccacggttcagctacaccacttacccatggggttgagtttctttttctttctttttttttttttttaattttctttttgtggttcagtttctacagaagaaatgtcatatcctcttaatcattgttcttaatctttcctttcttactttaacctttccccttatctttatcattgttcctttgttcttagaaatgattgctagcccaggaaaattttttttttttttttttttgagactgagtcttgctctgtcaccaggctggagtgcagtggcgcggtctcagctcactgcaacctctgcctcccgggttcaagcgattctcctgcctcagcctcccaagcagctgggactacaggcgcatgccaccacgcctggctaattttttgtatttttagtagagacggggtttcaccatgttagccaggatggtctcgatctcccaacctcgtgatctgcccacctcggcctcccaaagtgctgggattacaggcgtgaaccaccgtgcccggcctatttttattatttattttattttattttttccctttaaaattttgttttaatttaaaggaaaatagaatcagatccagcagctcccttgtacaaagtccgcctcatctacctatacagtggatttggactaaacttcccactgctttgtgtctactttttttgtgtgttagaaagatttcccttccttagcctcttcctctcaccaggcttatgaagctctaataaaaaagatgtgtttgcttcattttaggacactatcttgatcagaagaggctgaagcaggggctgtatcgtcatccgtgggatgatatttcatatgttcttccggaacacatgagcatgtaacagagccaggaaccctactgcagtaaactgaagacaagaactcttcccccaagaaaaagtgtacagacagctggcagtggagcctgctttatttagcaggggcctggaatgtaaacagccactggggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggagggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggctcctggcatccatatcctttgatctgtattcctttgtaactgtacttttttccagacagggtatcactctgtcgccccagggctggagtacagtggcaccatcacagctcactgcagcctccatctcctgggctcaagcagtcctcccactccagcctcccaagtagctgggactacaggagcatgccaccactccaggctaacttttgtattttttgtggagataaggttctgctgtatttcccaggctcttctggaactcatggactcaagcaatccatcctccttggcctcccaaagtgctgttacaggcgtgagccactgtgcctggcctggcctgaactgtactaacagtttcagtatatatggttttaaaaatgctcatctacggtcaggcgtggtggctcatgcctgtaatcccagcactttgggaggccgaggcgggtggatcacgaggtcagcagatcgagaccatcctggctaacacggtgaaaccccgtctctattaaaaatacaaaaacttagccaggcatggtggcgggcgcctgtagtcccagctactccggaggctgaggcaggagaatggcgtgaacccgggaggcggaggttgcagtgagccgagacccgcgccactgcactccagcctgggcgacagagcgagactccgtctcaaaaaaaaaaaaaaaaaaaattagcctggagtggtggcgggcgcctgtagtcccagctactcgggaggctgaggcacaagaatcgcttgaacccgggcggcggaggttgcaataagcgaagagcgcgccactgcactccagcctgggcgacagagcgagactccgtctcaaaaaaaaaaaaaaaaaaaattagcctggagtggtggcgggcgcctgtagtcccagctactcgggaggctgaggcacaagaatcgcttgaacccgggcggcggaggttgcaataagcgaagagcgcgccactgcactccagcctgggcgacagagcgagactccgtctcaaaaaaaaaaacaacaaaaaacccaaaacaaaacaaaaacaaaaagaaacaaaaaaaacggataacgagtaactcattcatccctcatccacttagctggggctagatcttataaaaatcctgtattgccactcaaggctttaacaacaggtgatggtctaaggtggctttactcgacaaaatgactgcagagagcatgctacccactaaggaaaggaagcgagccatactcgcaccgacgccctgggggtaggcctggggcgaagtcttctggactgggcgactgttactgacggacctcaccaaggcaggcagagctgctggaggcgaggcggcgctgctggaggcgaggcggcgcatgtgcggccggcgggcgacctggccccgccccgcgcgcactatttaatcccagaatccctctgtgtcgtaccaacagccgcatcgttccgaggctgtggaggccgggcgcagcggcgtcaagatggcggctgcggcagtggcggcggcggcggcggcggccgcggctgcatctcttcaggtactggagatggagagcatggagacggccgccgccggctcggcaggactggccgccgaggtccgaggcagcggcacggtggacttcgggcctgggccggggatctctgcaatggaggcgagcgggggcgatccgggcccagaagccgaggatttcgagtgcagctctcactgctcagagctgtcctggcggcagaacgagcagcggcgccagggcctcttctgcgacattaccctgtgcttcggcggggctggaggccgcgagttccgggcccaccgctcggtactggctgccgccaccgagtacttcacgcccctgctctcgggccagttttccgagtcccgctcgggacgggtggagatgcgcaagtggagctccgagccggggcccgaacccgacacagtggaagccgtaatcgagtacatgtacaccgggcgca

SEQ ID NO: 13005 - DNA, 9406 bp, Human
ttcatttgcatgatttaagcatatttgttctctgaacacaccagcgcccccctacccccccaaagaaaccctctgctgagaggcactgaaaccattcttggagagcctatgttcggcagacgcaataatttaagtcagcagtgaactcaccttccaacctggggagagagctctggatgtggagagagaattggggcgagtttgatgggagggggtgaatacggtaagatgtgctaccggtagggtgttctcccagcaaactggctaagaaagaaggtgaagtgttggctgggccaggcagactggggagcaggaagtgaaaggctgcagttataaagcgctgcttaaggcggtctctcctggcgcctctgaacttgatcagatgttctatttcctacagagagatggcggccaggctgtgaggctgcctcaaggcgcagactttggggcttggcccagctagggatgtgacaatcacagccatctttctctctgccttttctttccactctcttctgcattctttgcaaatgccttgcaggacacaaaaatgagtgaatttatagccttgtctgaacctggtcattatgtcagaaagaccttgcaacagacagaaggcgagaggactttcacacacacccctggaagtaaatccttaaggggtaagcagtccctgaggtcactacatgctttaccttctccgggtaggagtagaagagagtaaagccttggctgttcagaggaaagaaaattccatgtcacagtccccattcagcatcagcaacccccaacacgacttttgcatttgaaaatgttgagaattcaaagctgattagcctagtgatttggaaaccaccctgatactgtgtgtgtctagtgtgtttattatgtgtttagtgtgttgtgtgcatgttttgcgtacactggctaaaagtgttctttgcatgttttgtatttgtgggtatgctcgctgttatgtgtatttgctctgttgtgtttagttgtgtttctgtgtttgctgtgttgtgcgtagtttatgttactgtgttgtatgtgcttactttgttgtgttgtgtgcgtatttcatatgtcgtgtttgtttcctgtggtgcgcttgtgtttactgtgttgtgtgcttgtttcctactgtgtgcttgggtttactgcgttgtatatgtttgctgtgtcgtgcccggtgtgtaattcgggaagtgggcagcggcgagtacggccgctgctcacaaactaaagggtcaacgcttggcgcagacggaagtaacggagatcagctctaattgtaatcgtttcttctcctttgggtctcggacagctgccgacaggttgggggcacaaacggcgaactatcccggcctgggtcccggcctcgaggccatcagaactcgcagtgattggaggtggacgcagcggctggaccgggagcgcgaaactgctgcgctctccccaggatctgcgccctgcagctacagaggggacatgttctcaaggtggtgaggcagcgggggcccaagcaggactggacgttgagcgccgcgtctcctccatcggcgcagcagtgggaccgatcctcgcggggcaaagagcccgcgaggggtgggggaaagcccgcgagagtcccggcggcgtcccgccgtttgccggctggagcctggccccagttccccgcagccactcaagcccggtggagcccactcgcggccgcccggcagccgccgcctcacctgccaggcacccggcggctgcccaatcagcgggggtcgctcggccgtggctgccatgttctccgctccgcgctgccaatcagcctcgcggcggccaatgggcagtccggccggaggtcaggtgaccgcgggccagctggctccccattggcgcgcgcctcgcggcctcccgctcggtttatgtgcgaggagtgagtgattgactttatcagtccaaggacattactctggaggcgaagaggctgggactcgcgcggcgagcggcaagcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtaagggaaaaaagcaggcgggcgtgggttccactggcgataccccgtcacgcagcggacttagagcgcgagggagagaggtggcggccagggaaaggggcgacgccccgcaacggccgctcgaaaaagaagcgctgtcagtgaccatccacccctagccctccccgtcccgtggcgcctttgccgagttctaacttcccgggcagactgctctgcggtctcaggaactaattgggaccttctcgcgcccaggaacaaactggcgccgcctctttttgtctccctttctgggttaccgtgaagggactccgaatgtgttgagagcatattgcttacaagcgacttagctctcggcacacattcgtggaaggcaaccatacaaatgctaatgaaaactaactttcggttacttccgcttttttttacacttgattggcacatctcctaattaaatgactgatacttttgtcaaactatttttatttggagttccaggttcaattcagtcctccgggaggaaagctaaagcagtttcgtggtttgttcagaacatcttgtaaaactgtctggagccccctggatcgatcgatctatctatctatctatctatctatctatctatctatctatctatatttttttcctcaaacattaactacgactacccaggctttttaatatcgggcttagccaaaccgctgcatttgaaagaggcaaataaaaaggtacaaagaggctgaacgggattgtcctgtccggggcccattgtcccgccgggctcggttacattgctgaggtggtggcggaacgtggccgcgcattgggagccctgggtcgggtagggtggaaacacaacttaggggaaacttcggaggagccaggggctttccctccttgcaagaacaaagacatggtcaggttttgggccggccccgccccacccccacccccaccccgaccaccactcccaaacccagcgggctcaacctacgctcttcatttctctccagggaaaatagatgctgcagcagcccccagtccgcgctccctttccgggaagaccgccgggagctcagtctcctgctgcttgcctctgagaaactccggcgctgaccgtattttaccccccttgggtttttgccttttgcaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggtaattacctctttattagcggtcggcggtttgtaaacactcggcccgacgccgggccgcggaacggaagcgcccgcgctgccaaccctctgtcttccacgttaaatccgatttgctccagcagtgacaccttgaacccattttggggaccgggcgggggtgggggtgagggggtgggcgggagtgagcaaagttgggagggggaggaagcggagggaacaatcggttgtttactgggaagctctagccgagctcgcctgggcttgcggggctgccgtggccgcctcttcccgactcagcccgcggtgggaaccgagagtagccgcgccgaacccgagggtgggtggttcattcgctctttggcttcggataaaacaatagggccgaggagtgcaatctgattcccacacatttgtctgcgacttcgcagcgctcagggcccctgtgccaccttctctgtacctgctttctcaagccgaaacgggcttggtgaaacctgggcccggagttagtattttataggacctcacagtgtactgcttacctcactccatccgcggagaaagcatttttgaagtggcatgaccaaaacggaatgctttattccttttccgtaacaccagtcttaggagcaaaactggtttttggcgaacatctccgggttttctagacatcggtaatacggattttttttaagcagcatttttcttttaagtgggtcactgggcggtcttgttgttacagtgctcgaattctgctcttgtttttgcttgcacattgccagttggaattatattcattataatatatacatgttaattttaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgcagcagttctgaaatgatgctatgggaaaaaaattgcaaaatatgtatttttaaagttcatgatttgtaggcaaagatgttaagagcattgtttccattaaaatcaataacaatgaaaaacggttgtttgctttgtgataaaatgttaacaatccatttaatcttcagtgaagcaactcatttggacaaacagttcttttacagtggttatatggaaaagaaattgattgctattttggggggctggagtgggtagagtattgagaccttttttattagggtgctgtttgttattgagagcccaatctctgcatgaataacagaaaggtggacataaggaattgtaaagtatttagaatgtattgaataggcttaagtacctcctttaaggggcaatgctctaggtttttggtggcagtcaatttggtattatatatgatcattttcaattctagaattttgtttattgttctttttgaagaaataaagtcttggcacatcttatttatgttataacatttttgtatttggtgcctgattttttttcatgttcaaataaatcaatctaaaattgaaatgcttacagaacttctgatgattaaaagaaactttgattctgtgaatgcggttgaagcagtctatttaagttatctactgatctttgtcaacagacaattagttattgacagtttctaattgcaaattgctttggaggctattttttgttagtggagaataatggggtcttttgcattttcttccaccaatatccaagcctgaatgccatgaacagagattgggatgactacacatgtgatgagcaggtaacctggtcagtctatcactcccaacccagacattccgatcttgaccttgacattgagggtgctggaccagattcctatttcaggctttttccttcacctcaaaccagagaccattttaaatgctcagcaagttctcagaaagtatatattcataagactggctctaagtgtgttccattgtgaaatctaaatagtgtatttttcttctgaactgtacaatgaacttccataatttaccactttctccatgagttccctcccccaccctcaatctaacctaactttacgtggaagtagagccatgggttggatacaggattcaaccaaaaacctgcctccctttcaattaaatgtattaaatatctcctgagacaaagagcagtttgatcttttcttagttacctgaaattattctaccataaaattttacaggaaagtacttgagggtcctaagaggggaagatatcaattaaatgaaaaacaattatgataaccaatattaggagaatataaaagttttgcccctgtacatgattacctctaatttgggtgtagcatggtatttctcaaaatcacgtcctccacccttgtcatctgtggtaaagaaaactccttattttgatagaaagcttttcacagatttcccccctataatctggctctgggagtgcacatttacactcttgaatattcagtaaacaaccttagagagtaagtaccccccccaaaaaaaaaaaaaaaaaaaaaaaccaaacaaaccaaaatcatcaatgctcaagcccgaggcatgggccaggctcttaggaatcaacttgttactttccctcttgcaccttgtaagatctttgttcaaagtccctttttcaaaatgagtgattttgcataagattcccactgttaggcaaaagggaggtggctatttccacgcaagacagaagtttggccttcatccagctttagaaggttaaagatcaggacagggtccacgctaagcaggccggtcgatctaaattactaaagttggacatgagtgagcaaagacctccgctcacaaagcatcccaggaaagttggagtgttcaggacttcctcgctcctcccccttctcccttctccccgcctgatgtctctgcctcttcgccctggctctctctcccccttcttaaaaaactccct

SEQ ID NO: 13006 - DNA, 41243 bp, Human
ctcgtgaattacaatcactgtaactcagatatttagaatggtacattacacctatttggtactcataaataatggatggatggatggatggatggatggatggatggatggatggatggatgaacaggtaggtaaatagatggatacatgagtggatggatggatggatggatggatggatggatggatgaatggatagatggatggatgaacaggtaggtaaatggatgaatacatgagtggatggatggatggatggatggatggatggatggatggatggatggatagatggatgagtggatggatggatgggtggatatatggatggatggatggatagatggataaatgggtaaatggactgatatgtggatggatggatggatggatggatggatggatgagtggatagatggaggggtggatggatggatgaatggatggatgagtggatgggggatggatagatggatgggtaggtgggtgtgtgtatggatggatggatagatggatggatgggtaaatggactgatatgtggatggatggatgacgaatggatgaattgatggatgcatgcatgcatgagtggatagatggtgggtgggtggatggatgagtggatgggggatggatggatggatgggtaggtgggtatgtgtatggatggatggatagatggatggatgagtaaatggactgatatgtggatggatggatgcatgagtggatggatggatgagtggatagatggaggggtgggtggatgggtgaacggatggatgagtggatgggggatggatggatgcatggatggatggatgggtaggtgggtgtgtgtatggatggatggatagatggatggatgggtaaatggactgttatgtggatggatggatgaatggatagagagatagatggatgactggtattacaggaatatgtgagtgaatcctgttttctgtagataagtaatagagtttggagaggaaactaactaaatgatatttatttaaacctaacactctaacttgaaagcaaaatggattcattgcccttcgtgacagaaatgtggtattttttggagaaagctatgagatgctggtatacaacatgaaatatctcaatcccacttcagatttctaattgtttctgcttccagaggagaagccaagtcaaaatgtcctgaataagcagttctctattgtgagaggcctcttgtggaatctgggattgaaacaattctaaatgccccacttctttcatgcatgaattgcaaaaagatgtggcaagttttgtttctaccaagaaaactaaaaacaccttttgtcaaataaatgctccttgcatatttaacttatgcaccagtggccttttaaacagtcaatgtcccatcaaggtgcctgcacatctgggctctccgggagcagccatggcagcacccgggaagaaacgctgatgtggctgctctgcatgctcagatgacttcatcgggaagcctgggtgcattttacgctgggtgccaaatctcgagtaactgaggaattcccagagccttctgaaacacagagctgcaataaggctgctccatccaggttagctccatcctaggccaagggctttatgaggactgcacatattctgtgggttttataggagacagctaggtcaagacccctcagagaaagctgctttgtccggtgctcagctttgcacaggcccgtattcatatctcattgttgtttgcaggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcgaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgtactaattgcatgcgaacttctttaatttgtcgtttttggtttggttgcccccaccacgtcagtgtgctgtgttgccggcatttttgtggcctggtgacacagctggcaggtaagtgtgagcacccgagctcctgcccttctgtgtgggaaggtcacagttgctcactcatctgcttttactacacagagacattttactgtcttctctcacctgacctgtgcttctgtgtgggaaggtcacagttgctcactcatctgcttttactacacagagacattttactgtcttctctcccctgacagttcggtgttctggtctttctatggtgactattctgattctgcctgaagtttcttgtgtttctctcaaagcatcatcccgcaaatgttagggagggtggacgctgagcagatcccactggcaggtgctgtcatggacacagcccgccccaccagcatctcctgaatgaacgtgcacatgggtgccagtgcccacagggccccccgggagctcacacacaacgggggtcatgggaacctcgagacactgaaatgaggggatggtgctggctctctgaaagatgataatgagtgtatgagatgaagctgaaacttggggtctttgagaaattagaaacaagagtaaagataagtgattggcttggatgcggtcctgcctttcatgtcccatcagaccctcgtcttaactcatctcctccctttaaactcatttgcattttaaagcattcatttctctcatcgttgattttcctttgataaaaagtctggacatttgataacaggcaattctgatcggtgaattaggagcttggcttgacatctgagggaatagatcatccttagaaaaaaacacacaatagcactcgtgaaaatcacttagatattgatacaaatttaagaagtgtggacatttcctatcaaaccctgattcaatgtttttaaaagttttttcctttatggctatcagcacactcttaatgctctgaaatcatcctacttcataaaaacgtagtaaaaaagaagaaacagctaaagaacactgaactctcttgagggagccccatacaagcgggcttagcacacacaatttctcctaagaggctattcttgcctttcgtcttctctggcccttgcatttgtcctccctcttcctggctctgggagtggcaggcagccggggttacaggttgcatttcctgaaaaccatcagtgggatgtcttatggctaccccagccacctgccttccccatgagtagacggggagtcagtagaggggcttcacgccagcccaccagagccacgagaacatgcctcacagtgatgatcttctttgtgaagaagagccattgtaggagatggagggaaaattaatggaaagttcttcgcttgttggccctgtacatagcgtacacttgctcacgctcatggacaccagctgatgggagtcactgcttatgaggacagccaagtctcatcagcacagcaactcccgcaggcttatccacggagacctcctctaaagtgaatactcaatttacttacctttaatatcatgaattaaagtcaccagaaattcctgctaacctagaaatagcctctctcatgcagggagaatccatcaggagacgtacagctaagcacacactcaccacagatttgcctctgaaaaccccggtgtgttcactttccataatacttctagaatgctcccacattcttcagtgtcggaactactctattctcatgcatactcagctgctaacctggttaaaagaatccatttcatctgcagccaatacatctcctgaaacctattacgctgatttcatctcttgaccactataagtctcctctttctcttctctctctgtcttcattttgctgtagctgatagtcaagaaatagacatttcttgcagggcacttaccttggtcctataataatagtctttcaactgcagccctcaaagttcattgatatagcagatactctcgtgtaactgacaaagataatacattaagttaggagctaatgctacttaggaagatttgtagccgcagagctcaggtgaatgcgtagctcctgctcctgctgaggaagattaacttcctgcttatgttaaattcctaaccttcaccagtaccaaggaataatgtcagcaagaaaatcaactttaagtaattggctaaagtgattttgaacactattgctcctaaaaattatttcctcatgctctgcagaaaatcggaaaaggtccgtcctcggttcactgaaccttcacagagcagaaaaagtttcaacctgtaaatccaatgcagaagataacacacttgctataaaagaaaaaatacaactctgcaagtaaagtggaatgtaaaatttatccattccatggtagacgtcaaaaaacccttttagtgcactttgctccagactgggaaaggccttctgcactggatcctagaaatctttcacagctggtgcctgctgccatattaagaactcttggtcccattgtttgatacagggcctcagaatagactttggaggagagaattcttccctaaactttccttttgctctcgatttcctgagtccttcagggcgcatgcctgccctctgacctcccatcacctcttgctcttccttccatcatccatcatctgcacatgccttcttctctccctgtcgtccttcatcctccaccccccgctcactcctcctcactctgggctcttgccaagccagctctagaggagatttgctggaggactttggggcattgccggcggcgcccacccggactcacgcagcccactctgtgtcccccggcaggtaccctggctaaagccgggccggagccctctgccctctcatgcccgcagccagcctgggctgtgcaacatgtacaaggtaagacgccggcgggtcctcacccatcggggccaggggtgacctgccgtttcctgagctctcagccactgtccctcggggcaggtagtgtcactgccaggggcccacccccagcctccggggcatctgtgaggccgtgaaagcagggaggcaggcctcccccagggaaaagcagctgcaggaagagacaaatgcccaagaggggcatggaggacctgcctttgaatccttggagggaatcctctgcaaagggtatggctgtcagctcaggatgatgggcagccttggtgagagtctgcctcactttgccgaggcctgaagtgcgtggaggggcccgggagtggctctggtattgagggctggcctggtctatggccacgtgcatacccgagtttgctttgaaaactagtgcctagcagacatttagtactcactaaacatgggttgaattgagctctaaacgatgagtgtccttgggacgtctggtctctctgggctctgtcctcacctgagctcagctgggctctgcataggaagtgggctatcgctgtggcctgtcctcttctccttgtgtggctgccacggcttctcaaagcacataggtgccaggagcactcacaaagaagaggacagccaggaggagaaggggaaggggacaagcccagagctggcactgccgtcaccgtgagcagggctgccgtttgcacactaggagcggtcaccacaaacctgcatccaccaggcccccctccagacccaggccaccaccgtctgcaccgtggcacctggctttttaagcatgggaatgtgcaaaagattggaaacagctgctcaagtacctaaatagcgagaacatttcacagctatgctcaatggcgcaccaagtttgagggagagctggggtacccctcttcagaggccggcaaggggggaccatttacactcagcaaggagcacaggagcacgggggacaggacgcctgcggatgccaaaacttggaggccctgaaggggaagcgtccgccaggtgcggctgcatgtcagacatcatgctagtgcctggctgtccagggctgcaccgccgcgggccaggagtaggtttatgaggaatgaggatgtgcctgctggccccgggatggccagtccaggcagtggctgaaagtgcagcagaggaagccagggcttgggggcagaagggccctgggggagccggggccagacaagggccaggtgagagccccaaggtggtcgtgggacttggagtgactggcggctgcggctggggagaaggatttcttcctgaagccacaggggtggaggcaaccatgcaccctgagggggtctcagtggtttggaagcccatcctgagagtctgtgtttaacttgaatcgtgtcctggttgtgaagccgcacttggttttcgagggctctcttggtgatggaaaacaccaccactacccgcaggtagtttctgagggtcccccgtccttctgggaggcctcttctctggggtgcactggggctgtggccacctgggcttcactgagaccaagatggggctgcatgcaccagcccctgcctgggaggcaccgaccctgccggccccgccctggagagcagtgctggcgagaaggaggattttcactgtgtgtgcaggaatatctgatgtgtgggaggggtgagctaagggtggcacagcacccagtgtgtgacgcgctggcaggtagcggcttggcccctaccccgttccctgctccacgagaggcacgctgtcctcagtggaccctggccacagagagatggagcctctgccagaaaccccgtgtagccaagcagagtggagaggatgagagtcccaggctttggtatccagatcatagtaagaaactcaacagaatgcttcattcctcttctaaaaaaaattatttagcagggaaaagcagcccttctgttctccacagtttcatcctagacaggttttgcatatacctttaaaatcctggccaaagataagtaaatcctctacacaacgctttgtccacgtggctgcctgaggctcacactccaggacacacgcggaaaggtggttaaaagtctgcaggcttccaggactcagctccttgtgctcagcacttgtgcacttgtggacaccccattctggtccagataggaaaagcagtaggggtgtgtgtgcgtgtgtgtttgtgtgggggtgtgtgtggtatttacatgtctatggaatgaagggaaaatgaagataagcgtaagttgaaactaaagcctgggcaggctgtgtgggctcccagcgttgctcttaatggacagagaaccctcccagggatgcgtgctagaggcctcaacttctccctccagccccctgagcaggggccggcgatgcctggctcacagaggccatctctgcaggaggtgcacacagagggtgcaggcgggctggtctgagagcccccaggggtgcccctgcccgaagacggtggcaatcccacgccatttgcatattgagtggaagaataagcgaggagcttccctctctcgtccctgagaaggagcttttgagttagaatgccttcctccggtactttgggatgctttattattgcaagaaagtggctgtgagggcaccagccacggaagaaggaattgcaaggccggaggcactaaatggttttaaaatacagagggattttaaaatgcagggattccatgacaaaggacccttgaagtcagctcccaacggagacagaagcagctgggtggaaggctcaggctgagcagtgccaggaaccagcagagtcggaaccaagaactccctgccctgcggctgagaaacgcgagctgaacagagggcctccgcctgggtccacctcaccctgtgtcctctccctccctgtctctctgtctgtctacttccccctctctccctccctcttcgtgtctctctcttcctcttccctctctctctctgtgcaaacacaccaggagggtaagggagacaccccagctatgaaataggcaacaaggcaaagaacagcctggctcccgtgctgcggtgccccctccagcacgggaccctgctccgagctccctgactcccagagacaccggtgctctcggggctgacagggctcttttctttgaggactggaaggcaggcagcgggagcacagtaggggaatattgcgacatgcgagaacccaaaagcaagctggggaagcaaggattctgaggggagaggagcaacacgcacgatggggaatggctgcgtgggaagtggacccactgttctctgcagttcctctgtctgctcagcccctgcctgcccgcctgcctgtccatcccgtgctgcaggtccctggaacccggtgctgggcctgcactggaggctggagtgagggcgccagtggtgcagctggaaaggtggccccgggcagggcggctcctctcggccccgccaacggtgccagctcctccaagctccaggctcggcctggggcccaggacactgacctgagcaggaaggggctgctctgggcttccagcagccactgtctccgagtcctcggacgtcctttctgcctctttctcacagacccttgtgctcctggcctgacttggaggacactgtccacccctcagccttggcgcccatggaggcttctggaaagacctgccctgcctctgaatccaccatcacccagcacactggcgtttaggaagcaaagcattttgtgccatgggaaagcacaggaggaagaaccaaaaatgcttggctcaggtctcatggcactgcgtcatagccgtggacctggggcaggtgtctgtcttctctgagcttccttccctctcctgtaaaacagcaatggtggcaaaagcgtcacctgtcctgcagatgctttggaacgttgtgctgatcaagcaagaaaagcaatgcaaaggccccacaggagcctcgtcctctgaaaacattggtgtcatcataaccctgccccagtgccactccacactcgtgctattctggaagaggcctggccaccctcagagctgctggggagggcagtgctggctctaaaagctctgctggccctggcccctctgcccctcaaggctgtagctttgggtcctctgtgtttctgtgctggggccttagtttccgaaactgtaaaatgaaaatcagagcggtgaacctcatatcaatccctgctcccaccattctcagaaggaaatggtaatcaagcctcaaaagccccatggttggggcagctggactagaacttcactctctggccatcagctccgagtcatctgcgtttgggaaacagacgtctctgagcctcccccgtgggagaggagtccctcttgccatgaggaagaggaattttttccgtgggtctctcgggacaaggaacagagaccctgcttcccggagctgtggtcatgaagggtgtgctcctgcatggagacgccatggcaacatggtacctgggggcgggctgccatcaaggtgccaaccagagaggccatggcacagccacccggcggaaagcacacaaccattttaaggacttcctcgccaatctgacagcagctttcgcctctgacaggtgccgtttgtccacctccgttgcttctccctcttcggcacactcaccaggatgaggaagctggaacccggcgtcaaagctcttcctctttgaggttaaacccagatcagaaaaatgcagccactgaaagggtttacttaatggcagaagcacaggctgccgaactttgatttgttgtatccttctgtgcccagagccagagccccaatgtgggtcccacaaggtttcgtgccaagaggtctctgataccgacccctgtatcaccagcggacagaggcaaaggcccccaaaggaggccacgggagcttcacttccccatgaaacatgggagagaaaacacaaccagatatgccccgaccacatctacaaaagcagtatctgaatctctgcatccagcctcacagtttgctaagaggagaaacgctgatccttcctgtcatggggcaaagcaacaacctcccgagtagggcaccagaagggaaaccacacacacaagccacgggcgccagcggccgccaccctgcagcgctctcattcccagtatctgcaaggagctgcatcctctgcaaggagctgaggtaacagcctcaggttacctgaaatctgcatcagaacgaaaggcttgtctgtgaattttttcagacatagagaaaagcccgctattctggatggtgcacagctttctgtaaagaaagtaaatgcccgtgactttcattaactcgtgcgagccgatgattcaggaataaacataatcttcaacccggcaaagggcaaaaacacaggaaaaactgcatctgtcattcagacagaaaagaattctctccaaactgcaaaatctaaaatgccctgatcttgcttttaaaaaaaaatctaacatactctcctgaggcatggtaggagctgtttgaccagaaatcgaataatagcttccttgcggcggggagtggggggggacacatatatatatatgtgctttttttcagaggaagctattatttaactagtattgtaactagtatttaactagtattgaaaagagaaccacagtgttctgtgatttctcggaattgccagagcattatgaagtcagggggatggagagtaagaaaaggggagacagcatggcccaccatttacagtcggatgtgtcgtctcatctccagccttgcagactttgacacacatgttctgtccaataatactgatttcactggtgcctgttttagctgctgggccagtttccatgggaaacagataccatgaccctaagcttcagatagtttgcagggggtctgctgtttcccactcccaccggtttttaggtagaaaatacgcacgcattgaaacagaagatccctggagagaaaggaagatgctgcgtaggtgactgtctcctttgagcatctttaaggaggatcatttaatcacttaaacaaggtttctggggatgtcaaggatctctgtgagccacaaaagaagtgtgatgtagggaaaatggcagaaaaggtgcatctatttcatctagaactacattttacgattcctaattcaaaaaatatactgaagaagcatattatcactttcacaagaaaaaaattatatcaaatatacctctgttctttcttatcatggcagctcagaaaaacagtgacaccactatcttctgtggttctgaacaggccacacagattcatccctgagctctctgtctctgagttttttcagattaacttctgagctctctggtatctgcacttcctgagagtgccagaagaatcaaatattactctgggaggtaaaaagagtaaaaagcaaattcattcgcccttcactctcagggccactgctgaaaccgtcgaaatgaacagcagaggtcccgaatgccgctttgtggatgtgtgcaaaaacccgccacgtgcaacctggaaattaaaggaataaggaccaggagatatgttggttggttggttttcagtcacatagacaaaataggacagtccagacgatgccatctgtcagtcctgaggcatcactctccactgaaaggaggaactgatgggccctttgttttaattacatagaaatgcgtcttttaaaatgacagagaaaattgaaaaatctcatctcattaactacactggcatttattgtatccatcagtgtttactagaaaattagttcccaattattttggtaaacagcagcaattgaagcttccctcattccctagacactaactggcatatgtcattgactttgtctacagatactagtttatttttctcgtctgtgagcacactgttagttctagccaatagcttcataacttactacaaggtaagtctacaaattcttgtaataaaatacaatttaaaaatccgttcttctcccttcccttttccctttctcctatgactagccagtgaatttccccataggccgctgactttcaggtgggtaacgtgagcctctcatcctacgttcactccacaagagtctcgcttggcatgcagtctaaagttcaagccctagacagctagcagcctctgcgagcagctccctgaacctctgtgcatctcaatattcaaatctgtaaaacgagtggtgacgtgggagcagtgctgaatgatatttttggtttacgatcacacctcgtgttttaaaaccaagacgccttgctttctctattctggctttgcattgaatccttttggggacacagggaaaacatgtacattcctagaacttggaccacttacttgattaagacaatgcccataaggaaatccctactgcatttagccactggatggtagatgctgctctctgggcatattgagatacattaacaaagagacatttttctaacgtgtcattctgcaatgacatcatggaccacacgacaaagggaagaacaggtgcttgctaaggctccacagccgagtgctgatgggtgcatctctgtagcaaaggccctaatgggaggcccaggtggagagagccaggtgcatgggaccctgccgtggttgcctccatgagaacgcaccattccaggtttacgagaggccagaggtctccaggcggcaactccacatggagccaacttcctgtgctccatcccatcaggtgggaaaatggggcagatgttatcaacactcagttatttgacccacttccccaaaactggcacataatcaatacaaatggggaaacaaaatgtactgtgttaatatgtgtgatctgaaaggaggcagatcatctctaatgatagttagaagatgttccaacacgtggctgtgtcagtaagaacactatcatgaggggagggtgtagatgagcaggaactttcttacaggctttttttcttttcttttttttgagatgaagtctcactttgtcacccaggctggagtgcagtggcttgatctcggctcactgcaacctccgcctcccaggttcaggtgattctcctgcctcagcctcccaagtagctgggattacaggtgtccgccaccacgcccagctaattctcgtattttagtagagagggggttttgccacgttggccagggaggtctcaaactcctgatctcaggtgatccacccgccttggcctcccaaagttctgggattacaggtgtgagccaccgtgcctggcctcttacgggcattttcttaagtaagtcatccaagttctaggaatgcacacttctccttgtgtctccaaaaggattccatgtgaaataggagtagagacctccaatacctcgcccatctgttaaaactgcagcgtgggtaccctggcaggctcattagctgccgtggactgctgcggagtggctggagactgtcaggctacgctgggccgatcttctgggtaggtgtatctacacccgtgtatctagtgatttactctcctctggaagagaaacgcgggcacaccccagcctgggatggcaggcgaggaacccccaagccccagccctgcatggtcccacctggaggctgagatgagcttcagggtccgggacagtgagcggggaccctatgagtgggaaccgggtgggcggggacccggtgggcggggaccaggtgagtggggaccgggtgggcagggacccggacaggctcagaaccataaactcactaggtcttcacgtattgaccttatgatcgttgattcagggaagcaattaaattcctctctcagacaaagaactaagagcttgaactctttttttaccaactccaggcacccgtgaatattaatcttttttcaaattaattgtaaacatttcttctgagagggagtgactccatcaacgtatctcctttaataaaatccgagtggaaatgatgctgccaagaaatgccttggccctgcagccgctgatcttcagatgcatcgggcggcaactcatctgttactgcttcccagtttcagaacgcccagctccccaggccttaaaacaaattggaaagcaggggaataaaaaaacaaaaacaaaaacaaaaaaaacaacaacaaccctcttcctgatttctggagagaaacaggcggcgggcagcagcctgggtgctgtgcgcaggagctccgcctgctggtgatgggtatcatcgcaggttgaggaaaataattcttcaaaaatcatgcaatcaaacagcctaatggaaaaaggaatttcttttacaaataaatggccacccgtggtcttcctcccgtgattttaaaaacttttcagcaagttatttttatttaccaagcaaacgtttgtcattttgttgttgttgttgctctatgaatcgtgatgaaaagctctactgataggaagaggccccaacactgttgagtaaaacaagaaaactcagatgaagaaaacagtgtgtctagtatgatcacttttaacggcatttgcatattttgtctgtgtttttgcacaaagccagatctaacaatgtgctcatcaaagtgtaaaccagggtcatccttcggtggtagaatttttccacaaactttcttatttcatgggatatcttcatatgagcatgtattatttttctaaacaatagaaaatattagtttttaaaaatcaggtctttttttaattcttcagctgtcccaggtattcagctccaaattagccaaaaattttgcagaaatgtcctggcctcatctctagctggcaaaacacaggttgcaggatgccccccagcatctgagtctacatcacaaggtgcggccctgtgtccatttcttcttttatagtgcaactgacatcctagctcttcctcgcttttaatcacccacaaagaaagtgcagtacttgaaacaggttggggatggcccagaagacacaaatctcaatgaataaccaaaaatgttcacagttttggctttttttaaaccttagtgagtacaactaaaagtatatcagggaattactaaatgtgtgtcctaaaaactaagcaggccatgtgtggtggctcacggtggctcacacctgtaatcccagcactttgggaggccaaggtgggtggattgcttgaggccaggagttcaagaccagcctgggcaacatggtgaaactcgtctccactgaacaaaaattagccaggtatggtggtgcatgcctgtaatcccagctacttgggaggctgaggtatgagaatcgcttgaacccaggagcgaggttgcagtgagccaagatcacgctactgcatttcagcctggacaacagagtgagactgtctcaaaaaaaaaaaaaatacctaaactaaacagcaggaaccctttctgtcctagagagctgaagttcagctctcagttcactttcaggatgaccttatacgtcacaagtgttcctggggccgcagctcagagcttctgatggggttgacgggggaagcggaggttgcgaggctggcccaggccctcagcggtctcctccgggaaggcttgagggtgcgccacccgcttcagcgtcccccatggctggtctgtgaagtgacttgagttcaccttcaccccctaagtgccccacccagcttgcgtcttcccctcacctcctcccgttgtttctttaaggcctagcatcttctcccagctcctcccacctaggaacaggtaacctgtttatcataaggtgtgacagaatgataagtgcccactccccataaattgaaaaaccccccaaaacactgctcttaaacccccaaaacactgctcttaaacccccaaaacactgctcttaaaccccccaaaacactgctcttaaaatccgctgacaccttgcatctatcacatttcctgcaccactggaagccgtggagtaggtggtgcgtttctacaattgagctgagccgggtttgtggtgagcaaggggctgtggggtcaacgaggaaggagccaaggggctgcatgaaaggactgcagacccagatcatggccctgcaaccagccacccacaggagagcggggcagacacagggctgtacttctcagccaagccaccctaacactgtgtgtacgtctcatctcataaatgtaaatgcacgtcgaccttcaaaagagcagcaatgtcccgatgccgcgtgctgctattccttcaaagaataagggaacctcggcagcttcacttcaggctgttggggaaaggagggtggggcgttcgggcatctcttctgcgagtcacccgagggcatgggaatgtcatggccaaatcagatcagcgtggctccggggagcctgggtcacttcaaaggtgactgagaactagagccagaaggtggaaacaacccagaagtccccggaagggtgaatggatgagcagaaagcaatccgcgcatacggtgccgtggatgtcgttcagcctaacggtggaaggggattctgacaggggccgcagcacggggcgcctggagggcactgcggtaagtgcaccaagccgtccgcagagaacagacgctgcaggctccatgcacaggaggcccctcaggtggcccgttcatagagaagaagtgacttgaacgctggggccagggatggagagtgagtgtttcatgggggccaggtttcagttcgggaagctggagagggtgtggagatggatggcggtgatgctggtacaacagtgcgaatgtgatgtgtgccactgaattgcacacttaaaaattgttagaatggtaagttttatgtgtgtttcaccacaataaaaaaattactttttaaaaagtggctcaggccgggcgtggtggctcacgcctgtaatcccagcactttgggaggccgaggcgggcggatcacgaggtcaggagatcgagaccatcctggctaacacagtgaaaccccgtctctactaaaaatacaaaaaaatcagccgggcgtggtggcggagcctctagtcccagctgctcgggaggctgaggcaggagaatggcgtgaacccgggaggcggagcttgcagtgagccgaggtcgcgccaccgcactccagcctgggcgacagagcgagactccgtctcaaaaaaaaaaaaagtggctcagatgcagcatccgtccacgcgggccacgcagtcccctgcccgaggtcgtcaccagcctgacaccgaggcgtgctcctgggcttttcttcccgtgctcagcacaaaagctctttaggaacataaaccaaaacccaggtctggagtctccggaaacaaccaatataaaagctcaccagaggctgatctcacacgctttgccgcttttccaaggtggcttctcagtaaaattctagaaccgaagacttggagactctctgtttcagtcccatcatttcacccgcgaggaaccagaagccccagggccccaggggactcgctgaaggccacacaggtggcgtcaggcccgggctggagcttcccagctccctgcagcaagctcttttcacaaggctgccatggaaggcttttgttcctctggtcactttctatttgctgagctccaccttgtgagtcaaatgccgggagctttggggatcccacagaagtttttcttttttcctctgaaagattaaaatctagctggagagggaagatgcttgcagaaagctaaaaaggacaatccaatgccagatgagggttgcagccaaaagaggctatattttcccaaaacagagacatttggagggggaggacgctctaggcaaaggtcggggaggcagtaggagccccgaggcggaaggagaggccaacactttcaggggagacctgagactgccaatcagaaaatttgcacagtgatacgatgcacccatgaattccatctctggctgtacaatgacagctcatgttaaatggccttattctatattctatttcacaaaataatgaacaaaatgggcttgctttgggggtacacttctatgagttgtgatgcacgtatggatttgtgtagctagcgccataataaggacacaaccccaaatcctcccacgtccccctccctcgtggtccacactgcaccctccctccactccctgccccccagctctgacctcccccaatataggtcagccttttccggcatgtcatataaataagaccacacagtatgaaaccttttagaatggcggcttttactcagcaagattccttggagaggcctctaagctgttgcctgtaacaagagtttgtatttttattgccgaacagtatttcatgcctggatacagcacagtgtgtttatcccttcagcccctcaagagcattcaggttgtttgaaggttttagtgaaatctagtgggtttagctgctatgaacattcatgtactggttattgtataaacataagtttttattaaaatttaaattacttttccctcaaaagattggtggccaatatattcattatagaagccatttccaaaagcatgtaatttatcctttagtatttaaagcaggaaatggaattacagggtcatatggtaagtatagggttaactttctaagaaactaccaaattgtttcaaggagtgacagtttgcgttcccagcacttgggaatgttggcattttttatttcagccattctaacggtgcggtatcccctcgcggttttgatttgtgttttcctgatgctaatgatgatgctgaacatcttttcatctgcttattcaccctccctacgtcctctttgctgaagtgtttattcaagggtttagtccatttttaaaccaaattgtttgttttcttctggttgagtcttgagagccctttacagattctgctttcaagtcctttgtcagatacgtaatttgcaaatattttctccctgtctgtagcttgtctttttcttctcttgatggtgtcttttgtaaaacaaaagttttgaaactttgatgaggtccaatttatccattttttccttttatagatgatgttttggtgtcaggtctaagaacttgtctactcacaggtcatgaaggtttttctcctatggctgcttctaaaattttatagttttacatcatagataacgatctatgatctattttgagttaaatcttgtgtaaggtgtggattgggttaaagtggtttttcgtggtcgttgttttttttaacatatggatgttcaattgcttcaatgctgtttgttgagaagacagtgttttccattgaatgatctttgccaggaatcggctggtcagatttgggtgagtctatctctggactccattctgtccattaatctaggtgcctgtccttcctctagcaccacaggtcttcagttaccatggctgcatagtcaatcttagaaccaggtaatgtgtttttctcactttatgtgtccttttcacaattgtttggctatttttgctccctcggatttccatacagttttagaatccacctgtctctagctaaacaaaactttgctggaatttgatttggaatttcattaaacctgtagatcgatttggggaaagaatcaacagttttactatgttgagtcttctaattcatgaacatagtatgtctctctataagttcactttgatttcttccaccagcattttctagtgttagctttaaagttctgtacatttttgctaaatgtatacctaatattttgtttccttgatgctattatatgtaataatttttaatgttttttaattgttcattacttggatgtagatatataattgactaaatgtccttttagtgataggtcattacaactatggtataacaatacagatataagactgcctcaaattatctaggcaactgatgatttatggctaaaagcccaagtcaaagccctagttcagtcactcttcaatgcatctataaccaaaaaatgtgtatgatcctatgaaaattattccattcactgaagaccagtgtcagttctgtattaaaagtgaactaaacagcctacatgttaattcaacaaacagttgctgctcactgcattctttgttctgtatgaggaccaccaataaaccaactgcctttttcatagacatttctgacccccgataatagctccaagagctcaaataaaacctaccaacatcatgtgtaccttaaaagatttaaactaccttttcctcaccagtgtagtgatcaatatattcattataacagtcaccttcaaaaatatatcatttttcttttatcattcaaagcaagtattcataattcacatgtgaagcattatctatgtaatgctccgttgaatctctgacagcatggtaagttgtaaaatcctctgagatctgcatagcgtgactgagcattcatttctttagaaacctaacctaaccctaagttttttctttagaaacttaaaaagtttaagtcatttttctagtttaatcacaggatgagtgatttaaaggccagaaatgtttatgtgactcaaaaaccaaagttcagcatgtagagaaatggagaaatgctatccaaacaccgaggcggtgtggcttgccctggactgtgagctgtttcagtgatttcaggccactggagtaggagctaataagtaacttcgtctggtagacacagcacttaaagatgtacgtcttacagtttaaagagtttcccgtctcttccattttgttttttgattcacgatttcacaccccctctcatggaggagaagaacgtacaaggctggttagtggtgactaaatacaactggtcactgaacgcagagaagcattcgataaaatattacatgacacaaggagaatcagagaattacttgagttcttgcagcattcatagacagaatgagttggaatatgaagaatcagggatttctactaggactccgatgttcctggcccttctgacatcctcacgttcaaaggcccacggcacctgcctgggaggaaactgagcgtgcaaactccactcctctgtgtgtgagaaggtggaggtgtcagtaaacagaggggtacccgccatgaagcgccggccacaggcagagcgccagtggccttctgtgaagagtatgggagctgcgctctgtgcctgagggaggttgacagtctcatcaggaatgagaatcgttaaccaacgagggcacaaaataggaaaaacaactaggaaaatatggagttgctgattactaagaaatccaagggataaaatgggatcttttgttttttttttttttttttggagacaaagtctcgctctgtcgcccaggctgaagtgcagtggtgcaatctcagctcactgcaacctccgcctcagaggttcaagcaattctcctgcctcagccccctgaagctgggactataggcacacgacgccaagcctggctaattttttgtattttagtagagacggggtttcaccatattgcccagggtggtctcgaactcctgacctcaggcaatctgcccgcctcggcctcccaaagtgctaggattacaggcacgagccaccacacccagccaaaatgggatccctctttcattcctcatgcattcaaaacctctcaggcaggaattttgtctgcttcacttttgtggtattttcagaacgtggaccatgcctggcccctggcatttagttgggaagtaatgaggcccagtgcagagaaggacaagcagctcatggttacgccctgctgtgcctgcaactctgtcacaggggaggccacgagcaaggggtgcagaaaacagagctcgcagtgctgagtaggccctatgcatgggagatgcctttgccctgggccctgcggaggtttcagacagatgggagaaggaagggccttgtggacagaaaggaccctgcacaaggcccagggcagaggatgcacagcccatccacatggaagatggtcggggccagggcataggggcacagcccagggcaggggatggatgctcagcagccagggcaagtgggaggagagctggggctggggctctggctcctggcagggctgcagccagagggaagggccctcagaagcacccagaataacagggctcctgctgcaggcaagggcggccacaggacactggaaggagagggacatccatgttgcttctgtttcacgaagcttgctctgctctgggtgctgaatgctgggaaggtggacaggaagcctcaccacgttagggcccaggggacaaagagctttggcttcaccctgaagggtgggcagggcagggagcctcacaggcagcaggggagctgttagtagtctgggggtgagggcaagaaacgtttaaagaaggggtccccagcccccaggccctggaccggtaccgctctgtggcctgttagaaaccgaggtgcacagcaggaggtgagcagcgggcgagtgagattatctcctgagctctgcctcctgtcaggccagcggcaccagattcctataggagagcaaaccctactgggaatggcatgttcgagggatcgaggttgtgcactccttatgggaatctaatgcctgatgatctgaggtggaacagtttcatcccaaaaacgttcccctacccacccccatccatggaaaaactgtcttccacaaaacccatccctggtgccaaaaaggttgggaaccgctgctttgaagaggatcgagtagggaaggagggcagaggaaagagtccagtgccagcaaaacttcagacctgatgtgtgccgtgtggagacccccgtctgggctcagacacagaggtgaacaatgtcggtgctgggcgaaacgcagcacactctgcaaacattgtcctttgtggctgcagcatgcagttgtcacccactgaattccaccattccgtgcactaccataaatcccagaaaagcgcacttttcagggcgagttaggcctttggtggcaaaactgtcttctgaacaacaaggggtcctcccaatcaatgtgcatagagctgacagactggagggaaatacttcaattgacttccgtgcatttaactgatttgcttccgctgcgttctgtgtcgacggggcgcagccagcatgcctggggccagagctcctctgacctccagaaattcattcctgcctgaggtgtgggctctttacatgcaggctatttctgaacaagtagcatctgggagcagcagtgagaaagcgaggggaaaactgacaaaatcaatctcgcaagctcccccgagtccctttcctttgcttttctgagaactcacaatcagccctcttgcctggtgcgcattcaccgctgttgggcctttgcagttgagctgagagccgagcagacaatgcatgaagtctgcaaaagccgcagcatcccctgcgtcgcctatgtcccctgtgtcacctgcccccgtgtcccctgtgttcccctgcccccgggcgctcatggcttttcccttccctccactgtgagctaacctctcgcagtgcttaccactctgtatcttctgtgcgatctccagtgacctggagtgttctggttctgttgattaccagctggccctgggcactcatgcccagccattcttccctctccgcttcctcttactcaaaatgtggaagtgatattcccaaatcagcccggtgtcagtgtggcgtgagacacttactttgagaagcagagaccagctcatgttatgcagccgcgtcaaagcccatgagctgcctgcctcatgctgttgtgtgtttttctgtgtgtatttcccgagcattttcctgtattcagcccagaagcctggggataagtaatatttttctctcagtgctttgcccaacctgaccctatctcagatggaatcccccttgaattaccgtcacttcccctctatttgcttgttcaccttcaggagagccgcacactgagtcggtgatagaaatctctccccagcaagtcgcacacccaaacccgctgctgccagcccgtagctgccccaggtgtgtctggtggctcatctgtggcttcctagtagaagcccttaaaaaatccagatcactagttgtacacctgtcaacctaccatcctacacgcacacacaaacaagcacacacacaccctaatttgcatagacaaagtttaaaaggtgacaaagacactctccttgactgaactttagacaggctcttctaagccctcttttcaactaagcctcctccatgggccttgtcctcaagcctgcctagtccagttttaccaagaatcctgctaagctagtttagacaggatcttcccaatcttgatatatgatcaccctccaaatctgatcaaatccctcatccctcaccatcccctgagtgatataggatcatcttggcctgccttctgcaagaatcatattaggccagtttagcaagaatcctccctaccctttatgtctcttcttagtaattttccacccaccgagcaatgcacaccatcccaccttcctacccctctaactcttcacctcccaaccccatcctcacctgctgctttgctacaaatctccacttgttcttactgttcgtggagttgaagcccatctctctccccattgtgatagtctagataccatctatcacaatagtccttaataaagtattcctgactgttaaaaaaaaaaaaaatccagattacaaaggaggagagatccagcttccctgaggaggacaagccgcagggactgtggacttgtcctgaggtcaccgcgcctctgtgtttcaggactcacaccacccggcaagaactgctcactacggctccctgccccagaagtcacacggccggacccaagatgaaaaccccgtagtccacttcttcaagaacattgtaagtgacgatcgatgggaagaggtagcaactgtgagggggaggaggggtgctggccactgctgtcatccacacaggacgttcgtacgctcgggggtggcaccggggtcatcatcagggtgaggccggccggggaactcccccctcgcacctgatcgcgagttccaggcaagcgcttcccgactgtatctgccacggattgcaccgtgcgctccgtgcgttctccagagagctcacttctcttgagattaggctcccatgtaacgcttagcctaaaaacacaggctttgcaacctatggagagtgcttgccatgggctgggagcggagggggcagcagagagagcacagggcatttttagggcatttttcgggcagcgaaaccgctctgtcgaggctgccatggtgactgaagaccacgcacttgtccaaacccacagcgtgcacagcaccgagagagccctaaggcagtgttgctaataagggaaactgttcggggtatgtggaaactaatttctgcacagtttttctgtaaaccgaaaagtgccatgcaaaacgaagacgattaaaaacaagaacaaaaccacaggcttctaattccaagatctcagtgcagcagacattttatgctcgtattcgataagtgcacttaggagctgcagacctggggacatccccttggaagctctgaatgtcagagggcccgctactcctagccccggaaagggctcacggtgaagcaaagtccgccgcctccctcagtgtcccaagatgggcccattccccagctacggagcctctgggaggtgttttccatcctctgaaacacttcctgagtgctctgggagatctgcatcatctagaatattttcaatctcaggtctatacttcttcaccaactaggacagaagtggggaggctgggcacccgggtgcttctggcagctgatggatgctagccaccctcagcaggcaggagcccgttaggaaatggacggcggcacagggctcccagtgcagcccacggttctctgtgtctttccaggtgacgcctcgcacaccacccccgtcgcagggaaaggtaagaccttggaatgttttgattgatcatcacttttctgatagaccttctctaaaatcccataatgtaccaaagagagagttaggctccgagctaccagaatccatcccaaaacgtgttgccaggcagctcccaagtagaacaggtcggcagatccatgcacccctcctgtccctcccgcacctgcacagccgctgtggccctgagcctgcggcccccctcggagctccgggtggaacctgtttttaccacctcagctccactgtgctttgactgtgtttcctgttgattgaaaggactttcccttcactgaccaccatgtcattatttctctgtcttcctcatgcaggggagaggactgtccctgagcagatttagctgggtaggtgacgaacgcacttccatcggcttcctcttccgtcccagtcctcacagccccgcaacttttgtgttctgctctgtttcggttgcttcctggcctccttttctctcctctcgagacctctctgcccacagctgggatcgggccgccttgtcttccactggggaaatgaaacgtggtcttcccttccggaaggtctggtctcttgcttctgtgccggggacccagccctgcaaggccagatcctcttctcccagagggttcccaggcgacgtgactggtctccctcccagggagggagcaacaccacgtccgagaaaatgtttaacttcctccaacacaaccagtgcgagaagccccaggaacccgcatgtggaagtgggactggctggcccgtctcagtgaccccagatgctgacactgggaaaatgattctgctgatgaacagaaaaagaggctaaatagagttgctcgatttataataacctcattaatccaaagatttttgttttgtatgtgtttaaataataattaaaacatagatatcaagccatccagaaaatcttccttaggaattttaggctggttaatactgaaagcaaactttcaaggaaggtttaaaatggccaatttgaactttctagtgaaaaaatttggtgtctgagccaaattaaaatgccaatcattatattctaaccaaacttacagactttagttactagcaaataccagatatgattcttactgtataaaagttataattttagaataaaatggaggaataaccaccaacgtattgtagataggttgtgtctgtctccgaaactgcaatgctctcatacgctagaacagagcctacctacactttctgctcaattaataagcatcatataaatgaatgaatacattttaaaagaaaaacaacaaggagaaagaacaggaagaaagaacagggaaagaaaacagaaggtggggaagaggaaggaagagagggaggaaggggcagggtacttgagagaccatgaggatcccagatcagtcccacacatgattacactgaattatgaactaagatatttaccgaaacgttttccattaatgcatatttgacttgctttttctgacctaatgaatttgcaaaacgatgacaatcatgtagcaaatgtacatggactagtactcacaattaattttttattttctatgccagcaggagacaaagatgatagaagaatgaaattcatttttgacccagaaatcttattttagctactgctttatctgctcttaattttctaggagtggactttggggccgtcgtgccggatcctccctgaatgtggagcgatggggggttgcacacaggccgttctgccccagcagctaacaagaaagacccttgcattcctccctgcatctctcccttttgggtcctactaatgtctgttgaatttctcttttttccaaagcaaaatccttctctgcattttgtctgcttgtctgtttcccagagccgcaggactctctccttgtctggagttccagagagcccccactttctctttctaagctgtgttgtgtgtttcctggtacattctaggttccccaaagataaacatgactaaggattggaaaggaggaaaggccgcgcagattgttaatctgaaagtcaatccccggatttagctctcaaaaatgctttatttttggagaaaagcaatagagtaagacagaaggacttaacgcttgcagggaagtggctttctgccatgtagagccaggctggcaacctgccctctgccatcagggagtgagcatgaacctggaaacctctaggacgcaagagcgaggctggctgtcccctcgtgtgcagtgcttagaccttcttgccacacatcccgtccctcacctcactggatagcccccgaatcaactgttcacacgaaagcagctgcctggttctgagtggccatgctcactcccaagcacaggctgaatgaaaagaaaactgtgcaagtagcttgtatggtgggaagcccccagcagaggctgagggtgcagccaggtgctctggaagccttgaggcctctggtgtcatcttcctcacctctaaataagagatgggctaggttggtcaaggtcctccctgtcctaaaacactttaatgaaatggaagaaaggctgcaggctgatagaggagggacagtctggtttggttccctcaagtcttcaggagagggctcaaggacagtctcccatttcttgttggcaaaatgtaaagtgcagtctggaccctgtccattgagtagagactcaggaggccaaccaagatccctgaaaagctaacagcgtggtcagccttcccacagacagtgcacccaccgtgggaggacacttcgccccccattgttaacgtccaccgcgcccagactcccacagcgagctccttcccttcctccccatgtttgcagtggagttcccactcgagaagacagcacagtagcaagtagaggctggtcctgggacactcgcacccatgtgtgtcaggaagcccctgcggtcacacggcccatgaggaagccagaggggctgctggggctgatgaggccagggcagggcggcctgctcttccataaatgacagctggcaccaaagcccagagctggcagcctccacctgaggagtggcatctccatgaacggcttgtgttctcgcacagccccattgcgtagatgaggaaactgaagctcagagaggttcctgcccttgcccaaggccacacagccggatgagctagaaaggtgctaggggactgggaggtgggggagctgagacgctgtcccgctgctgccaggatgcggccgccccccgtgccagccaggcctgcctcctccctctgtccggctcagcagccccggcctcctgttgctcccagtccgagctatggccaagggagactgattcctgctcaccctgggagagagctcaggattttgtctcaaaaccttataaaagatacgaggctcgacattttactaaggccgaggactcttgatctcccagacagatcctagaaccacagggcacatgtgaccagaatccaatctgtgcaaatcaatcagcaaaaggagcccccagcaaaggcgcaggccggggcctccggggaccggcacctacacagcgcacagccccccagggtccgagtcctccaaacccgtgtaggcaggagcctccttaccttgatttgcttgatgtttgctaatcttctcttgaacaccccacagcgtgaaggtaagcaactgttccctaaacgacttagatccttaaaatatgtgtggttgggccgcatatctcatgagagagcctccgcccaaaccagagccctcctctctctgcggccaacaccctggtagacctgggggagcagcctctcccgcccccaccccctcagcgtggtgctggcccgtggctcctgaaccactcaccagtccagtccggggcctgggcccttccccggggccctggtggcagctcccagtggctcaagcagcgtgcccagcaccgcgggtggaggttgagctccgtggtcttctcttgcagggggccgaaggccagagaccaggatttggctacggaggcagagcgtccgactataaatcggctcacaagggattcaagggagtcgatgcccagggcacgctttccaaaatttttaagctggtaaggtaccctctgctcagctccactgagcggggactaagggctcccagaatccccaactaagctgagtacaagggtggctgccgcctctggctcagccgcactgtaccctggacgtgctctgtcccagcaggcgtgcaggggctcaggtggcattgcccacccgcatttacgcgtggatttcctccgagatgcatgtgaagccggaggtgcttgaggaagggctgcgcctgggctggttcaggggccctggagcaggcgactgaccttgactctggggcagggcccagctggagtccaacttgctcatgcccaggggttggggccctcagggagctaaagcaggagtcaagcagacgtgggtgtcggggggagatccctggagccacgggaggggatgcccaggagacctccagggagtggggagtgtcccgtcggctcatgaggacctggaaccagacccaggacgaatgccaggcccgctgtttataagctctgtctctgagacttggttttctcatctgtaaaatggaggtaacccgcccactcagctcacaaaatcgctgtgaaagtaaaaggtagtgacaaacacaaaacgcggctggcaggtgcgcggctcggattccttagataagcagtcacctttattattgttaaacgtcacccagaaaacccttaactcttagacagcggctctcattaagcaaaaggggaggcacatgaagctccaggcagggccgggagggaaccgtgaagccaaaggctctgggagcccccaggcacctgcgtttgcattttcatcctggaggagaccaggcctctggggctgctccccggggtgcagagaggaggggtctttcttggtgtgtaacatactcattgattcagtcacctgacctttgactccatgtattttgttgagtctggatgtgtggtgtgctctgcccagcagctgggatccacatgagcacagacatggtccccccgcgtccttggtgagtgcagaacctctgccgtgagcctcgattctgggaggttctgggaggttctgtggacaacaggcaattcagggcacagcccctgctcttaaggatagccggtcttaggagaagcttttaatatgtgaagtgagcagggagtaactgagctgctaagtaagcagctttatgtcagatgaagtggtaggcaggatccactcctcaacgtaaattctgagttaagaaaaaaattctccaaatattcaagtctcagggccatcatgctgtacattgccgcagttctgggatgtggccacaagagggcggagatgaggctccccggggagcagtgtctgaacccagcactgcagtcaggacggccccgccccacctggccagcacgtcacctgcctctgaatcgcctgggatgcacgcccagacccctatctgcgctccgccacagcctcactgagtcagaatgtccaagggcgaactaggtgttgctagttgtgatgattttgcagacaccgtgctcacctgggaaacacggattcatcccatctggaaaactaattactccactaccagcttaaggactgttagacacaccgggagagctgagtgctggctcagagttgatgggagggcccagatgagtgaggggccccatttagcaaatattgtccttgcaatatatgcaaggcttacaaccagtcactcaaagatgcttgcaaggccagagcttaccaagaccaccctgaggaacagaaagctgcatttagatctgcacatttactgtgtgcaaatataaccagtgtactatacacatgtgtttcctgaaataagttcagtattttccctgaacttttttgtaagaagcttttaaaaattatttaatttctgtagagttcaagggaagcttctatgtatcaaagcaaatttcaaatcatatggttgtaattaaattttactgcataaaaagttcataactggcctactatggccgtatggctgaattagttgacttggagcacttccaatagattaataaatcagctcccccagaaatgagggggtctagaggcaggcagatggagaggacagggacttcatagcatttaacatcattttaccatctttccttcctgttctttttggtgctgttggaaatcagtagtgagaggaaaacactcaaatctggaagtctagcgctgtcggtaggaactgggtagaaaaaactatgcatgtccccccatcactcggaaactacatcagaacatcataggagcatcctgtttccatgtgcattagtttccacgaacatacatgtgaatgttttcccacctgtagtgttgctgtggagttgtgagatgtcaaagtggaggcaagagtatctgccttttgcagtaggctctgttcttttcctgtcctgagagaggaggtcagtctaaccctcaccttgtgagttcagccttatactgacctgagcccagggtggatcagatgctgagatcatgtgactccaagttgcaagacacgtaatagagagaagcgtgactgttgcatccatgcaggctctaatcctggctccttcgggctggctgagctttggctcctgagctataaagagaggatgataggaacacctactccaggaggtgctgtgagcacaaaagagaaaacggggaaaaacgggtttcctgcatggtcagtgctcaacaaattgtagtttcaatgataaaaagtaaaaccaatacacccaccattttcaatgtcaaaagggggcatcaagaaagttaagattgtacctcggtaggttaccttgccagaggctgcagggaacttactccatttcagcacagaagcactttgtttcataggacagtggttctaccactttccaggaagtccaaaggctgatctcttggaaatgcagcaaaaggtgaggtgagtgccaacttctgggctactccagagggcagctccaatgccagagatgttcaagttaagccaggatcaaacaggaaaaacccacgctcccgagggagaggctggccctcgaggggcagggccctgcacctgtcagtccccaggccggcaggaggcctccacggtatgtgagaaagctgcctgtcttgggagggaaatctcactagatggttcctgaagcggcttcgcaggctagcatttcataaacgttttcacttgtgaaaacaaaaatcccttgagtgagttgtgtaagcacaacatagaggcttgtttataatgctacgtatgtacttggaaaaccccccaagaagtcagaactgtcaccttggtctgttagctgcgttacttggaaggattcttggcgtctgcgctctggttatttgtgttactgggcagtgtggaagacgtagaattagatgaggacagtgttggttcgttgctgatcggccacggtaaagagcatatttcttttctatcttgctttctgggggctcttcgccaaaattgatcatttcataaaagaggggaaacccaaggagagagactaaactttgaataaaaatttgaatgcaaaaaaagtgcagttctgcttcgtcgatctaagtgacattctgagtgaccaacgcattcctctttctagagggatggccacgcctggctacctccacaccgtgggccacagcacacctgtgcaccatctcaattagctgccaactctcttttaaacatcgaaattatttgtcccccaaacgtgtaaatgcatggttttaagaccccttcaagtcaaagtttgcagacaaagctctctgtgcatttgatttgtctggtgtggcagatgagatggcacataggagggacgtccccagggatggacacgtggctttgctctttgctggcgcgtgtagcaaggggtgtgctagggtcccgccgaaaaagaagttgctcctgttgtcgctggcagttcccctcggctgccctggcacctctagctgacgagaaaaagtgctcattcaaagcaaagcaatggagcggctgcactttcacccacagaagtgcagcgttgttttgcagagcagtggttatgccaggcaccactccctggggcctgggaatccgattccagttctctctcacagaactggaaattcaattagcatttgctgagggaggtcgggagaaatggaatgaaaagaccagctctccggggtgccatttctattagcagatgagagagacacccaatggctcagcatccacccgggaccacagaagaggggatgctggtgtgggaggaccctgcggcactctcgtcctaactcctctctcttccttttcagggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtatttgcatgggtgtcttcttttgtgttccgggctgtagcacacaggcccacatcaagcgagagccaggtgtgcagagcaaatgtgactcggtgcctctgggtctccaggcagggctgcctggcggtgcctgttggagggggcatcctcatcagagggtcgatggctactgaagaaagtggaacagaggtagttgttagggcactgattctctcaccaggaaaaaaatatttagtgtctctgaagacaagcttccaagtctgtctgtgttctgctgtgtggctagtgtacacaccctgcagatgtgaacccaggagtcttggacgtgttccccttgccacctttttctctgaaagcatgaaagagcgtgaagcaatgttttacttatagttacctttggttacaagaatttttcttcaaaaagatagacgaaagtctcttttgttttttctttttcttttgagacaggatcttactttgccacccaggttggagtgcagtgctgcaatcttggctcactgcagccttaacctcccaggctcaagctatcctcctgccaaagccttccacatagctgggactacaggtacacgccaccacacccagctaaaatttttgtattttttgtagagacgggatctcgccatgttgcccaggctggtcccatcctgacctcaagcagatctgcccacctcagcctcccaacgtgctaggattacaggcgtgagccaccgcacccagcctttgttttgcttttaatggaatcaccagttcccctccgtgtctcagcagcagctgtgagaaatgctttgcatctgtgacctttatgaaggggaacttccatgctgaatgagggtaggattacatgctcctgtttcccgggggtcagagagcctcagactccagcatgataagcagggtgagaagcttgagaatatgattgcattcattgcaatagcaggaaaaactgccgaggctggaggcatggccacctgagctcgcctggcaggcgtggcagacagaaagcccacgttcactggctacacttctctgcccagaccccttccaa

SEQ ID NO: 13007 - DNA, 10849 bp, Human
catctgtaatcccagctactcaggaggctgaggcaggagaatctcttgaacctgggaggtagaggttgcagtgagctcagatcgtgccactgcactcaagcctgggtgacagaatgagagcctgtctcaaaaagaaaataaataaaatgaggaagattattaatgaggctgagcatcttttcatatgtttaagagccatttgtttttcctttactggaatgacctattcaccttctctggcaatttttctttccaaaaaattaatttttaggagctctttatatattagggagataacaggtcagagaatgggatcactttgtttttaaaatgatttttaaagaagaagacaaaaactatatctggtcacctttcatatgtacctaggcccttctgcggggcctcgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggcttcttcttcactgctcagaggggaataggaatgagtgaggaagggagcacagcatggataaaggtttggaagctggaaaccatgaagagagagcagactgtgattggttcatggttagtttatgattgattagatgatgagcctgaagatggcaggatcctggtcctgcttggtttgatcagggcagggacagattgcatagttggatgtgggggaggcctgattggctggaaaactgaaggatccccattctgattggttgctctgagtgggacacagaggagagaaagcaagagagatgaagggttggtgcctatttatccttaggactgagggttgtgggttctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgagacagagtctcgctctgttgcccaggctggagtgcagtggcatgaccccggctcactgcagcctctgcctcccaggttcaagcgattctcctgcctcagcctcctgagtagctgtaactacaggcgcacgccaccacacctggctaatttttgtatttttagtagagacggggttttgccatgttggccgggctggtcttgaactcctgagctcaagtggtccactcgtcttggcctcccaaagtgctgggattacaggcgtgagccaccgcgcccggccttcttttttagaggcagagtctcagactggagggcagtgatgtggtcactgctcacttcagccttgaagtcctgggctcaaagcgatcctcctgcctcagcctacctactagctgggactacaggcctttgtcaccacacctgactgattttcttatttttttagagacagtttcgctgtgttgcccaggccggacttgaattcctggcctcaggtgctgctcctgcatcagcctcccaaagcactggaattacctgccacggtgcctggcctttagtcatggtcttaaaacagaatgtaggccgggcgcagtggctcacgcctgtaatcccagcactttgggaggctgaggcgggcggatcgtgaggtcaggagatcaagaccatcctggctaacacggtgaaaccccgtctctactaaaaatacaaaaaattagctgggcgtggtggcaggcacctgtagtcccagctactcgggaggctgaggcaggagaatcgtttgaacccggaaggcagaggttgcagtgagccgaggtcgcaccactccactccagcctgggtgacagagcaagactccgtctgaaaaaaaaaaaaaaaaacggaatgtaattagaagtgttacaatcctgtctgttaactggtaaattcggtccatttacatttctcatgataataaactatttgaatttgattttattatctcattctgtactttctatttgtccaggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctgtgagtcctgatttctttcatatgctgtgggatgggatttgctgggcagggatcggcttgcatgtttacctatccacctattcttcttccattgatttattttaaatttttatttaatcttttaaaaaatttattataggccgggcacagtggctcacgcttgtaatcccagcactttgggaggccgaggcaggtggatcacttgaggtcaggaatttgagaccagcctggtcaacatggcaaaaccccatctctactaaaaatacaaaaattagccaggcgcggtggctcaagcctgtaatcccagcactttgggaggccgaggcaggcagatcacgaggtcgggagttgaagaccagccaggccaagatgatgaaaccccatctctactaaaaatacaaaaattagccgggtgtggtggcacacgcctgtaatcccagctactagggaggctgaggcaggagaattgcttgaacctgggaggcggaggttgcagtgagccaagaccatgccattgcactccagcctgggcaacagagtgagactttgtctcaaaaaaaaaattattatgtattgttattattattctttttgttttttgcccttctctaaaactggtagataacttatttttgagacaaggtcttgctctgttgcccaggctggagtgcagtggtatgatgattgctcactgcaacctccaactcctgggttcaagcgatcgtcttgcctcagcctccccagtagctgggactatactataggtgcacacctttatgcctggctaatattttcacttttttgtagagacaaggtcttgctatgttgctcaggctgttctttaactcctgggctcaagcaatccttccacctcagcctcccaaaattctgggatgacaggtgcgcaccaccgtgcccagccttatttaacttttttgttgcatgtatattcacgtgggtcaaaaaaccatttaaagagatttgcagtgaaaatctgctttctatccactaagtttccccaaacgctgttaggcactgttgatagttgtttatgtttcttttcagtttatttacacacgtaagtctcaatttgctcaattgtaaaaggaggataatagtaataaccaactatatgtaagatacttagaacagtgtttggcaaacagtggttgccatgtaactgttcactattattatcattatttgcacttttccctttttacacaaatggtaatatgctatatatacttctaatcttttctctttttctttctttccttacaagaaaaccaaagaagccattttcttttttgagacggggtctcgctctgtcacccaggctagagtgcagtggcatgattatagctcactgcaaccttgaactcctgggcaatcaagcaatcctcctgcctcagcctccctagtagctgggattataggcatgtgccaccccaccaagttattttttttttaacaacttttttttttaagagatggcgtcttgctttgttgcccaggctgttctccaactcctggcttcaagtgatctgcccacctcagcctcccaaagtgctaggattacaagcatgagccaccgcacccagctgctttttttaatgaggtcactcctcatgatttcataaagagctttcaaagcatggacattgtacagttgcttgacttgtgtagtattgatgggcattttccctcaatcttctgccattataaacaaggccgggcagagtggctcatgcctgtaatcccagcactttgtgaggcgaaggcgggcagatcacctgaggtcaggagtttgagaccagtctggccaacatagtgaaaccccgtctctactaaaagtctaaaaattagctgggcgtggtggcaggtgcctgtaatcccagctactcaggaggctgaggcaggagaatctctgggacctgggaggcggaggttgtggtgagctgagattgcgccactgcacactccagcctgagcgataagagcaaggctccgtctcaaaaaaaaaaaaaaaaaaaaaaaacattacaggcatgagccattgtgcccggctggtcagatgtttcttaaattttagtcattccagtagatgtgagtgatatctcattatggttttaatttgcttttccttagtgactaatggaagtttgaacatctttcatatacttattggccatttagaaatcctctttgtgaagaacctattcaagtcttctgcctattttatattggatgatctttttctttctttcttttttttttttttttttgagacagggtcttaccctgttgtccaggctgagcactgtggtgctatcatagctcactgcagcctcaacctcctgggctcaagacatcctcccactgcagcctgggactgtaggcacgtgccaccacgtccagctaatttttgtatgttttatagagttgggggtctcactatattgttcagactggtcttgaactcctttatgcaagccatcatcccacctcagcctcccaaagtgttgggattacaggcatgagccatcgtgcccggcggtctttttctttctgattctctgctcactcttgtattcactcatctgttcacctacattctctctctctcattggctacttcactcactccatcatctacacctgcttccttttataccacacacacttcttgagtaccaatcacagccacactgttttgtgtcaggctttacacatattaccttgttttagagaaataaaccactagaatccaaacagttaccccatttcacggatgaggaagcagacgcatgggaaggttatgaagtctgtcttcttgcagggacccccagctctcacaagtgtgtgttcctttcactgcctttattcttcatatctctctcttcttttcttcagggaaagagtatgccaagggagacagccgatacatcctgtaagtgtttgcctctgtcaatggagactggcattggttttcggggggtggtgagttggggagcactaatgggctaacctgtaggaagagcacaccgataccagtgtcccctcatgctttctcctgcaggggtgacaacttcacagtgtgcatggaaaccatcacagcttgcctgtggggaccactcagcctgtgggtggtgatcgcctttctccgccagcatcccctccgcttcattctacagcttgtggtctctgtgggtaaggaaagggcactagaggggcactgggcactagaggggttgatgggggatccacagacacagatgtatccctgtgggtgggatctctcaacggtgcccttccaggggtaagtcagactgaatgacaaaccccctgaggctctggaaaggtcatgcccttctctgagcctgcactctcaggtggggagggttcatttttcttcctcctcctccttctccatcacaaagtctcctgtgaaggttacatgaggtggcccagggtggcaagaagcccctggaacctccaggatcagggctctgagatcccttcatgtaagattctgtcatattttttttaaaacagggtctggctctgtcacccaggccagagtgctatggtgtgatctcggctcactgcaacctccacctcccagactcaagcgatcttcctgcctcagtctcctgagtagctgggactacaggcatgtgccaccgtgcctggctaacttttgtatttttagtagagatggggtttcgccatgttgcccaggctggtctcaagctcctgagctcaaacagtcctcctggcttggcctcccgaagtactgggattacaggtgtgagccactgtgcccggcctcagtcatcttgtgttattaaattgttagctttctttagttctagcgatatgagttatctttagtcccagaatcctaagctgtcttggatttgaggattttgaacttccttaaatctgaaggtgtgagctctcctgagttctgaaattctcagctctctggtgtctggaatctcacttttctgatttctcagattttcagctctgtgatttcagaatacttagctctgagaccttgaatgatgacttggaaagtgctttggaatagagaattggcgaaagtgtccccttcctcactggggcttctccttcccctcctgccacccacaggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaacactgagagatccttaattactaaccccagagatgcgctatgactgaccccacagatcccaccatcattcacttattccagacccccatcagcatctaaagacctcccacctctgacctcacaaacccctatcactgaccccccgccagaccccataactcactacacagaccctatcactggccccacagtcccctggtcttaactcgagctgccataacagaatgccacagactaggcttaaaccaccgaagttcattttctcacagttctggagtccaagatcaaggtgtcagcaggtttgacttctcctgaggcccctgtccgtagcttgcaggtggccaccttctcagtgtcctcacatggtctctatgaactagcgtccctgtccctggtgtctctctgtgtgtccaaatttcctttttttttttttttttttgagacagggcctcgctctgtgtcaggctggagtgcagtggtatgatcatggttcactgcagcctctacctccctggctccagcgatcctcctgcctcagcctcctaagtagctgggactacaggtgtgcactaccacacatggctatatttatttttttttatagcaatggactctcactatgttgcccaggctggtctcaaacacctgggctcaagtgatcctcccacctcaaccttccaagtaactgggacaacaggcacatgccattatacctaatttttgttttgttttttttttttgagacggagtttcactcttgttgcccaggctggagtgcaatggcacgatcttggctcaccacaacctctgcctcctgggttaaagcaattctcctgcctcagcctcccgggtaggtgggatcacaggcatgtgccaccatgctcagctaattttgtatttttagtagagacggggtttctccatgttggtcaagctggtcgcgaactcccgacctcaggtgatctacccgcctctgcctcccaaagtgccaggattacaggtgtgaaccaccatgtccggcaatattttttcaattttttgtagagatggggtctcactatgttgcccaagctgatctcaaactcctaggctcaagtggtcctcccacctcagcctcccaagtagctgagactacaggtgtgaactaccatgcctagcccaaatttccttttatgaggacaccatttgaccagcctgggcaacatggtgaaaccccatctctacaaaaaaaattttgaaaattagctgggcatcatgaggccacggtgggaggatcatctgagctagggaggtgtaggctgcagtgagccatgatcacggtgagagcctgtcttaaaaaaaaaaaggaggtggggggtgggcaccagtcaggcacagtggctcatgcctataatcccaggctgacacaagtggatcacctgaggtcaggagtttgagaccagcctggccaacatggtaaaactccatctctactaaaaatacaaaaattagccatgcatggtggcacatgcctgtaatcccagctacttgggaggctgaggcaggagaatcacttgaacctgggaagttgaggtggcagtgagccaacatcatggcactactgcactccagtctgggcaacagagtgagactctgtcccaaaaaaaaaagtggggggcaccatttgtattggattaggcccactctatgagtcccattttaacttaaccacccttttaaagtccctatctccaaatatagtcacattctgtggtattgggggttagggctttaacatatgaatttggggaggacacagttcagtctataacattctgctctctctggcctcccagaattcatgtccttgcatgcaaaataccttcacccccatcccagcagcccaaaactctcttttgtttttttggagacagggtcttgctctgtggcccaggctggagtgcaacggcacgatctcaggtcactgcaaccacagggtttcactatgttggcctggctggt

SEQ ID NO: 13008 - DNA, 7681 bp, Human
ggagaatcacttgaacctgggaggcggaggttgcagtgagctgagatcatgccactgcactccagcctgagcgacagagtgagactccgtctcagaaaaaagcacagaacatagggggaaaaatgattatatcaaaattatggatctttattcaactaagtttactgcttacaaagttaataacacaaatgccagagctggagaggctatttccaacacctaagggattaataattagactatgtgaggaatccctgacaataacaggaagataaatatgggaattaccccaacaggaatatggatgtactgtattctgtatgttagcaaatttggtctgtgttgggcaaattcattctatggataagaaatttagcctctgagggcaaactaacttattcttcgttgatgtggcgctcagaagtgaaaaatctgtcaaatccatttattgtaaaggtggccaagacactgaagactaaattgtgaacagtgggctcagacactacttgattgggataagtctattgtgtattgcgaaagtcccttctgtgaatcaagggctcagttacttttttttttttttttgagactgagtcttgctctgtcgcccaagctggagtgcagtggcatgatctcagctcactgcaacctccacctcccgggttcaagcgattatcccgcctcagcctcctgagtagctgggactacaggtgcctaccaccacgcccggctaattttttttttttttgtattgttagtagagacagggtttcaccatattggccagggtagtcttgaactcctgaccttgtgatctgcccacttcggcctcccaaagtgctgggattacaggcatgagccactgcgcccggcaagggctcagttactttcgaagagagcaaaaattgctctatggattgggatttacaacctctgaagatcgtagcatcctcttttgttttgttttgttttcacccaggctggagtgcaatggcgtggtctcggctcactgcaacctccgcctcccgggttcaagcgattttccagcctcagcctcccgagtaggtgggactacaggcacgtgccaccacacccagctaatttttttttcttttttttttttttttttttttttggatttttagtagagatggggtttcaccatgttggccatgcaggtctcgaactcctgaactcgtgaaccgcccgctttggcctcccaaagtgctgggaatacaggcgtgagccaccgcgcccggccagcatcctgttttgtaaaagccatctcaggcagtctattggtgagaaaattaaggggctggcttcacgccagcagtcagacaagggtgagggctgaagtcagagatgagatggaatgacgccagggaaaagggtcccatgacaggcggctagatgttgagcacagaggagaaagagtaggagtcagggtcaaaccttaaaacgttgggtctgacatcatggactgtgaagggtgatgacatcagtgacggtgggggataaaatgtcaggcctttaaagggtatgaggttaaagaactagaaggtgaaggaggttaacatcagagaatggcagggacctagaggaagacgactacgatggtgaggaagacatccgatccagcgggggaaatgatggcaaggacgggaggatgatgtcagggacagcaagtagtatgagattgagaaggttcctttgtggaagggataaaggcagctcagccggttgtgggggggatgctgacgtttagggtgcaccagctgttcaaaagtcgaccccatttccggaaacaccccatttccggaaacaccccatttcgcggagaacactgctcccttcgctttgctgtcccttcctctccccaccactccgcccctgctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggtaagttgcatatgtcctgcgaaacggcggctcctcgccacacacgcgccgcgccggccgtgaccggggaatagcgagtggggagagtaatggccactgacacgtaggcttggctttctctgggacgggcgggtcccgtgcttggaggtgaaacatttcggttggtgggaggccggcgcgctgtatctgagtgtgaggcctaccgggagggactggtggcgtcggtggtggcagtgaccacgcgacagccgacacttactttccttatcccacgtggccgccgccatcttgttctgccggcgttaagggaacgcagggatgttctgggcttgcgcagtggcacaaaatgacgggcgtggcggctatgaatgtgagagcatgcgcaatgtggccccctaatggtggctgcgctgagccagctcctcagattaccaccttattggccgcctttctcagcttttctgtagttacccatattttgttcctctttcttgtctattttctgtgctttttctctgctttccgtctcgctattttgtcacatctccattttctttctccttcctgtcaccattcttcatgttcttcccacaggacttgaactgccatgtcctctgaagaaggaaagctcttcgtgggagggctcaactttaacaccgacgagcaggcactggaagaccacttcagcagtttcggacctatctctgagggtgagacgggccatactcacaatgggggttggtgagagaaagtctgggatccttgcatttcaaggagtattaactgaaaagttaggacccacgcctccaaattctttttcttcctaagcctatggtgtagactaaggatgaggggaagcgtctttgggattagtgggagcgctccgttttccctacctatgccatctccttttccggccaccctttgctacttaacctttggggtactgactggtccacattgctccatcttctctccctctcacagtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtgagtgcagtgatcgttttgatcatggggtgagagggagagttgcctatgtgtggacaactgccatttaaatatttttctgctctaggtggtggggaccagggctatgggagtggcaggtattatgacagtcgacctggagggtatggatatggatatggacgttccagagactataatggcaggtgggtagccaaagggctgggatgttctcctattgcttccctctccttaagaactcagcgcctgggtgttcatgcataccacaccttgctgttactaatgtgtacctaaaatgagtatgaaatttagcattttaagttaattgtgtagtcatatagttgcgacatggtaaagtatactatatatgttgtgctgtgtgggttatataactatattgctttaacatgtaatatgatttaatatactgcgtataaatcgtatgccataaaactgtttactgtgatactcatatgcttaacatatcctgtttttgatacataaggtttatgttatgacccatactgtaaaatgtgacgcatataattacagtggtatatataatgcagtaccagaaaacttttgtgtgttttttttcccccccagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcactgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccaggggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaatggcacatcaacgagagggaggcttggagaatatttggttggtgggcgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatcttttttggtgtgtgtgtgtcttgggtggtaaagtggtaattttgtaattctagctggtcttagttcctcagttctgctccctttagtcatggttctttctagtggctgtattgaggccccatgggtgttatccctccattggttctagtttggaacagaaaaatctgttgtattcatggctttcacctggctaatactgagctaagttaccaccaggttgcaaactccaggacattattgtcctgagctgcctattcccttgctggtgcgttgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttggtctcctactttggtttgtcttcagcatccaactgatgcacatttgtcaagaacccactgaggctagaaaccccccaaacactcaaggtaccttgagaacatgtatcccaagacctgcaaagaccaaacacatggcctgtaactacttttcactttcaagccctggaacttgtctgtaccaaaaatctttctgaaccattcaccaaatct

SEQ ID NO: 13009 - DNA, 12460 bp, Human
acctgcctcagcccaggattctttattctgggggaggtaatgccctgttgttaccccaaggcttctttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatcagaagcggctggccatttgtaggtgtgaggcttttatggagcatctactgtgcactgagacagactgtccctctgctttgtcctcaggaagccacagtcttatgttgccatcctaaagagctttaaggattcttgaagctgcaccacacacacacaaaaaaatcttgattcccctgcccctgatcttatgcagtgcccagtatgtgcagaagggttctctgttggagatactgtgcatattgaaggtgtttagggcacatccccaatcaagatggctatctcagaagcagaaaaactaccttccctggcaccccaggggaatgaagaagccctttcccctgttgcagaagaaaagccctgtcagggtactggccagggcggggctggggttgggcgctgactggaatctgtccagggtgtagtcacctgttttgctctttatctttagcctcttcccccatctttacccttacatacccatccctctaatttctccttcaacacttgacttacctggcctaccctattccatgttggtttcacttgttccgacctgagttgttccctctcttgccctgcttatttgtctcggttcagtataaactccgccttccgggttccagcggttctcctgcctcagcctccagagtagctgggtacaggtgcataccactaagcccgggtaattttttttttttatttgagacggggttttgtcgttttgcccaggctggaactcctgagctcaggtgatcgcccggctcagcctcccaaagtgctgggattacaggcgtgagccaccgcctctggcccggactcttgccctgcttccaaatgctagctaacctgtgagcctttcgcctgtcccctttgccatcctcagtggtgactcacttgtcttcccttatgtgcgtcaactttcctttgcattttcacttgtttatcctcacctgctctgcttttatctgctagcttaacattcctgactcgcacctgatgccagtacgccctcaccccgaccccgccaggtcaaagtttcttcgtccccagattcccgtgtgctctccagggggcgaggcctcgctggaagacgggaaagcggaatttcagtccaaccatgaagcacctggtagtttctgatacggaaagggcggcgccttatggagaagctgccaataaagagccgagatgaaaggggtggctgaaccaatgagtctaggagacaagatcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcgggtgagacagtctgcccgagcagtcgcatgggaggcggaggtcgggatcgctgggagtcgggaatgttcctcactaaagtgagagggagcatcccgtgtggaccgacgtgtgtgtgtgtgtgtgtgtgcacattgtcagtgtgttgggggcggggaagagaacattctgagagtgattgtgggatccttccgcatatggagagtagagaccattgtgagtgtggtgggtaattctttttgggaaggctaaggccaccgaaaccattctgaatatgtggagtccttccgtgtggaagagaccattctgcgggtgtgggagttcctcactgaagaagggggagactattctgagggtggtggttccttccttataaagggacagagactattgtgagttagggtggggcgagtccttctttatgtgactagagagggtccattttgaggatgggggtgtctttcattatgtgcggaggagaccgttctgggggctccctcctaatggaggtagagttcattgtacattcgggtgggagggctcatcgttatatggtggagaaagaacgttctgagagtgccgggtccttccttatagcagagagagctcattgtgagtgtgggtagagcaaggaaaaattcattagctagagggtccgtgtgcggtggtgggagggcagaccatgtggagtgcagggaagtatttcctcatctggttgagggagccagacctttcttggtgggataaccattcctgatacaggattcagtccctgggagcatgtgggaatcatttcttgtatttagtagactattctggttcgagaggaaccagttgtcacaggagtgaggggttggagagaccattctgggtatgaggaggatcattccatatgggatgtaggccattctcagtgtgagggaatcgaatcatttcttagataggagaaagaccgttcttagggggtgaacatacctcatacagtggcctcattccctgcattgatgtgttattctttacatgagacagtccctcattaaacaggagcatcatttcatataaattctcagtttgctaatccataaatgggaatcctcgcagttcttttggagatgacagtgatatgagtctattgaggtaatccatagaaatcccttaacccagtgataggcatacagtaaacactcaataaacgtggagaatgtagttgtcggtattctttctggggaagagttgcttctcacttgggaggaagccgaggcgcgtggccagggtttgcctcagccattacctgacacctcagtaaggattccaggtatggactgggacagggtggggcccatttctcccttctggctcttcctgctcatggctgaggcagtaagccggtaggagtcagacccttattgggtgagggcaggcaggctgagggagcaagtagccatggctaggagggtcctgggtgagaaagaaagggggtgggtggtggtgtggctatgccccagcggcttctgaccccgtccttcccccttgccccttccgttccccacagctcacaggcgcctgaagtacatatccctagctgtgctggtggtccagaatgcctccctcatcctcagcatccgctacgcccgcacgttgccaggggaccgcttctttgccaccactgctgtggtcatggcggaagtgctcaaaggtctcacctgcctgctgctgctcttcgcacagaagaggggtacgaaccagggatggggctgcactggggtcggtgggtgagactccacatgtatgtgtgtgtgttcacacagatggtttgcttcaggagtgtctccaaatctcaacctgcctggagcgccactccagctatgcgtagcggcatcttacacttttctagccctaacagccgggtagccggcctgtgtgggctgtaggagtgagattgccaatgcttataaagtagcagggatctctcacatgtgatttagcttcatattatggagaattccgaatacatgcaaaatcagagagaataatcaaatagtaaaatatccatgtacccatcccccagagtcagcaattagcaactcatggccgctttaaacaacatcagtgattgttcactcactgccaatctatatgtctacctacgtccttatcctcttattatttttaagtaaatcccacacgaagtaatattgtatggaagtaaattcccctgaattatcttgaataaatgtagctgggattacaggcacgtgccaccacgcccagctaatttttttgtatttttagtagagaaggggtttcaccatgttagccaggatggtctcgaactcctgacctcgtgatccgcccacctcagcctcccaaagtgctgggattacaggcgtgagccaccaggctggccttgtttggtatcttctaaatctgttaatctctaggggttttttggtctttgcaattaatttgttggagaaaacaggtcatttgttttgtagactttgggtagtctggattttgctgactgcctccctaaggcaaatattctcaaaaatttaacaagtattctgtcttctacatctcttgtaaattggaagttgggtttatctgctaatttcaacatctccctgaaggccttctactttgaagtgttgcccaattgtttctctaaaaaggtcttgcataagtaaagggatggagatgaattatgcacctttgccctttgtttacattgaagagaatattctcacccacctgttaactccaggttaacaagagacctgctcttacctttgttaactctgtgaacagtgtaggtgtgaacactgcctcaggccgtgggggtagatgggttagcaatgcagaggagcagcttgtcctcattgctgatggaagatggaaataacagatagccacagacttaatcacaggccttcatctcttagccacaatttcagcacccctctctcccctgcccggaatttttttcccctgaattcgagtttggagaccaggagtgcacagggtttggtgaatgaacatcagtaggagttcctgggacaaccttgttcagtgtttgaagaagttttgcctgtggagtgacacccagctgtgacttaaaagatgaactgctggctgggcgtggttgctcacgtctgtaatcccagcactttgggaggccgagaggcaggtggatcacaaggtcaggagttagagaccagcctggccaagatggtgaaaccccgtctctactaaaaatacaaaaattatccaggcgcggtggcaggtgcctgtaatcccagctactagggaggctgaggcaggagaattgcttgaacccgggaggcagaggttgcagtgagccaagatcacaccactgcactccagcctgggcgacagagcaagactcctcacccacccaccccgccccgccaaaaaaaaagatgaactgccaaaaagtggggcgagctttgcaaaggccttgttacataggaaatgattctcatgttttttgtttgtttgttttgaaatggagttttgcccttgttgtctgagctggagtgcaatggcacgatcttggctcactgcaacctccgcctcccgggttcaaaagattctcctgcctcagcctcctgagtagctgggattataggcgcctgccaccacacccggctaatttttgtatttttagtagagacggggtttcaccacgttggccagcctggtctcgaactcctgacctcaggtgatccacccaccttaacctcccaaagtgttgggattacaggcgtgagccactgcgcccagcccgattatcatgttttcactggagcaggtcccaagcggacttctgcttaatggtcaagcctgcattcatccatgtggcagaggcaactctgtgtctagggctgacagaaagatgcaacaagggggagatggcccctgccctcagacggcacatgggtcagtgaggagctaggataagtctaaaagtctagactatgcctggtgtggtggcttacacctgtaatcccagaactttgggaggccgaggtaggcggatcacgaggtcaggagatcaagaccatcgtggctaacacggtgaagccccatctctactaaagatacaaaaaattagctgggagtggtggcacgcgcctgtagtccaagctacttgggaggctgaggcaggagaatggcttgaacctgggaggtggagcttgcagtgagccgagatcgcgccactgtgccaaaaaaaaaaaaaagtctagactaaactcttctgtgtgggagacagccctccaccccagctcctagggcttctatttcataagctccaagttaatgatggttatttctttctttctttttttttttttttgagatggagtctcactctgttgcccaggctggagtgcaatggcatggtctcagctcactgcaacctccacctcccaggttcaagcaattctcctgcctcagcctcccaagtagctgggattacagtcgcttgccaccacacctggctaatttttgtatttttagtagagatagggtttcagtgttgttggcccagctggtcttgaactcctaacctcatgagccacctgccttggcctcccaaagtgctgggattacaggcgtgagccacggcacctggcctaatgctggttatttcattgtacacaaatatattgagtattgagtgctttccctgaatggggctctctgccagggaggtaggctctaacatgagtgacatgctctgtgattagcagacacggatggctgattcttttgctgccattaaactgagtctcagaaaagcttgctggaaacatggttgtactctagggaaaaccaagatcacatacttcattccagcctccagggattggacagcagggtggatgggggagtcacaggagcaaggcctgttcccagccttcaggggttccccatgtatggctgtcagtgctaagaagggctctcctcctcccacctaggtaacgtgaagcacctggttctcttcctccatgaggctgtcctggtgcagtatgtggacacgctcaagctcgcagtgccctctctcatctacaccttgcagaataacctccagtatgttgccatctctaacctaccagctgccactttccaggtgagccccaagcccagcatggccccagaggaactaactgggttggggactggagtatgggaatagcgtggtgggggggtgttgcagaggacaggggctatgtcaccttcagaatgtccttggaactccttcaacctcccttttctcgtctgtgaaaattgggggtggaaatagtaatgcctgttcattgagatgctaggatacttaaaagaaataatacctgtgaagagcccttgattggtgacagataagctttaggctatttgtgggcagctttgtgaaatggttaaagagcctggattctggggccaggctgtctgggttcaaatctcagctctgctaccttccagctgtgtgattttggggcacgtcacctaacctctctgtgccttagttttctcacctttaaattggggcttacagtggtgctcacttcagaatggtgttgtgagaattaaatgaatgaattcacgtgcagtgcctagaaccacactgatatattgtaagcactatgtaagtatttgctgacattgttgtggctattgattcatttgtatcaagtccctcatcacaaagatacttccatacctcagccatcttttatagatgatgatgccagggctcagacagggcaagtgctttgtccccagtcacacagccaggaaatgggattgggatgtggacttcttggcacagccatccttttgtgcacttgctgggagagacttcagaactgttttgctgcagctcagccaatggccagtggctggctccttttgctgtttttgctgtcataccccccaccctgtccctccattgtgcctgggggcccacagtgggtgctgccccccatgtgcacctgttgggggccagggtcagccctcagtgccttccacgtgccactcgcaggtgacataccagctgaagatcctgaccacagcgctgttctccgtgctcatgctgaatcgcagcctttcccggctgcagtgggcctccctgctgctcctcttcactggcgtcgccattgtccaggcacagcaagccggtgggggaggcccacggccactggatcagaaccctggggcaggcctggcagccgtcgtggcctcctgtctctcctccggcttcgcaggtgtctactttgagaagatcctcaaaggcagctcaggctccgtgtggctgcgcaacctgcaactgggcctcttcggcacagcactgggcctggtggggctctggtgggctgagggtaccgccgtggccacccgtggtttcttttttgggtacacacctgctgtctggggcgtggtgctcaaccaggccttcggcgggctactggtggctgtggttgtcaagtacgctgacaatatcctcaagggctttgccacctccctgtccattgtgctgtccactgttgcctccattcgcctctttggcttccacgtggacccattatttgcccttggcgctggactcgtcattggtgctgtctacctctacagccttccccgaggtgcagccaaagccatagcctctgcctctgcctccgcctccgggccctgcgttcaccagcagcctcccgggcagccaccaccaccgcagctgtcttcccaccgtggagacctcatcacggagccctttctgccaaagtcagtgctggtgaagtgagggctggcagcaatggggggacacaagggagggggactggggtggagggtgttgggcatctgcaggacccaagtcgccaccctccggggcctggctcctctgggtttgggagatggtcttttctcccaggtcactgagacttctggaggggtgtgggactagagctgggtgtcacgtgaacccttcctggtagggtgacccccttcccctggagggggttttagagctgccgcctctgctccctctaacctctttggaggcagggttgggggtattgtcattcaaggccttttttttgtctgctccctccccgaccctgtgccctcttctggaggtttctcgtctgggagagtccctcccagcagtccctccacctccataaggacacactggacaaaactcccgcagctcttcaggaatgaccgatgcctacctgtggggttcagttgcccatagtttgaggccttctctcctcccttaccaccgctctggatcatgttactagttccgtcttttgtgtggccttgggccagcttccttgataccttgaagatgggcttcttgtgagtccccagggagaaagggacaagagctaagatttttgcatcagcccttctggcagaaggtgtggtaggggccatttgttttttttagtggacttgggatttgtggtgtaatcatatcattaatgatccagggtgtgggaaaaatggaggtccttgaagtggctgaatctcattgtatttaagacactgtcagttgccagatgtaggcttatttttggagatgtctaggagaggaaaaagctaccaatcatactcttgatatccgtctggctgtgtgaggcacccctacctcatgggggtgtcttgggattgatgaactgtggaacctgcctcctgcgctccccaaagcttattaaccccttaactgtatcggggcggggtgtgtgtgtgcatggaagatgcctgggctgtctttgctatatgtaaatagagccattggatctttatttttgattaatttgttctgattttttggtttgttttttaaggaactgtaatgaacaaatgtcaggatatccaatgccaaataaagatgttgtatttatttagtccacgtgtagctttctgaccaggtgggcaccattactaaccccaggactaccagcctcaccaccgccgccctcacttgctcaggaaacccgcctgccagcctagcccagctttgtgtttttctttcctccccattcccaccacaggttgctcaccaaggtgaagggttcctagccgctgggattgaagacattggcctggcctcgttctctcttcttgcccttggcccagctgggaccaaactctgatcagtattaggggtagagtgaggtagacactggactccctgtccccaccacccctgccccacccagggccaacatgactaagctctctcatgacccacctcagctcagccccccagcccctgccagctccacactatctcttagctgagtttttgcaaataaaatgtgttgtgtatcttgccgacttgggttgggcagcctcaaaggaagcactcaggtatggtgggcaggatcaccagaaagcttttattttaacccagggccagggaggccgaagcttcaatcctgctgcttggttcgggaggcctctgcattggcccggagcacagcccctggggatggatacggccgctgctggaagaggggcccagctgctgtggtgtcagcgccagtcttggcctcattccgcttggggagtcctgttgaccacgtgcccctgccggtgaaagagtcaggggatggggatgggtgatgtggcggacacagcccacctggtcccaatgaggaatggaggaaggaggccggaggatggtgtccacgtactgagtcaagaggggttgtcacttaccggggggcgtctgagtatgagctagggtccatggggtctaactcttcatcctttcggcttactgctgtggaagtggcagggcaaagtcttcaatagaggcaccaggagcccctgatcactgagccccaccccacaagaagaaatgaagcccctggctgccatgtaccacagcaccctcctctagccccaggtccaggcatctttttgagggaaggcttcctcacgcagtgcaccctgcaccttgttggtctcaccgagccccattctgcccagcttacccttcttgctcttgggatagggagccagctcctcccggcgatggtggcgccgttctttgccctcttcccggtctgccttgtcatacccgcggtcccgatcccgttccctgtctcgctctctctctctgtctaccttgtcatagccacgctctcgatccctgtcagacttgtcgtggccccggtctgacttgtcgtggcccctgtctagtttctcatggctgcggtccgacttgtcatggcccctgtccgacttgtcatggctccggtccaacttttcttcagcatctggggacacaagtcttgaagtgacctcttgccaccccaggacccagcagcctctgccttcaacaacctcccttgcctgaggctgggcccgcctggtctcacctgcccctctgatccactatcattctacttggcctctccgtgagaactgctaagatcactcaaggcacgcttgtacctgccaactcacctgcattactgcttctgagcttcttggccgatttggtaaccacggagttggggtcatgtggggagagccaggatacaaggtctgtgtctgcattccagtagtaagggagcccgctgtggggccgcaggaaagaagtgtcagcacagatgtccttgccttggatcctcaactcttgtctccccagtctctgcctatacctgccccatgtcaggaccccacaggcaggatccccagaatctcttctcctgaagagaaaacactgtcagctgggcgtggtggctcatgcctgtaatcccagcactttgggaggccgaggcaggcggatcacctgaggtcaggagttcgggaccagcctgaccaatatgatgaaaccccatctctacaaaaaatacaaaaattagctgggtgtggtggtgtgcacctgtaatcccagctacctgggaggctgagacaggagaatcgcttgaacccacgaggcggaggttgccataagccgagatcacaccattgcactccagcccgggctacaagagtgaaactccgtttcaaaaaagagagaaaagacagtcttccaaccccagaggagccaggccccagcaggcagcaacttgagtcctgcagatacctaatgccaacaccctccacccgaggctccctcccttgtgtccccctaaacctcacaaccaaggtcagcacaggaagggtgaagccagaagttagctccccctcacccaggctcaccaggaagggtcgaacaccttgtaccagcttggtggtaggccctccaacctggtggcctcgtagtccacaggatcatcgtcatagtcctcggcaatgatctcttcctctggttctggtaga

SEQ ID NO: 13010 - DNA, 18620 bp, Human
tcaaagtgctgggattacaggcgtgagccaccgcactgggccattgtttttgtttttgagacagagtctcactctgtcgccccaggctggagtgcagtggcgtgatctcggctcactgcaacctccgcctgtcgggttcaagctattctcctgcctcagcctcccgagtagctgggactacaggccaggcgcagaccaccacgcccggctaatttttgtatttttgtagagacgaggttttgccatgttggccaggctggtatcgaacttctggcctcaagcgacccaccaaccttggcctcccaaactgctggattacaggtgtgagccaccgtgcccggcccattcttacatgtttaaggcatcataggaattttaacattggatctacaagttccgttttagagttttgattggtacaattggtaatgtattcttttttcttttttttttttttttgagactgagtctcactctgtcacccaggctgcagtgcagtgacactatcttggttcactgcaacctctgcttcctggttcaagggattctcctgcctcagcctcccgagtagttgggattacaggcgcccgccaccacgcccggctaattttttgtatttttagtagagacggggtttcaccgtgttggccaggctggtctcaaactcctgacctcaggtgatccacccgcctcggcctcccaaagtgctgggattacaggcatgagccaccgcgcccggccagaagtcatctttattatgtagaggtttcccccttgtacgagatggttgtgtgtgagtatggatgagtttacgaaagcaactgacagacctgtgaaataatgatgccaatacaggaaggtccaaggtaaatgaaagcccggtgaaattcctggaggcgcaactcagggtggggtcttgggatgtcaggaaagaggaagggaaggctgtaggtctgggtgttttgtgagctatttgcacctgaggatatatgagtgagaccctccgccttgtgcgagccggcttgcatgcgtctggcatacagaagcgctcagtgaatgttgaataagtgaacaaatgagtgaatcaactaattttgggaagcttcttgtatgccaaacaacctgctagcacttttcatacattatctttaatcctcagaacaaccctgccagacaggtattttgacccccatttaacaggccaggaaagctgaggctgggagaggggaggtccccttccctattcaaacctggatctttgtgattccagaagtcgtcattcaccgaagggaccagattcattcacccgtcaagaatttattaagcacatattgcgcagcgcaatgaacatagtacaaccgctctcgatggcatggaacaggcggaatactcccggaagaccagctgggcggctggactgcggacagcgaaaggggggggtttctggcccgcaccttcagggaatgtagctgcctgtgcctcatagttatggctttggctgagagagcacagccagatcgaggttggagcgcggtctagggctcagatattacaaatattggccgaaagagggcgcggttccgcagctaaaagcttggccaggagaccctccgtgcgccgactggccatcgatgcgcaggcgcagaggacccaaggagcggcttaatattaccttgcagagggataatttgagaagagagggcgtggctccgaaagcgacgcaaacatagaggcgtggttcaaccaaatcaaccctcgcctatttgtcgctgcccctgagggcgtggtctgggtgctgcttctcggaatgagggcgggccgaatcgcgtttttcctccgcgtcggaggcgtcgcttagggtgggccctcgaatcgccgttcagcgattggccgcctcgctaatgggtcgtggccagacgggccatccatccccagtgcggtcacttcctgtggagtttccccatccctgggaggagggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcaggtgcggggccgcctggggctgggagtgccgactggggctcccaggggcctgatctcgggggcagcgggggccccggactgggattggaggccctcggcctagccttggaggacgtcggggcgcccgtcttgggggggcacctaaggaatccggcagtggcctgcttggattgtggctttattaaaggagtcgtgggagtgcattaagcggggtctgggtcaggtttggggagcccttgactgcgtctagcggggcctattctggagtatccagaaactggtctgagatagctgaacttggtagacagggtctctgattagaggctgaattcggggattttcagtcggacatgaggggaatgaatttgaggggacactgtcaggtgaggcactggttttaagggaatcctagaatcttttttccctcagtgtgggagaaggggtcctgagggacagaagtgctgtcttgggagcttggtgcctctcagtgactggttgctgtgtttggggataacatgaatctggagggatttggaggtatctcagatatgctgcctgggaccagccttgtgagtgcgtgtgaatgaacaagagaagcaacattcagcaagacttgaccagaataatcctttcccctctgcccgcctacccagctggggcagatcccaaggatagtggaaaagccctcttcccacacctgttaagggcctgaatggaagatagacagccaggcagagggcgatgatgttacctcttagctcagaggcctcagaccttgtttgggaacccagaggaggctcttgttcatgctgctactcgctctagcctctcagcccttcccactccctagccccacaccccttttctttttatcttcttttcgatctccgagctcctgggggtaatcttgaatctgtccatagagctggaacgagtacagattgcaccatccctgcctgggtggatcccctctggcctcttctcatccttactttcatcaatgggctttggagccccagccctccctgctcaccccagtgcccatctcttccaacttctgtgcaatgggtgtgtgagccctgggtggggggggtctttgcctcctttgtgcctgggattgtgctgagctcagtggcttgcccgagcttcctcttcccaacttcctgggtggttttagggctccatctgagggtgaggagaggaaggaagacagatccttggggaggggagaggattcttgtcaagtgaagtcaccagcaatctctcagcattctaaatgtttagctaaattgaaggatgcatattcatccacgtgtgtgttaactgtcccttgctctctggggctgagcagagcctttctgtatatcgattcaccatcttctaattcctctgtaacaacctagatcatcgcagtagtggacatagttaaagggatgggtgtatatggcttcttattttgtgcgccagtgggtgttagtgttgggggtgtgtgtgtgttttgatctatccaaaaaaacaggagaaggctgggcaggctcctccggtaagaaaagaatgcttgtataaagtggatcaaccacccaaattctccctcttgtaaatccagtctgttggagcgaggggagcctttgatatttctattttatatttaggcatgtgttggcatcccatgaactctggctggggctgggagaaactcatttgtgaaatggtagatctttacgtcaagtgaattatttccagttctctttgtgatgcattcagtttgtgttacaagggactgttatgctgagggatgcccctacttgctctgtgtgtgtgtgtgtgtacacacatatacctgggctcacattcagctgtaaagaaaatagcagggggttggccgggcgcagtggctcacacctgtaatcccagcactttgggaggccgaggcaagcggatcttgaggtcaggagatcgagaccatcctggctaatatggtgaaaccccgtctctactaaaaatacaaaaattagccggacgtggtggcgtgtgcctgtaatcccagctactcgggaggctgaggcgtgagaatcacttgaacccaggaggcagagcttgcagtgagctgagatcgcaccactgtactccagcctggtgacagagcgatactctgtctcaaaaaaaaaaaaaaagtagggggtatgggggctgggagaactctgaataggaagtcaggaatccttctataaagtgaattgttattcctaaattctgttttcctcaaacccaggttgttacagtgtgggggttgggatgcaggcgttcttattattctgactcctaagggactatgagtaacacagtggggaagggaaagggggatgggggaaggaggtgggaattcatggtggtgtggtacccagcaaggtggccaaatatgaggggcttgtaccctcctcttcgttctccccccctctctgtctctttctctgtctcaggggagggctggggaataaggtccttcattcaatcactgaccaccactccacctccccctcagcctgaactctttgcttccggaatccgggattgttgctgacatagaattagaaaacgtccttgatcctgacagcttctacgagctcaaaagccaacccttaccccttcgctcaaggtatgtatgacttgtctatctgattcccctcccaattcctcagccctcctctcccctcttgatgggcagaggccctcagtaccagcccaacccattctttcaccagcctgcgttttctagtggtggtaaaattagggaccagaaagagcatgtcacacaggaaagtaggtggccaagctaggattccagtatctctgtcaagacctcccctgcctgcccccagcccacctgcacacccattcatatgcaagtgtttcagcctcaggtgttccagccggcctggagtgctcagagatagggcgtggcctgcttaaactcatgtccccgggtgggcggggacatgcctctagccccaactcagtcccttcccacactaccaactcacccaccctcagcccttgaggagcccctgctggtctcttctttccccaagcttggaagtctaaatgtgctgagtcatcggcccgggctctgagagaggggaggggagggggaagaggggcaggaagagagtattgtgaaatctccgaggttttcaagactgactagctcctgggaccagaggcccaggcaggggaagaagaggaacctggggcttctcctatcacctgacgcccacccccaggagctcagagagcttctctagcctcacattgggcttaggagccctctgtatccacattctgctgccaaagcctcaattctgcttcttctgctctcctgtaaataggacaaacccccccttgcagagctgaacaatagcatctccacttaatatgtgaacaggctcaaatctaggcttcaccataaggaccaaaggctaaaactcccccaccagactgacctccagtgtgtcccccatcagactgtgacccctgagagccatcaccaagcctggttcctgtgtctctgcttctacattgtggcctcggaaggcagagaacaggcctggttcctgtgtctgctccgtcacgctaagaccctttaggcttgggatgagacttttagcttacctaaaatatggccccatatttcccattccacagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtaaggtgagatccagaggccctgggagggggctcctggtgactgaggagtgatcctaggagctagggatggcctcgatgcactggtgatttgggggcaaggtcttaggggctctaaggaaggtccctggtactgtttaaattatctgtgttcatgtctcatgtgttttgggtttctgagatgatcttgtgaaattgcgaggagttcgtgggggccatgaggatgtcttggtggaccatggaggctcatgagtgccccaagtgggccctggctttgtaggaagagcttcatgtgtgtgggatacattagttctttggccattagggggtcttgggaagcattgtatggttcccaggtctattaggtggtgtcagagactaggtggggaatcttggggactgtgacagggttttccagaaactacgagggatcctgtcagtcatgggtggatcttggcagctgtgaaggatttctgagaaagagagtttgggtcctgggggagactcgctaatatttttggggtgttctcagattctgggcccagcttgtctgcgtgagtctaggcaccaatgagttaggagggtcaggctggggctcagaattcacccctttgagtcctgttctgccttgtcccctctctttccttgtctaccttatttcacaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggaggtaagaggctacagccaaacctcctcccacattcccctcccaaattcttctaaacctgtataatatttacttcttcccctagattgatgatgtcattgatgagatcatcagcctggagtccagttacaatgatgaaatgctcagctatctgcccggaggcaccacaggactgcagctccccagcacggtgaggccctgagatgggaggttggtctgaaaattagggcatttctgtatcaccaagaccatactcagtctggctgtgtgtataggagacccttgccttgattgtgctaagatagagagggaggccttatgacgagaacagggtatgtcaacaatgcctttggaccttgttggactgtgttgagaggtggaccatgtagactgtgagagatacaggtggggagttcactgagacagtagggcatatcaaagtgcttgggctttgctgtgagaagtaccaagagatgataatcttttttttttttttttttcgagacggagtctcgctctgtcacccaggctagagtgcagtggcgcggtctcagctcactgcaacctctgcctcccaggtccaagcgattctcctacctcagcctcctgagtagctgggattataggcacgtgccaccataccaagctaatttttctatttttagtagagacggggtttcatcacgttggtcaggcgggtcttgaactcctgacttcgtgatctgcctgcctcggcctcccaaagtactgggattacaggcgtgagccaccacacccggccgagatgagcatcttatagcaacttgaatgtaccaagggattcaggtcatcgggacatatacaccagaccatgtaatgattggagcattttgttttattttatttttaccttttttttcttttaagacagagtctcactctgtcaccctggctggagtgcagcggtgcgatcttggctcactgcagcctctgggttcaagcgattttcgtgcctcagcctctcacgtagctgggattacaggtgtacgccactacgcttggctaatttttgtatttttagtagagaccgggtttcaccctgtgagccaggctggtcttgaactcctgacttcaagtgatccacctgccttggcctcccaaagtgctggaattacaggtgtgagccaccacacctggccttgaagcataacaaaagttttcaaacttgctgtgggttataacaagtagttggatctcgtagtgattggaatataccaagtgaactgtgccaggaggcagagtccttctagtcagtagataaaactttctagagcaagggatataccattgtaacattctggttttgaacactccaagagtctcataacttgctttattatatttatttatttattttttgagacaaagtcttgctctgtcacccaggctggagcgcaatggtgctatctcggctcactggaacctccgcctaccaagttcaagcgattctcttgcctcagcctcctgagtaactgggactacaggcgcgtgcccccatgcccggctaatttttgtatttttagtagagacggggtttcaccgtgttacccaggttatctcaatctcctgactttgtgatctgcctgcctcggcctcccaaagtgctgggattacaggcatgagccaccatgcctggcctaacttgctttatttatttatttttttttttttattgaatttttttttttttttttgagatggagtttcactctccttgtccaggctggaatgcaatggtgcgatctctgctcattgcaccctctgcctcctgggttcaagcaattctcctgcctcagcctcccaagtagccgagattacaggtgcccgccagcacgcctggctaatttttgtattttagtagagacggggtttcactatgttggtcaggctggtctcgaactcctgacctcaggtgatccacctgcctcggcctcccaaagttctcggattacaggcttgagccactgcgcccggcctatttatttatttttgagacaggatcttgctctgtcacccaggctggagtgcagtggtgtaatcctggctcactgcagcctccaccttccgggctcaagtgatcctcccacctcagcctcccaagtaactgggaccataggcttgtgtcaccatgcctggctaattttttgcatttttagtagagacagggtctcactgtgttgcccaggctggtctcgaactcctgagctcaagccatctgcccacctcggcctcccaaagtgctgggattacagacatagccaccatgcctggtctcataacttgctttagagcataccaagtggctgtagttttgcttttttccaacttatcaataggatggaagcatgtataaaaatgggactaatttatcagaactttttattgatttggacacaactagagaatgggaccttatatccaccagactggaagtgggttcaagagattaaagctcagccaggcacggtggctcacacctgtaatcccagcactttgggaggctgaggcgggcagatcacaaggtcaggagatccagaccatcctggctaacacagtgaaaccccgtctctactaaaaatacgaaaaaattagctgggcgtggtggcgggtgcctgtagtcccagctactcgggaggctgaggcaggagaatggcgtgaacccgggaggcagagcttgcagtgagccgagattgcgccactgccctccagcctgggtgacagaacgatactccgtctcaaaaaaaaaaaaaaaaaaaaaaagagattaaaactcatgaagaagtgggatttggatatactttattttatttgtatttatttatttatttatttatttatttatttattttgagatagagtcttgctctgttgcccaggctggagtgcagtggtgtgatcttggctcactgcaacctctacctcctgggttcaagcaactctcctgtttcagcctctcaagtagctgggactacaagtgcaggccaccatgctcggctaattttttttgttgttttgtatttttagtagagacggagtttcaccatgttggccaggctggtcacgaactcctgacctcaagtgatccgcccgcctcggcctcccaaagtgctgggattacaggcgtgagccactgcacctggccctgggtatacttaagattgacgtgctcctctggagtatatccaggaaagtgtgaaggagaggaaaaaaaaaaaaactaggctgacataaagcagtgctaattgaatagttggataagaatctcctgagagaacagaatgtgcaggaagatactggagtcaggaccttggtccacagcagcaggagaccctgatgtggaagatggtacaacttgatcagagtggaagatggtacaacttgatcagagtgaaagactggagattaggttggaattctccagaaggccagattttggatagaatgttgtcatgacaatttaccaaggtcggagaagattgggttggagtgttccaagaatgctggattggaatgttgtgctgggaggagctaacggactggaatgtcccatcagagccgacaaagacctgagaagggtggttttccagcatttcttctcagagccagccccggggtttgggaaaggggctttagaggtcactgagggatatgagggactggaggaagtgataagcaggccaggcaggctccagtctcccagcgaagcaaggtaggtccagtttgctctgtcctccctgtttggtcgccatgtgaatttgccttgaaggagaagcaagggttctggtgctgagtcagccagtccttgcattagagggtgccccatctttgggatatgtggaagctcaggaacctggttctgaggaggagccaagcctgggtttgttcccaactggtggttctctgccctctctgcccccagctgcctgtgtcagggaatctgcttgatgtgtacagtagtcaaggcgtggccacaccagccatcactgtcagcaactcctgcccagctgagctgcccaacatcaaacgggagatctctggtaggtgatagggtcttggccccatggccctacactttaccccaggtgagccctgtgcctaccaggtctagagatgggcctgattctgaggggaatggtttggacatatggaaatggaggctgtttgtcccctttccccctatggcttgtggtcttgctttcaccccacttcagttcctctcgtcttggatttaacaaccagcctatcaccatggcttaaaatagtaaaaagaaggcactttttaaaaaaggcatttcccctgcttttggctaccaaaccctaccttagtatctgcatgtgtttcttgccttcctgtgctcagaggccctgatcactccactcttttccagagaccgaggcaaaggcccttttgaaggaacggcagaagaaagacaatcacaacctaagtaagccagagagcgtgtgcattgcccgggtgctgtgcaggcctgcctcaccccgagtcctggccccccatggggaactccttccctgcaacagcctcccaactccctactttctgtctcttccatttttggctaattgacaactctttctcccactctttcttcctctcctcccctctccaaagttgagcgtcgcaggcgattcaacattaacgacaggatcaaggaactgggcactctcatccctaagtccagtgacccgtgagtctgggctgggaccctcaggccagcgggaggtggggcaggcgtcccatgctactaaaattgtgccttggtgggctcaccaggcagtctcggcccaggcatttctcctctgtctggttctttctcagcctgagcagggttgcagaccctcactatgtcagcacctaaaattttaggcacataatgttatggtctgtgtgccccatctggtccccgtaggatatatgcacctacttttctgttcacttagtacttcctttttttttttcttttttttgagatggagtctcacgctgtcacccaggctggagtgcagtggtgcaatggtacttcctttatttattcaagatttatttattggccgggtgtggtggctcatgcctgtaatcccagcactttgggaggccaaggcggggtcgatcacctaaggtcaggagtttcagactagcctggccaacatgatgaaaccccgtctctactaaaaaatacaaaaattagccaggtgcagtggctcacacttgtaatcctggcactttgggaggccaaggcaggcggatcacgaggtcaggaggtgaaggccaacatggtgaaaccctgtctccactaaaaataaaaaaaatttagctgggcgtggtggcacgcacctgtaatccccgctactcgggatgctgaggcaggagaatcacttgaacccgggaggtggaggttgcagtgagccaatatggtgccactgcactccagcctgggtgacagagcaagactttgtctcaaaaacaaaaaaaaaaaaagatggccgggcgcagtggctcacgcctgtaatcccagcactttgggaggctgaggcgggtggatcacaaggtcaggagattgagaccattctggccaacatggtgaaaccccatttctattaaaaatataaaaattagcggggcgtggtggtgggcacctgtaatcccagcacttggggaggccgagacgggtggatcacctgaggtcaggagtttgagaccagcctggccaacatggtgaaaccccatctctacaaaaaatacaaaaaaaattagctgggcgtggtggcgtaggcctgtcatctcagctactcagaaggctgaggcaggagaatcgcttgaacccaagaagtggaggttgtagtgagccgagattgtgccactgctctccagcctgggtgacagagcgagactccatcccccaccgccccgcaaaaaaaaaggaaaagagaaagatttattttttgaacctctggtttgtgccaggtaccatattaggccctaaagataccagagggaacaaaacagacctcatgaaactgatgttttagtgggggcagacaaatagtaaataagtaaacatccatgagatccattatgatgagtgttatgagaagaataaagactggaaggaaaatgggagaatgttggggagggttagtttgggataaggaaggtgaggacagggcaggccccaactgacaaggaaacgtttgaataaagagcctaaggaggcaaggcggggagccgcatgggtgtctgggggtaagagtattcaaggcagagggcacggctgggattgatgccctgagatgggagtggttttccatattctaggagcactgagagaccaatgtggctgtagtgagatcaatcggagggacatagggaagagaggaatcctaaggggtcaggtcagagacggcttccagggtttggagtgtgatggggcaccattgtaagattccaggcgggaagttttcctctggatactccatacctttgaaagaccccagcctcaagttctaagcatgtggtgggaggctcccacctggtgcaatccccgcctcagctcctgagaaactcctcatgtggcatttcctgcttgcctcccacttgggccccacagggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggtttgaaaagaggagatggtggtgggggaagagggggagagcttcctgcaggtggaggcagagagagagcaggccagggtttcccttcctggcatacttgggggatccctgggcttcccagatcacacgatgatgatagtgataatgataaataataatcataatattaacaaggataataatattgctaatgtacatagcatttatcttgtgctctgtactgtgacaagagctttatatccactaacttattcaatcctcagaattctatgagataggggccattattttatttatttatttatttatttatttttgagatggagtttcgctcgttgcccaggctggagtgcaatggcgcaatctcggctcaccgcaacctccgcctcccgggttcaagcaattctcctgtctcagcctcctgagtagctaggattataggcatgcaccaccacacccagctaatttttgtatttttagtagagatggggtttctccatgttggtcaagctggtctcgaactcctgacctcaggtgatccacctgcctcggcctcccaaagtgattacaggcgtgagccaccgcgcccagcctaggggccattattatatacccactttacagtttgcgactctgaagcttcagagatgttaagcaccttgcctaaagttttggaactagtgagtagcagaagctgaattccaacccagggaacctacccttttcaacctttatactcctctgcctctgagggactctgaaccctacttatcctgcacccaacccctattttttacaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaagagtctcctgtccttgttttacactgtgcagtgaacatagcccatgcaggccaagagggataaaagtccttgggagaaacagattccagaaggatggataaaagaatttagaaaggaagagggcatggaggaagacaatatgcaaacaaaagacagtatttttaaagaccaatcaccaggcacaattttaactgctgcaagtgtttcatctaatttatttctctaaagggatgttagtcagaacatgctgcttcttacttccatttggtctttgaagaagctgaggaatagaattgaactgttctgaagatatgcaagcctgtaaatgggtgaggcggtaaaacagtaaagtcaggtgagtgagggctcgattgaaaaatgccactgagggcagagggggaaagaagcttttcttgcaaatccacttttgaaactgataaagaagtctatgaggatatttcctggcagacaacagaggtatttaagatggtggaaaggacaaagacaaatatctgaaaggcagaggaacaagcaaccaactgaattttggaacagatgttgagattttgggagaatttaaatgaacacaagtatcttcttgaaggctgggaaaaagtattttcccgcaatttctcaaccagacactgactcctagaacaagcatcaggcctggtccctccatttcccccaccagactgtgacctctgagggctggaactgggcttggtcaccgtgactaccctagactgtgaccaccatacttgttatctcttttttttttttttgagacaatctcgccctgtcacccaggctggagtgcagtggcatgatctcggctcactgcaacctctgcctcccaggttcaggtaattatcttgtctcaacctctctagttgcgattacaggcatctgccaccacacccagctaattttttgtgtttttagtagagacggggtttcaccatgatggccaggctggtttcgaactcctgacctcaagtgatctgcctgcctcggcctcccaaagtgctgggattagaggtgtaagccaccacacccgacccttgctagctctttctaacctatcacactgctacccctccaagcctggttgctgaatctctgtaaccagactgatggctccctaataacctttattttttctcctcaactttgctgtactctctctctttttttttttttttttttttttgaaacggagtctcactctattgcccaaactggagtgcagtggcatgatctctgctaactgcaacctctgcctcccaggttcaagcgattcacgtgcctcagcctcccaagtacctgggattacagacgcgcaaccacgcccagctaatttttgtatttttagtagagacagggtctcaccatgttgcccaggctagtctcaaactcctggcctcaagtgatatacctgccgtggcctcccaaagtgggattacaggcgtaaaccaccatacctggccctatactctcttattttattttattttattttattttatttatttatttatttattttgaaacagggtttccctctgtcacccaggctggggtgcaatggcgcgatctcagctcactgcaacctccgcctcccgggttcaagcgattctcctgcctcagcctcctgagtacctgggattacaggcatgtgccaccacgcctggcaaattttaggtacttttctttttttttatatggagtctcgctcttttgcccaagctggagtgcagtggcacggtctcggctcactgcaacctccacctcccaggctcaagcaattctcctgcctcagcctcccgagtagctgggattacaggcacctgtcaccgcgcctggctaa

SEQ ID NO: 13011 - DNA, 9838 bp, Human
attctttttgtagaagtttctgcaccatttggcccctgccaatctctcgccgctctgtccagtgttcttggcctttgcctgcaatttgccctcccctgtcctgagccaccaaccttctttgtctttcaagacagagggtcacctgctgagaagcccattcacattctcacttctatctaaaaatctccccagtagctgtactacagataaacttcatggcacgggtttgatgcctgacttatctgtacatctctgataccaacatccccatcaaggcctggcaggcttatagcaaaccacccccaataacgttgggtgaacaaaggagagtacatgtgtgcttttttggtgttgtctgtgtgtgtgtgactgtggtgagtccaagtcttcatgtgcagctcacagagtgtccccagttgtgtgtgtgatgaagggcttgtttccaggtgtgtcagatggtgactgagtgtgggactcttatctctgacagtttgtgtctaaatccaagatgcgtgcatgcctgcgtgggtctgtctgtgacagtgcatctgtggtttctgtctgatggggtggatgtccgtttgtgttcctgcaacagattctgggtagctatttctggacagtttgttccattgataaactgcatgtgtcatggtgtatgtatgtctgtgtctgaacaggtctatccatgtctgtttttgtgacactgccacaaaatgtgattctatcacatcagtacatgtctgccttcagagcagtgcatgtgtgtccctggagcatctgtgcatcttcctgtgacagactctgcgtctctcatttctgggacagtacaagtcttgctgtgacagtgcatatctgatggtgacagtgtgtttgtgacaagttctgccagtgtgacgggacatttctgtgtcatcacatggcaaatgtaggtctgcgtgagtgcctttctgtaacagtgtatctctgggtgtcattctaggacataactatttttctgacagtgtgcttgcctgaaagtgtatgtcagtctctggctgcatgtgtatctaggtcgtttctgtgaatgtgtctgacagtatgtgtttgtgtatatcttggcattcatgtgtctttggagtgcatttttcttcctggggtgtggcgccttttctggctgtttttcacaaatttgtgtctgagagttgccacttctctagcagcctctatcatgtctctcagtccttgcctctctcaactccaagagcagccccatgccaccaccactctgggctcacccccatcccccaagaaccaccccctgctgttctagattctagacttgctgactgggcccagggctcagggttaaaagctccaataaacactcaccaggcaatgctgcctttgaccaatgcacacccgtggcgttgatggtaggggttccccctccctggctaccagatatttccagggccctggcctcagctttccagtgaaggccgccagtcgcctggaggactccggtgaaggagtccgacaagcacctttcgagacggagtcttggatagccacaagcgcgaattcttagaagcccggcctggcgctatctctgtgctaatatccaggcagcggcggcaaaccaacttcccaggaaaggatactgcgcagttattttttaagtgtaaatacacacacacaccgccaccactaccaacaacaaccccgcgcaacaaccaaaacaagcgcggtgctgcaaagggattcccagaaccggtttcctcttggtgtgagccccacctcaagccccctcatttacatgcaggccccgcctcctcggaagaaccgagcgtgtatttgcataagggggcccttgaaacgatgagggtggtatgcaaataagaactggctccgattggctgtggtacagcaggtgccgcgtccggattgatcaaagccaggtgggcggggctgtcgcccagggtgactctcccgggaggcgcgtgcccaggctcagtagcattggggctggcgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggtgagtacatcctcccctactgcaaccagacggggtgggctggaatgatgggttgcagcgcggggggagggagtcgtggctgggctcagcacgccgccaccctgacttcctcgcctccgcctgcgtaggaggcaaggatcgggaagcgttcgaggccgagtatcgactcggccccctcctgggtaaggggggctttggcaccgtcttcgcaggacaccgcctcacagatcgactccaggtatccgtcatgagggtcttgggagggtcaggtgcgtgtggcgggggcgggggtcctggccctggaatgctggttgaccgaggagtgagcctgcagagtgtgtagaggaccaggtgtgtgtgtgtgtgtgtccgtgtccgtgtccgaggagtgagcctgcagtgtgtgtagagggccaggtgtgtgtgcgtgcgcgtgtgtgtgtcggtctaggaggttatgggcggggggggggggcagggggcttcagattccggagttccttgaccccggggtccaggctgtgtatgtgtgggaaagcagggacctagatgtgagatttgtgggacttttggaggtaggtgtccagtgtggagtcatgcggaccaggaccctggtacagagttggggtgtcgtagagctaaataggaagattgtgggcctggggtatcaggaaatctagaactcaggacttggagtgatgagtcctgatgcctgagaacggagagcccagggctaaggaaggtgggagagataaacttggttccgaggacctggagggcaggggagacgccctggtacgcgttctgtggggtgctgtggttggggaccagaaagactagagtgctggtagatggaggaatactggaggtaggcagaaggtctagactgggaggggtctggggatcacctgctggcctccttatcacggccttcttctccaggtggccatcaaagtgattccccggaatcgtgtgctgggctggtcccccttggtgagtaccttcggagcccttcctaacctacctactccatcactgatgtattcacctccttgcttttccaggggatgtatgactccctgggccctgtaacagtgagaatactgccagtccatttatactcccttggggtgacatacagttctgattcaccccaattcccctagagccctggattctcccctccaacaaacctttaccatccttcctccaaacactgctgggggactgcccgcagggcgtgctggtggggaacaaggggcagaggtcactggttgccatggtgatggtggctgcttctctcttgccgttataacgctaacggacatcagggcgggtctgggcaagttgtagagttgggagcgccccctggcgggctctaggggaaactgcgcctgcgcagtccatgggacccaaagggagagggtgcgcctgcgcaatatcggtatttttgcatctcggtgagaaaacgtctgctgccgtgcaagtcagcagcctggccaggagagggctctacctcatcccagaaggttgctgctcgaagtgtacctgcgcagggcttggggaggcagtggggggcggattttgtggcccccagcgtttatacttttttttttttggagacacagtctccctctgttgcccaggctggagtgaggtgacgcgatctcggctcactgcaacctccgtctcctgggttcaagtgattctcctgcctcagcctcccaagtagctgggactacaggagcgcacaaccatgcccggctaatttttgtatttttagtagagacagggtttcaccatgttggccaggcgggttttgaactgctgacctcaggtgatccgcctgcctcggccactcaaagtgctgggattacaggcatgagccaccacgcccggctgcatttatgacttttttttttccttgagacggagtttcgctctgctgcctgggctggagtgcagtggcgtgatctcagctcactgcagcctccacctcctgggttcaagcgattctcctgcctcaggctcctgagtagctggaattacaggcacccgctgccatgcccggctaagttttacgtttttagtagagaccgtgtttcaccatgttggccaggctggtctcgaacccctgacctagtgatctgcccgccttgggcctcccaaagtgctgggattacaggcgtgagccaccgcgcccagcctctaattttgtatttttagtagagacggggtttctccatgttggtcaggctggtctcgaactcccgacctcaggtgatctgcccgtctcggcctcccaaagtgctgggattacaggcgtgagccactgcgcagggccacatttaggctttttattggctggttctaggtgcttggtgatgctgacaaaacacatgataacactaagtccttttgtgctaggtcctttgtaataaatcactcagctgtttaacaaattaggtatattgaccacctactatatgacagacataattctagacactcagcaaagtattacataagtattgagagctcattttgtgctaggtccttttttactaattgttttcacctgtttaacaaatatttattcagccctactctgttagcagccactgttctagtgcttcatatacgtccgtgaacaaaacaaaccattacacaataagtgtttattgagtgctaactgcttgtcagagcccatgctattaagtgctgtcatctgtttaacatttattgatcacctgtgtaaggtactattctaatctgggatatgtcagggaacaaaacaaaacacataatggtggtgctgcttctgctgaaagccttcagttgataaccagatttttctttgtatttttgcttgtttgttttgagacagctggagtgcagtggtgtgatcttcactgcaacctctgccttcttggctcaagcgaccctcccacctgagcctcccaagtagctgggactacaggtgcatgccaccaagcctggctaatttttgtgtttgtgccattttgcccaggctgatcttgaactcttgggctcaagcaatccacccacatcagcctcccaaagtgctgggattgcagggatgagccactgtgcctggccgaacttctttcgtttattcaaatgtttattgatctacgacatgcgagatttgtgcaggctctttgctggtttcaccctctcaatcgctgtgtgagtttgtgtctttagggaaagtgaggcccaggaagggaagtgagttgcttagcgacacactgtcaggaaaaggggccctgagttgagcttaggtaaaaagcctcagagctgttgccctgacatctgtcttttttctctccctgcttcccaccccacctgtgcccccagtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatggtaaggcttctctaaatctccctggagggattgtttttacttgatggccttgtgacctttggcctccagtggtggggtgtcctgtaatccttgacccatactgcattatataagatgatcgattgctaatactggggattctcagccttgccctctgataaagtccatcttttaatggtgtgctaaccttattctgggctcctattctggtgaggggatcctgttaccatcctgagtattctttctctggtaaggggatcctgttacttttcagtgcttttattctgttgaggggactctgttattttagctgctttttatctagtgaggggactctgcttttatcttgagtgctcttaattgtggtgaggccatccttcctggagagtttggggttggagaagggcatcatgagattgagttggtctaacccctggcttgtgtgcagggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccaggtgaggcctcactgaccccagcccagaagactccatccttctcagggaccagtaccccctactgactgctaatcttccctctctgcttcttggcctacagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttctttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatcagaagcggctggccatttgtaggtgtgaggcttttatggagcatctactgtgcactgagacagactgtccctctgctttgtcctcaggaagccacagtcttatgttgccatcctaaagagctttaaggattcttgaagctgcaccacacacacacaaaaaaatcttgattcccctgcccctgatcttatgcagtgcccagtatgtgcagaagggttctctgttggagatactgtgcatattgaaggtgtttagggcacatccccaatcaagatggctatctcagaagcagaaaaactaccttccctggcaccccaggggaatgaagaagccctttcccctgttgcagaagaaaagccctgtcagggtactggccagggcggggctggggttgggcgctgactggaatctgtccagggtgtagtcacctgttttgctctttatctttagcctcttcccccatctttacccttacatacccatccctctaatttctccttcaacacttgacttacctggcctaccctattccatgttggtttcacttgttccgacctgagttgttccctctcttgccctgcttatttgtctcggttcagtataaactccgccttccgggttccagcggttctcctgcctcagcctccagagtagctgggtacaggtgcataccactaagcccgggtaattttttttttttatttgagacggggttttgtcgttttgcccaggctggaactcctgagctcaggtgatcgcccggctcagcctcccaaagtgctgggattacaggcgtgagccaccgcctctggcccggactcttgccctgcttccaaatgctagctaacctgtgagcctttcgcctgtcccctttgccatcctcagtggtgactcacttgtcttcccttatgtgcgtcaactttcctttgcattttcacttgtttatcctcacctgctctgcttttatctgctagcttaacattcctgactcgcacctgatgccagtacgccctcaccccgaccccgccaggtcaaagtttcttcgtccccagattcccgtgtgctctccagggggcgaggcctcgctggaagacgggaaagcggaatttcagtccaaccatgaagcacctggtagtttctgatacggaaagggcggcgccttatggagaagctgccaataaagagccgagatgaaaggggtggctgaaccaatgagtctaggagacaagatcgggggatgatctggaaagcgcgatcagtgaagcggacgaacggcaggataaggcgggtctagtgacaggaatgggccgatgaagctctgtagggatggtgggtaggccgatcgggccgtgtccccggcctcccgatccgacggaatttggaaatcccggggctattcatacattgagcttttaggagcggaggagaaaagccaccaccctgacgatcccggctctcgctccaccttcactcaggtggcccggcagcggaagtgacgaacgcggaagtggtttttctgttgccgaggggacgggccgggcagatgccaacatggcagcggttggggctggtggttccaccgcggcgcccgggccaggggcggtttccgcgggtgcattggagccggggaccgccagtgcgggtgagacagtctgcccgagcagtcgcatgggaggcggaggtcgggatcgctgggagtcgggaatgttcctcactaaagtgagagggagcatcccgtgtggaccgacgtgtgtgtgtgtgtgtgtgtgcacattgtcagtgtgttgggggcggggaagagaacattctgagagtgattgtgggatccttccgcatatggagagtagagaccattgtgagtgtggtgggtaattctttttgggaaggctaaggccaccgaaaccattctgaatatgtggagtccttccgtgtggaagagaccattctgcgggtgtgggagttcctcactgaagaagggggagactattctgagggtggtggttcct

SEQ ID NO: 13012 - DNA, 11085 bp, Human
gtggtggaaaacatccatttgcaccgaaatcggtattagtttgttctggctgctataacaaagtaccacaactgagtggcttcagcaacagaaattgatcatctcacagttctggaggccagagtccaagatcaaggtgttgccagggttggttccttctgggggccataagggagaagctgctccaggcctctcccccagcttctggtggttgctggcaatctttgttatttcttggcttgaaggagcatcaccccatctctggcttcattcattcactcaccttctcatctcaccagtgctctcccaggcccttgttcggagcctccacagacccacactcctgtttctcacgcagtaatgttctaagcccccaggagactaagaacttaatacctggattctcacactcatctccctcagcaccacagctctgacaaccacccccaggaggtgacagcaaagaaaggaaggagcaactgctcccccagaacccttctatactcccccgggctgctctcagcagctgtgtgcccaactcagtgctgtgaggtggaacggggagatggagacacacacacacacacaccagagagtttataaaatgtgcacacggaaacacttcctaaagaaagaagtggagttctcaagtcactatgggactacggaactcggcatctgagcatccccttctgtataatggggttggctgggcagtcccttccagctctggcttcctctcagaccaggattataggatcctgaaaagccagtgcttccctcagggagtggaaggttctggggctcagcagggggcccggagccattgtggagggctttcaaggtgaggacaatagaagagcaggtcttgcgtggcttggacagggaaagaggagaaggagtgggcatttgaggcagggggtgtagcatgagccaggcttgagggccagaaattggggtgaactctgatgggggctgggtagagaagcttctacaggccccagctcaagagaccccgtctctcctcctctctgtcacttgccatgctggatccgtgcatgatcacactcctggactcgcctccttgccctgagatccagacccccgtattcagctgccccctcagctcctccactcacatatttaatgccagactcttcatgtctatctacacctgcacttttgcacccaatccaactccccgccatgtcccccatctcaggtaatgtcagctcggtccttccagctgctcaagctaaaacccatgtcactttgactctccctcttgcccactacatccaagctgctagcactgctcctgatccagcttcagattaagtctcagaatctacccacttctcgccttctccactgccaccagcccattctgtgccagcatcatcacttgccaggactgttacaatagcctcctcactagccccactcacagcagccagatgaatcttttgagtccatgcctagtcactggggcaaaataggactccgaggagaaagtccgagaccagctccggcaagatgagcaaacacagcctgtgcagggtgcagggagggctagaggcctgaggcttgaaacagctctcaagtggagggggaaacaaccattgccctcatagaggacacatccacaccagggctgtgctagcgtgggcaggcaagccaggtgctggacctctgcacgtggggcatgtgtgggtatgtacatgtacctgtgttcttggtgtgtgtgtgtgtgtgtgtgtgtgtgtgtctagagctggggtgcaactatggggcccctcgggacatgtcccagccaatgcctgctttgaccagaggagtgtccacgtggctcaggtggtcgagtatctcataccgccctagcacacgtgtgactcctttcccctattgtctacgcagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcaggtgaggccctgggcccaggatggggcaggcagggtggggtacctggacctacaggtgccgacctttactgtggcactgggcgggaggggggctggctggggcacaggaagtggtttctgggtcccaggcaagtctgtgacttatgcagatgttgcagggccaagaaaatccccacctgccaggcctcagagattggaggctctccccgacctcccaatccctgtctcaggagaggaggaggccgtattgtagtcccatgagcatagctatgtgtccccatccccatgtgacaagagaagaggactggggccaagtaggtgaggtgacagggctgaggccagctctgcaacttattagctgtttgatctttaaaaagttactcgatctccatgagcctcagtttccatacgtgtaaaagggggatgatcatagcatctaccatgtgggcttgcagtgcagagtatttgaattagacacagaacagtgaggatcaggatggcctctcacccacctgcctttctgcccagctgcccacactgcccctagtcatggtggcaccctccggggcacggctgggccccttgccccacttacaggcactcctccaggacaggccacatttcatgcaccaggtatggacggtgaatgggcagggaggagggagcaggtgggagaactgtggggaggggccccgagtcaggctgaaccacagcccacatgtgccccccagctctcaacggtggatgcccacgcccggacccctgtgctgcaggtgcaccccctggagagcccagccatgatcagcctcacaccacccaccaccgccactggggtcttctccctcaaggcccggcctggcctcccacctggtaacacctcagcccgtaccccatggcttcacagaacccccaagtccccagatccttggctgtgagcagtgtaggctattctgaattgcagtactctgggggtcaaaggtgtcaggtctcagaggcttggaaactccaccctccaaaaaacgtcaggtgcagaaccttaaagatgcagaatgtcaaaatcacaaaaccacagagctttacaaagctagtcaaaatgtcagcacctgcgaatggccgtctttaagcttctctgccagaagcctgggactttggggacagcagagccccctgggagtcagggttttcgaggctcaggagggtgggaagctcaaaatgagaggccttgtgggccaagctccagagcccagcccacagcctccataggtgccctgtccccacccacagggatcaacgtggccagcctggaatgggtgtccagggagccggcactgctctgcaccttcccaaatcccagtgcacccaggaaggacaggtcagtggacagggctgggaaggatcctcgccctcctatcccctcccctgacaccctctgtccccccagcaccctttcggctgtgccccagagctcctacccactgctggcaaatggtgtctgcaagtggcccggatgtgagaaggtcttcgaagagccagaggacttcctcaagtgagtggcccaggcctgtgccagtctaccggccctggcttgtggggagaggtctagggtgcagatctcagctcaggcttcatcccaataagtagtaagatgcaagagctaaactctgagactgtgggttcaaatcccagctccatccctgactggctgtgtgaccttggacaaattacttagcttctctcgacctcagttttctcgtatgtataataagaaacgtttgtgctgttatttacccccattttacagacaaggagactgaggccaaagaggttaagtgtcttgatcaaaatctcccagttcctgagtgacagagctgggatttgaacccatgtagccaggctctagaatctgcactcctgctttgccctgctactcctcatgccaacatgccagccttattccactgttcccaaagttctagctcctctagatggctgctgctgcctcccctcagtccccccatatgtctctctctctctctctctctctctctctttctctctctctcacacacacacacacacaaatacacaccacactacacacaacccttagcagcaaccccacatgtcctgtcctccttgcagccaggcctttgcacaggccgtccctccacccagaatgctttgcccactctcacctccctggcccattctcaactcaccacacttccaacattatctccagcactctggccaggctcaagtggtgagttcaggcctgacatgcagtaggtgctgaggggcatgtgttaagggaacgaggggtgtgagagggagactgaggtagagaggggaggggagctggggctcagaggagagaactcccagagggtctgggccctccccattcagagcattgagccagaccaggcctgtcgtggtcacctgcatggaatcttctccctacttaggcactgccaggcggaccatcttctggatgagaagggcagggcacaatgtctcctccagagagagatggtacagtctctggagcagcaggtaatgccagggcggtggagggtaagggatagggatagtgcgcaaaaccttctgtccaccatgtgccagaaaccaagttcacctgggacgagggctggtataaaggaaggaagaggagcgggcactcccagggaagaccgtagcctgggcaaagatgtggcagagaagggccaggctgaggcctcatgtttgtgccatttcacagctggtgctggagaaggagaagctgagtgccatgcaggcccacctggctgggaaaatggcactgaccaaggcttcatctgtggtgagcgaccccaggactggtggtggcagactcagactgctggggggcagggaggaggtctgcacggtgcagggaacctaacctcacattcaggtcctgagagctaggggcccctgtccccagctccaaacatgcccagacctggaaatctgtccccttctacttacaaaccctctgaccccggctgggcgtggtggctcacgcctgtaatcccagcactttgggaggccgaggcgggtggatcacgaggtcaggagttcaagaccagcctcgccaagatggtgaaaccctgtgtctactaaaagtacaaaaaattagccaggcgtggtggcaggtgtctgtagtcccaactacttgggaggctgaggcagagaattgcttgaacctgggaggcggagtttgcagtgagctgagatcataccactgcactccagcctaggcgacagatcaagactccgtctcaagaaaaaaaaaaaaaaaaaaccctctgactctaagatccccaaacactgtgatcctgagttgttaaagcaaatgcaaatagccagacttgccagatgcaggctgtgtgccagcaggaccagctatgtaacctgcagggccccttgttcagatttcaagatggcgaccacagagcattaaacaaagcacagggtgccacataaccacataggtcacacgcccatgaagccagccctggaggccaggcactgtttctgagcgctttgctggtggtaatttatttctcatgatgcgaatgtacagatgaggaatattgaggccaggggggtttaggtgactttcccaaggtcacagttgggtggtaaagagccctattcaaccccagttcatggtcccagcatcagtggccacatacgacatccgcacctgtgctctaataaatacggctcatgctgttttgtgggattccacctcagactggaatttagaagagggcgtccttgctttgaaaaacactgatttaaaaataaagtggagccaggcgcagtggctcatgcctgtaatcccagcactttgggaggctgaagcgggtggatcacatgaggtcaggagttcgagaccagcctggctaacatggtgaaaccccatctctaccaaaaatacaaaaattagctgggcgtagtgacgggcacctgtagtcccagctactcgggaggctgaggcagaagacttgcttgaatctgggaggtgggggttgcagtgagccgagattgcaccactgcactccagcctgggcgacagagcaagactcagtatcaaaaaaaataaaaaacataaaatagaaagtaaaaagtgggaagtttaagcctctgggtcaccagcctctccccctcacccaggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccaggtaagaatggtccttgcactacacggtgcccccaagctcctaatcctgacaggctctgggtggagggtgcaaaggagctccatgctgccccttcccaccaccaccaccactgcagctgccgccactcagcctttgggaaaatgcatccgctcacaaaagcttcctttcgggatgtccgtggcctgaaagccccccatatggtctcgagtgtcgggcccctagccctgactcccttggggattggggccatgcctcacccactctggactccagctactatattcggccatcagaagggagggaccctgctaagtaattccaggagcacctcctttcctcccctgaccaaggaaaatcggggtggattcgcccgagctcacctatccactgctctccaccaggcctggcctgtgggcttagcagggatcagagaccttgactgtcatcctggctctgccatttaacctcttgcatcctttggtgtgcaagttactccgcttcttttcaacctcggggagaactattttggcagaagtggtgcaaagaataaatgatacaacttatgtcaggtgctcagcaaacagtacctgtgcccgtggacacgggtgttgacggtgagatctcaggcctgtagactcaccttgtagggggaggggacagggagctagctaggaggtcctgcatggggcttgattcatccccaccctctgacagagttcctccacaacatggactacttcaagttccacaacatgcgaccccctttcacctacgccacgctcatccgctgggtaagcagggcagctcggccccaaggaggaggaagacaaagatggggtgggggacctgcctcccaaactcctgtctccctctgagtgccctcagagtgggttcctccattcccaagccccagccccaaggatccccaagccgtgcctcaaatgtgacccctcatgctggcttcaccccaaacctgtccgcaaatccaaacctaaaccaccatccaggccagagcatgccaaattctgaccctaaacctacccctttccagatgtccacctcagccccatacctaaccctctcctggacccataaaatagcctaaagctaaccccatctctgcaccttgccctaaacgtaccccagctcttactctaactccttccccagcctttatgccaacccaaccccatctccttccctggccccaacgtaccccagtatgtcaatacacccccaactgggcaccgttcccaacctttccttgtaacacccatttgatccttaacttcatcaccccatcccaactccttcatctcagcctccccaatgccttctcagaaccttcatcctagcgccacacctaaccccaaacctgaacctcacccctacatgataccagatattccccgactgtctctgaactgaaaccctgacctagccccatcctgactgatagcctcactgcaatcatcatcgctgactctgtaatcccattcctgaatccaaactgatcaaattccctgaccctcagcctcactccacaccgaaccccacaactaacctcatccttgccctgagcctaaccacctaaccatgtccctgacacgtaagatactcgataattcaaaccatctctggcttctgacctaaagccaagtcatcccatccctcacccctagaccccccacctgagtccaccccagcctgactcttaacccaccccttccctgacccttaagttggcctggccctttaccccttccaaatccttgaccccacttctgacccttcaccttccccaaccctgaaatgtcacctccacagagaaccccaactccaactccatcccagacctttcacctcacttcagccctagccctgaacaagaccccactcccaacctcagtcctgatcccttacctaatcccagaacaaccatacccacacccatctaaccctgcccaacccgacacttcaccccttttctaaccccatctttgaccccatgcttcaccccacatctagtcctgtccctgattacctgcccctacaattccgcccccatgtcagatggctcggggtaggtcatagcccctctaaaccccaagtttggggaatgtgccccttaccccaccccccaacttccaggccatcctggaggctccagagaagcagcggacactcaatgagatctaccactggttcacacgcatgtttgccttcttcagaaaccatcctgccacctggaaggtgagctcctctgaggtggcggtgactgggatggcctcaagtgccatcgcagctcaaagtgggcaggcctgggtctgggctcataggcacattggggaggaacgggatgtgggttgttggtggtggctgctggcctcagaggttgacgcccacctgctccctgtccccggccttccacagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcactcaacacaaaccccaaaacacagagagcctgcctcagtacactcaaacaacctcaaagctgcatcatcacacaatcacacacaagcacagccctgacaacccacacaccccaaggcacgcacccacagccagcctcagggcccacaggggcactgtcaacacaggggtgtgcccagaggcctacacagaagcagcgtcagtaccctcaggatctgaggtcccaacacgtgctcgctcacacacacggcctgttagaattcacctgtgtatctcacgcatatgcacacgcacagccccccagtgggtctcttgagtcccgtgcagacacacacagccacacacactgccttgccaaaaataccccgtgtctcccctgccactcacctcactcccattccctgagccctgatccatgcctcagcttagactgcagaggaactactcatttatttgggatccaaggcccccaacccacagtaccgtccccaataaactgcagccgagctccccacatgctggactatcaccccatataagggttgcggtcagtgggcaggggtctgggtccaaggccgcagcaggaggaactggacagcggaggaagtagctagggcatgtgcttggccactgcctccagcaccccaaatccctgcctgaggctggggagagacctctgccggcggctcctcaggcctcccggacccggcctaggaggccagcgttctcctggcggagggctcggtagtcctcccggatcttctccaggttgctgagggtcttcttgcccagctctgtctcgatctgaggcaatgtgaacacatgccccctcagcacacacagcccctttcccagctcctgctcaccagcccccatcacagccactctgggcccctcccaccaactccaacagcctgctctgtcccatggccaggcctcgtgtggtgttccctctacccaaagcatccttcgccatgtggcaggattccccctacatctttaagctgaagcctctgcccatggccctgggaggcagacaggagggcccttggggtggaagctggggctcacagtaggccacttgcctgtcccaggtcacaggcactaaggggcagggctgggtgtccagccatcggctgtgtgtggctccacagcctctgtcagcataacctgaggaactgtccccccggcccgccttggctccccatcctgcccccaggcctcacctgctcctcgaggtctcgaacctcccgcatgatggtgcctgtgtcctcgatggtctggatgagctggctgcagttctggggacaacaggagcagaaggcttgcacccagtcccacccacccccagcagccccaccccaggcacatgtctcccctcacctcgtgcagagcagctagatacttataggccttccgaacagcatcgtccttcttggcatcctgaccagacacagggacctcaaaggtatcagtgggctgcccttgaccatctccatgccctaagaaggccaccctctcccaccaccccactagcttcatcctccatgaaacaaagccagccctgggtatcagtgcacctccagcctcgcacagggcctgggtctggaccccagcc

SEQ ID NO: 13013 - DNA, 14871 bp, Human
gacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccacctagtctacccggctctgatttctcagtgtgtctttttcgggcgccggggaggaggttggccgggggagaaaggagggagaggtggtgagaacaagctccacccggacccaccgaccgcagttcagcttgctgcaccatttcaggccccttcaaaagtgttaggcagagcagcatcctctgggaagcctctcctgccaatcactctgtcactctctgagtagccctgctcaccctcccactactggccaccaaatgcccggtctttctaggagttggttctaattctggtcccttagccaagcctcttccgagcccctgtggaaccctctcctcaaatccccaaggggtccgaataggaggaaacctcacattgcctgaccccatccctaatcttcagaccctactgtctctcctttccctgcctccgcccaggctggagaaatgggagacaggttaggcaaggaggggaggtggggcgccggggtgactccttagttcattagttattctcttttacctctccactccacgggaagtgacagggacatgtgtaatggggggcggggagaggtccccggggcccgcgatgaagggcctggccgctgcagtctccgtgcatagagacccgggccgagttctgactgaggccatgggaccccctccccccagcccggaggcacagccaagcctgagagcgtgaaggagaggctccccgccctggaactgagctggggaaggggataactggagagagaaaaatgtgggtgggggagggaaggctttaagatctacttctcaagacttggggtggggggacggggctggacagctaggcttataaggatgaggggagagaggggacgagggctttggaacctggcctcgctgagaggggaatgagaagggaggagtgcgtataagatctagctctctggtggctagggccaggttcccaggttcccagcgagcaccagctggggctgcgggtgaggttggggcccattgttgcagcattcatcggggagaccctcggaacctcaccagtggggaggagccaagaggtgtctttaacccctctcccaaataagcatccgaaataaatcgacacaaaacgtcaacacaagcaccctagcgcgccacccctctcagtccagttggccacctctgagtctccccatcctccactacagaaccttcaagccccaggtcccgtgagaggccacgtggcacgccgggattctgggggtcgtgccttgtgacgccccgcaccggcccggagcgggagggcagaggcctttcccgcggggcactccgggctacgtgcagttcacctctaggcagggggcgccctggcagcggagagaccacatgcccgggggcgggccctgcggggcgcgctcctcccacgagggtgtcaggtttacggaaccgagttcccaggccggacgcgcggtggcctgacggtcgcaaggattacattcgcctgacccggcccggcttgaccctgcccgggcgcgccatgttcgcgcgtgggtcccggaggcgccgctccgggcgtgcggtgagcgggagtcagggcagcggtgggggtcgggggtaaactgaggcccaggcaagggggcaatggataggcatagcgaataggtgccccacagaggatctgggaatcccatcccctgcattcccagacctggggctggggctgctggaggcgaatggatggaggaaggtgtagatctggtggcccaaaccccctaatcacctctccacacactttcatcagcactcctgggacctggtggggacccctctcttatgaattgtgggagggaatcctgagggccagagaactgggtcttgaagccttaggttgagcaggaacctcctgagctgctgctttttttttttttttttttttttgagactgaatctctgtcacccaggctggagtgcagtggcgctatctccgctcactgcaacctccgcctcctgggttcaagcgattctcctgcttcagcctcccatgtacctgggattacagacgcccgccaccgcgcccgcctaatttttgtatttttagtagagacaaggtttcaccatgttggccaggctggtctcgaactcctgacctcaggtgatccgcccacctcggcctcccaaagtgctgggattataggcgtgagccaccgagcctggccgacctcctcagcttctaaaggacacagtaccttggaggaatgtgcacggagggatggagtcctacactcctgggatgccgaaatgctgagagtcaagagactgggatttggggggacaaggcttccagggttccgcctgagcaagggagtttttgacttcttagacaggaggttctttcacttcctttggagtgggtctctgacctgggaatgtggggtctgggtttgatggtccggagaaggaataaatagccctaggatgggatgggtaaaggccaaggtttcttgggatgggggtttctgaatggagcaggggcctcctgagatcctggggagggtccccagttccttgggtatcagggcatgaggccagggtttaggggaggagctcctgagcttctgaagagaggggcagggttcacgtggggatctcaaggaagaatgcggtctcgtctcctaccctgtggaactggagtgctgctggcggcgtagatggagagggaaccgggatgaggccggggagaggatgcccagagtaggggttctgtgctctagtggggagagtacaatgaattataggggaggtgcttgagccctggaaggatctaaggctggtgggaggtgtctgaggctaggggcggacggggaggggggtccgaggccagcctaggaaggggaattccctgaaaaggggacatataaggaggtggctccaactgccccgcctctgcctcggttgtgtcccgctcccccgcactctgggcgctgtcccagcctgcccagcgctgcccaggtaagacaggccccagcgtgcggtcgcgggcaatgaagtggaggggcgggcgttgacttctccttccctgcttccgcgcctcacccggccctgcatctgcccccgcccactgcagcctccagaggcagaggacccagaccggggccagccctgcaactcctgtagggagcagtgccctggcttcctgctccacggctggaggtaagtggcgcccctaaagggcctcgcctttgtcagagctccgccttcggggggaaatccaggagccttacgccacgcccctacgcttgagctccgcctacagagggatctcagttgggaaaagagcctcaggctcagattcagagccccgccccctgactcattccccaaagtcctttcccaggagagctccacccactacgcagccccgcccccagaagtgttctcccgtagccgcggagtcgcatccctagggagattcttcgtctctaactttgagcgccgccctctggcctccagcacccctcttagactcagacctactctcccaggcccagcgtcctatcctcctgctggagccctgcacccaataaacagagcctacagcccccagactcaggccctacccacaggctcagagcccacaagttcagagcctcaccacaggttagatgcctgtgtctagtgaaagttcccccacaaagcatcccactccccacgacctgtcctctggctcacagcccagccacaccctggctcataggcccacctcctgcagccccgcccccaggcccagatccctgtccctgctcacagacctttggtggtgataatctgtatgtccccgctcctccattggacctgggctgccgaggggttcgggtgggcaactccttagtaattgacccccatcccggccccctcagaaagatctgccagcattgcaaatgcccgcgggaggagcatgcagtgcacgcggtgcctgtggacctggaacgcatcatgtgtcggctaatctcggacttccagcgccactccatctccgacgacgactcaggctgtgcatcggaggagtatgcctgggtgcccccaggccttaagccggagcaggtgaccagaggccagccctccactcttgctgtccagtgggtgcacactaatgctcacacacacacacacactcaggtgggaacctatttctggggctacgctagagtgtgcagtcagaccgagggtccttctggcccctctgtgatggaagagtggtcagccccccataccttgggtgactgagggaccagttcctcagggcctgttcaccccaatcctattatttttgattgattgtttttgagacagggtctcactctgttgcccaccacagcctcccttgtagctgggactgcaggtgcatgccaccctgcctggctatttttaaaatttttttgtagagacagggtctccctatgttgcccaggctgatgttgaactcctgggctcaagtgatcctgcctcggcctcccaaagtgctgggattacaagagcaagccaccatgcgtggccccactccctattctaccctcccagcacttcattcaccacatgacttcattgattgactcattcaacacatagttatggggcacctactgcatgtgagacactgttctaggcactgaggacacagcaatgagcaaaacacaaaataacatatctgcccacgggcacggtggctcacgcctgtaatcccagcacttcgggaggctgaggcgggcggattacttgaggtcaggagtttgagaccaacctggccaacatggcaaaaccccgtctctactaaaagtacaaaaattagccaggtgtggtggtgcacacctgtaatcctagctactcaggaggctgaggcaggagaattgtttgaacccaggaagcggaggttgcagtgagctgagatcgtgccactgcactccagcctgggcaacagagtgatacttctcaaaaaaaaaaaaaaaaaatctgcccaggcagagggtagattctggaaaggaggaacacccaataagcaaacctgtaaatatatgtcagatggtgtaagggctatggaattaaaaagcaaggaaggtggggtgaagaaagagagagggaaggagagagatgctagaattgtaaatagggtgcccagaataagcctctgtgagaatttaatggttgagctgcccgaaaggaggtgagaagtgagccatgcagacatctaaggttacagcgattcacacaggcaaagggcatggctaatgccaaggccctgaggcaggcgtgtgcttggcatatgtaagggatggcaaggccagtgctgctggcgcagagtgagcaagggggagaccagctggagatgaggtcagagatgtggcaggggctatggagaggactttggctttgcctgtgaatgaagggaagtcgcaagagggttgtcagcagaagacagcctggaggaataagggtggaatcaggagaccagtgaggaacctgatgatgatggcactggcagtgcaaggagttatatatatatggagagagagacagacagacagacagaaaggccggcatggtggctcacacctgtaatcccagcactttgggaggccgaggcgagtggatcacttgaggtcaggagtttgagaccagcctggccaacatagtgaaaccccatctctactaaaaatacaaaaattagtctggcatggtggcaaatgtctgtaatcccagctactcgggaggctgagccacaagaattccttgaacccaggaggcagaggttgcagtgagctgagattgcaccactgcactccagcctgggcgacagagcaagaccctgtctcaaaaaaaaaaaaaataggctgggtgcagtggttcacgcctgtaatcccaccactttgggaagcctaggcaggcagatcgcctgaggtcgggagtttgagaccagcctgaccaacatggagaaaccccgtctctattaaaaatacaaaaaaattagccaggcgtggtggcacatgcctgtaatcccagctacttggaaggctgaagcaggagaagcgcttgaacccgggaggcggaggtttcggtgagcccagatcatgccattgcactgcagcctgggcaacaagagcaaaattccgtttaataaataattatttaatatatatatatatgtgtgtgtatatatatatacacgtatatatatacgtatatatatacacgcgtatatatatacgtatatatatacacgcgtatatatacgtatatatatacgcgtatatatatacgtatatatatacacgtacatatacgtatatatatatacgtatatatatacacgtacatatacgtgtatatatatacacatatacgtatatatatacacatatatacgtatatatacacatatatatacacatatgtatacatctatatacatatatataaaataattattttacgtatataatttacgtaaataatatacgtataataattatacgtgtatatatatatatatatatacacacacacatatatatatatgggggggggtctcactctgtctcccaggtttgagtgcagtggctcaatcacagctcactgcagcctcaacttcctgagctcaagtgatcctcccacctcagcctcccaagtagctgggactacaggcacgcatcatcacgcctggatgatttttgtattttttgtagagatggggttttgccatgttgcccagggtggtcttggactcctgggctcaagctatcttcccctctgggcctcctaaagtgctgggattacaggtgtgatccacagcacccagcctatattttggaagtagcactcagaggatttgcttgtgggggtgggagaaagaggagtgaaagatgaccctgaggataggtagattaactgatgtgggagaggccaagacaggagcagtttgaggggtaagagcataagtttggttgtggccatctggagtttgagatgcctgttagacatctaaatagccacattgcctggaactcaagggataagttacagagctggacgtatgtgtttgtcattatgtgtcacaggctggaggtgacacattagccagccaagtagatgatatttacagccataaggttgaatgtaattcccaagaaattgaatgtagacagaggcaagaggaccaagagctgagtcctaggatcctcctgcatttaggggtcagctagttgaggaggagccaaaacagggacaaagaaggagcagccaataaggtggaaggaaaacctggactgtgtggtgtcctggaagccaagggaagaaagtgtttccaggaagagagagtggtcagctcggtgcagtgctaccatcatcaagtctgatgacgactgagacctgaacaatgattttaacaatggggaagtcatcgatgaccttgacagctttggaagagggatgggagcggaagcctgcctcaagtaggctcaagagagattggaaggacaggaagtggagtgaacacaagtgctcataactttttgaggaattttcctgtaaagggaaaaagaaaagtggatcagtagactgggcgcggtggctcacacctgtaatcccagcactttgggagaccaaggcaggcggatcacttgaggtcaggagttcgagaccagcctggccaacatggtgaaaccctgtctctactaaaaataaaaaattagctgggcatagtggtatgcctgtaatcccagctactcaggaggctgaggcaggagaatcgcttgaacccaggaggcggaggttgcagtgagcctagatcgcgccactccagcttgggcaacagagaaagattccgtctcaaaaaaaaaaaaaaaaaaaaaaaggtgatcagcagctggaggaggaagtgaggtcaatacatgcaggaaccctcagcgtgtttgggagctgggagctgagggaaatgatccgcctttaggaaggagagatgagggagtcagaaggtccctcctaatgcctttcattttctgagaaatggggacccgccatctcactgcatcccaactcacctctcatttcagttgttttctcccactcctatgtcctcccaggtatatcaatttttcagctgcctcccagaggacaaggtcccctacgtcaacagtcctggggagaaatacaggatcaagcagctgctgcaccagctgcccccacacgacagtgaggtgaggagagagaagacaggaagggcatgccaggcacagcacacagcctgggccaatgcagggcagggtcagaggaggaaaggtgagctgatctgaggtgagtggtccagacaggcaggggtcatcaggggacattccttggcaaaaccacagctgggccttggaagaagaggtggttacttcaggcaggaggcaccatctatagaaagacctagaagtaaacttgcggggcatggatgaagtctggaagaggggcagggacaggcatcaagggaggagcctgggagatgccttctcctcccaggcacagtactgcacagcactggaagaggaggaaaagaaagagctccgagcctttagccagcagcggaagcgggagaatctggggcgtggcatcgtgcgcatcttcccggtgaccatcactggggccatctgtgaggaggtgagccgtggagggcctcagcgagtgagcagtgcctctgctccaagccctggggagcaggacacatcttccaagcactgggaagatgaggcctgccacttaagccccagtgaggtgtctctagggtcccctcttgtgggcggggtctgttcctcacatctcactgttgggcagggactgtctctaaggcaacccctggtggacagggacctgtcccatcaatcccactgtcgtgtggggtttgtctgtaaggaggccttagtgtgtttttctccccgtctgtgcagtggacatggggcatgggctatctctttggtcctcctgtggtcagaacttgtcctcaagagctgacccacagtggcagggcctgtctgcagggcccagtggtaagcagggcctgtccttagatcctactgttaggtgagatctattgctaaggtcccggtgggtggagactatctctgtggtttcccccactaggcctggcctgtctgtcttccccacccctgatgagggaggcttgcctataaggccacccaccatgggtagggcctgtctctacggcttccctcatgagcagggtcagtctctaaggtaccgcccaaccccatccctggtataggcagggcctgtgtcaaagttaccccatgggtggggctgatcacaaagtttcactgtgggaaaggcccaagtgtaacatactttggctgaccccatccatctgaccatcttggtgacagtgatggtaaccatcttggtgcttgtctcatggcagtgcggaaagcagattggaggtggggacatcgcagtgtttgccagccgtgcaggcctgggtgcctgctggcacccacagtgcttcgtgtgtaccacgtgccaggaactgctggttgacctcatctacttctaccatgttggcaaggtctactgcgggcgtcaccatgccgaatgcctgcgtccacgctgccaagcctgtgacgaggtttgggcctccctgcccaggggtgggagttgagggtgggcagggccaggagcaggctcatctgacagccacagatggcctgcgccctccagatcatcttctcccctgagtgcacggaggctgagggccgccactggcacatggatcacttctgctgctttgagtgtgaagcttcactaggagggcagcgctatgtcatgcgtcagagccgcccccactgctgcgcctgctacgaggcccgccacgcggagtactgtgatggctgtggggagcacatcggtgggtgaatgctgtgggactggacagagggatggatggacagctgggccacagtcctaccccaccaggactcctcctgtcctccaggccccatcctccattgtgccctgtactttgtccagccccaacactatagacctgtacgcttggttgcaagtcccactcccaatgtccccactatgccatgctttctaaaccccacctaacacaatgctaggccaccaccacatgtctacacccacctccagagggtgctctaattccagccccagggctcgccctactcctagcctttaccaccccaagctgtgccccgttctcctccactctcctgtatcagcctaagtcaggcctagcttctagctacaccctatcctctgagaaccactcctttctcaacagggccactccccacctgctaagccctgcccccaccagccaggcctcctcttcaggcccagctttccattctccttccacttggagccaccccctaatgtctaagcctggcccgaatcttagagtccaatgcccaccccgctctgggagagagcaccctgggaaagaaagggaggagtgagagagaggttcaccagccagtctccaggagagaaccaaaacctgtttcctgctttctccaaaagggccccattctggaggagggaggaaggcacccaggggtgccctgcctcggattccccacctcttcttgagaagggactcgttcacgaggggtggggttacgcctgggggttctgcctcagtttttccccctcgtcgttccccacaggcctggaccaaggccagatggcttacgagggccagcactggcatgcctcagaccgctgcttctgctgtagtcgctgtgggcgggccctgctgggccgcccattcctgccacgccgaggcctaatcttctgctctcgagcctgcagccttgggtccgagcccacagctccagggccgagccgccgcagctggagtgccggccctgtcacagccccacttgcagcctccacagcctctttctctgctgtgaagggggcatcagagaccaccaccaaaggcaccagcacagagttagcgccaggtgagctaaccctctagccacacccagccacagcccagtcacccctatgtccttgcccctgcctcagccctggcccttccttcttgactagcccaggcccttcacctgctgtatccctgggccccgcccatttctcagctcatcctccttccccacaccagtccaggcctggtttccatcccaaactacacccgcctcatgaaccctggttccaccctgtcaatacagggctggtcccctacctcaacttgtctctgcttgaccccaagttcctcttcctcttctccagccggtcacccttcatcctctgcagtcaggccccaccccttttattgcaaaccaaatctactccagcctatgccacacctcttccatccgaagccaccccgggtgccctggccacgccccccacaccagtcccatcttgctccgtgttcttccttccaaccctctcaacacccagagcctgctccaggcctcacacttcccagacttcccacctccctgccattctccgacccctgcccccactttcccagtcttagtggaggaaagaaggcccttccgcaggcctcctcttaggagggggccagtgggagggcagatacaaggagtcactctgtctcccccttaacagctacaggccctgaggagccctcccgctttctgagaggggctccccaccgccactccatgccggaactggggctccgcagtgtccccgagccgcccccagagtcccccggccagcctaacctgcgcccagatgatagtgccttcggtcgtcagagcaccccacgcgtcagcttccgcgaccctctggtgtctgaaggaggcccgcgccggaccctgagtgcacccccggcccagcgccgcaggccacgcagtcccccacccagggcccccagccgtcgccgccaccatcatcataatcaccatcaccatcacaaccgccacccaagcagacgtcgccactatcaatgtgacgcgggatcagggtcagactcggaatcttgctccagctcgccctccagttccagttccgaatcatcagaggatgatggcttcttcctaggagagcgcatccctctgcccccgcatttgtgcaggcccatgcctgctcaggacactgcaatggagaccttcaactccccatctttatcgctccccagggactctcgcgcagggatgcctcgtcaggcccgagacaagaactgcatcgtggcttgaaggcaggccgtcctggagggggctccattctccagtcagagtagatgatgaggcccatgcccctcacccccacgccccgcccctacaacctaagtcataaatcctcttcctccctcctttatcagtttgtttctatttttgtttctgttttagagacttggtctaccctattgcccaggctggagtgcagtggtgtgatcagggctcactgcagcctcaaaagttttgggctcaagctatcctcccacctcagcctcccaagtagctgggactccaggctcgtgtcagcgttcccagctaattttttaattttttggtagagatggggttttgccatgttgcccaggctggtctagaactcctgggctcaagcaatcctcccgcagcctcccaaaggactgggattacaggcatgagccaccgcaccgggcctctcgtttgtattattgaagtaatttaatatttgttgtaaaacaggcctggcttctttgcctccttgccccagctgtttccactccatttccccctcctgatgcttgaaatttacccacatttgatgaaaggattactttattcattatcgtatattttaacaatgtttattattcatttatccctctatagaaccaccacccacaccgaggagattatttggagtgggtcccaacctagggcctggactctgaaatctaactccccacttccctcattttgtgacttaggtgggggcatggttcagtcagaactggtgtctcctattggatcgtgcagaaggaggacctaggcacacacatatggtggccacacccaggagggttgattggcaggctggaagacaaaagtctcccaataaaggcacttttacctcaaagagggggtgggagttggtctgctgggaatgttgttgttggggtggggaggagttatttcaatggaggagttatttgcagattgcagagagaaatgagggaagttcgcctacaccgggccatctgcggggtctgcaggtgaggaaaagagagaaagcattggctgaatctatatgcccattttttaaaacaagatccaaagtccatgaacattttacacacaagaataccgaagcttatggtacctattggtacaaaagccctaagtaccaatacgagaccagagttggcattcgtgcctttaagagatccctttcctttttccctctgccctctcagcaacccccttacccccaaccaacacacacacacacacttaccagtgggggctgctgtatgtcttggctgccgaacggggaaggtgacataggcatcatagccaaagaggcacgtagcgattaggcccagtacctgggggacaggataggagtgagggggtttagattagctggtcaggttactcagtctcttatcttcttgtatccaccacctccagcacctgccccacgcaggatgggactcaagcaccgggttggtaagccagggaaaggccaagagagtgcatcctaccccactctccctcctcctatacctctcaacacagggaggccacactgtggccctacccgtagggggcacaattcaagtcatactttttttttttttgagacacagtatcactctgtcacccatctgtcactggggctggagtgagtggcatgatcttggctcactgcaacctttgtcttctgggttcaagtgattctcctgcctcagcctcctgagtagctgggactataggcgcccaccaccatgcccggctgatttttgtatttttagtggagatggggtttcgccatgttggccaggctggtcttgaactcctgacctcaagtgatctgcctgcctcggcctcagcctcccaaagtgctgggaatacaggcatgagccactgcgcccggccccaatttctactacatttgggacaaagttcttgcagatggtagtctagtgcgttgacaaaggggccgcctgtttgtacctctcaccaaggtccttgtgtctgacaagggacttcccttcacagcaaatgaagaccttgggaggcaaaaccaagtcctgggccagactttcctccatgtctgaggacaagtgtgacttgctgtgggtcacacgatttctgccag

SEQ ID NO: 13014 - DNA, 19299 bp, Human
tcagcctcccaagtagctgcgattacaggtgtgcaccaccacgcctgcttaattttgtatttttagtagagacagggtttcacaatgttggccaggctggtcttgaactcctgaccttaggtgatggacccaccttagcctcccaaagtgctgagattacaggtgtgagccaccgcgcccagcccacatacttcttttgatcttaagaactcttaaaaatacacaaagttctctaacacttaacaactggcatttattttcagtatgtccacaagtattgccaagcatgccccggtgattaacaacacaggctcaggactgtctgtgaacttgggaccattgtgagcctactgtttcagttggaaagtgtatacacctaatgggactgttgtcaagattatcccaggaagtacatgtagaaagcttggcacattgcttggcatatagtggcatatattttcttggtatatttctggatattatcactttcaggctgcttagaaattgagtagaatgtaaatgccaaagccatgacagtttcaacatccaagatacttccaattaaaattaattccaagtgaaacatgggaaacagaattcagctcctcagagctcaaacaccacagaaaacatgtactgcgcgggagggagggaggaagggaggaaagaagggagggaagggaagggaagaggagagaggggagaggggaagcgggaggggaggtgagggcagggctggaaaggaaagacagatccagagagtggtgagccttgatgccaagtgagacctgcagaactgtcctctcaggacaactctgtacaaatccctgaactccacagacttgaccaaactctagcatagtttctagcagcataaggctgtatcctaggatgacctcggccccccctttaaagtgcctgcctgagaaagctcaacgctgcctggaaaatttcctatttattttggccaacataccccgatagtaggtcccgaactcccttagagcatttcctggaaagggcatataattgtaaatacgtatcccttgcaactaactcggaagcttttctttcaaggccctgagagccattccttcgaaatctaatcattaggaaggatagggcctttgtctcccagtctctgcgggaggatagaattctccctaagacaactgcgagctagcagacacagccggctaatcacatttgcactgacttcactatactacacttctctgactctacagagcccctacactcccgcctcgctcattctccctttaaaacgcccaaagtcacctctgcacaaaccgggatggaactcagcccttttacctgcagtagttactgaataaaatccgttttcagcgctttacttactggctggctatgatttatctttgacacaagcttgggttacattctgtgtacgaatggaacaagcagaggaatttttttttttttttttgcggtggagggagcgcaaaaacagtcgttctgttctcgctaatatgggaatgtcacgaactacgtccccgacatgaggccgcggatcagaaccggggctgagggcgaactgtgtaagctgcgtctgctacgctgcccgaggtcccgtcatcagccccctctcccacggagcccttctttacctaccccacggaggactgggaaagcccggccggctctgcggaagcttccgtagcagtcgctcccagtagtttcgaagcactccccgggccgcagaccacggcgaaaccaccaagaccagcatggccagcgccattttccctgctggaagaccgccccggtcccgcccctgctttcagcatgcgcacaggcacagaatcgggcaagcctcgcttcttagaactacaacaccccgcatgctcttggagcagctctgactctcctccaatcatagagagtaaaggaaaggtgaggggcggggaaatgaaaggaaatcggccacagtgcgcatgtgtgcggctgtgctttggctcttcgggtaaagatggcggagcgcgggtacagcttttcgctgactacattcaggtatggaaggggccctcgaggtcttcagcgtagtcgaggttgctggtactctgtcgatttagtttttcccatcctgacgtcggcattggtgcttctggagggtccagtagggaatggagttggaaatgcggctttgcaaagtcatttgccaggccgacccgggattcctggagcttccttggtcggaggctgctggagggtcgggggatgcggttttgcggggttaacatggggctgcgggacggtgaggcacatagccaaggattcgctttcactttggagaccagaaaagaaggcagttttagcttaaccatctctgggtggcccgttccgaactcaggatttttttcctggctcaagtagacctgatgcggtggtttctgaaacttggaatcttggtcaaatatgtggggttcccttttcttggaaaactctcagctttacagttaagtcggagtcttggtctccatttggcactagtgtctttcaaaacctcccgctttcggtttcttcgatgcacgaattagaaacataaggactaaaaaccgaaagcccctatcacttttttgtgaacccctaacgaggcaagtttgagttttggtctttttttggtggactggggggaacgtcggggagggggatgtttactttaaacaagattgtaggtttttctattgtagaaaaggggattagaataataagtttactttccaaaatacagttggggcgaaccatggctctcaacgtgagaaaaccatcgccgaagacttttaaaaattgactggggaagttttctgacttacccattttcttaaggatcagtaatgcccagtttacttaaaatgtactcctgacaactgaaggcaggcgggatctaacttgttgagtactttgttaggtgcaacttaaccttaacctgctccatctctttccactgctataatgaatgttatctcagcttcttacagatgaactaaccacagcttgtacaaattaaacaacttgtctaaggtcatcggtgagtagctgagttgacattcaaactgggttttttttctgataacaaaaatacactttccattacataacgttgtcttaaattccaaaagtacttttctcttggcagttttcagtaagcagtgggtgtatgtaatagtttttttgtaacctttgaacgagattaatttaattatgcaataaaaggtctcattatattacatatgacagaatagtgtgtgcaggatgtattcactgttcctatttatgaagaaaacaaatgtggtcctttttttagggacagggacttggcagcctccagctcttgggctcaagggatcctcctgcctcagtctctggagtagctgggattagaggtgtgcaccaccctgcctgctaatttttttttttaaggcatgaggtcttgcgatgttgcccaggctgcaaatgtggtcttttatcgcgaagaaagtgtaatcctagtggagctgaaaacataaaacaaccgtataccttcagggactgaatctttttataacaaattttctttattaaaataaacttttggccaggcagggtgactcacacctgtaatcccagctactcaggagactgaggcaggaggatcactttagcccaggagttcaagactagcctgggcaacacagcaagaccctatctctgaaaaaaattaaaaaattagccaggcatgtgcctgtaatccaagctatttgggaggctgagggcgagaggagcacttgaacccaagagtttaggattcagtgagctgtgattctgccactgcactccagcctgggtcacaaagtgataccccatatctaaaagttttttttaaaaaaaccaaacttgtgtgtgtgtgtgtgtgcgtgtgtgtgtgtgtgttttaacatggtggattcacctgttttagataaaaggaaaatatttgtttctagcctctcgtaatcagaagtaaactaatggtggaagggactagagaccatacaggatgaaacagttcttgtggactacatttggttgaggaattgacaataaatgagtaaacaaattggtgcctactaatacattctcttactaaggaattttattttaaatgggtgaaggaaggaatatgactttagattgagtaatcaggaaaggcttgtgcttgggggtgatttttgagactggaagattaaaagtaaccagctatttgaagattcaggaataaggagacttgtagacagagggaacagcatgtatgaaagccctgaaactgggaaggagcttgagctcttaaaggaataaaaatgaggcaaatgtgctatagtgagcaaggagataatgtgggagagggctaatcgtgtaggactttgtaggccagagaaggagattttattttacgtgaacaaagaagttattacaaaatctaagtgtaggtgacatggtccaaaggtaactttggctgggggtggaagtaaggttgagaaagaggaaaaccagttagaaggctatttcagttatcccatgtagggatgctgatgctatggaatgggatagtggcattatggaatataaagatggttgattgctcagccagctcacaggttagtgagctttcacacagtgaaatcatgcagtggtaaagataggtatgtacaggtaataggaacagagaaatggtagctattaagtttacatgagcctttaaatgttacccaggggtatatgaattaggtattgaacaataattgaaagctggatggacccagaaagttatgatatgattattgaaatagtgactattaaaggaaaagttcagcctaattttttaatttaaatgtcagttgatgttattctgctcaaattaattatatcaagagccttaaagctgtcacccttaggtctgtttctttaattggtctagatgtgtctctgtcagccaaatgattgtggattcctggtattaggttatgtgctggaatcctgactgaacatagctactttattgaggaagacaaatattgtaaaaataataaagagaccgaggcaggaggattgcttgagaccaggtgtttgagaccagcctgggcagcatagcaagaccctgttactaaaaaaaaaaaataacaattcagatatgatgaatcttagacaaagaggaagtgcaggacatcacaggcatcagtgaataggtattcaacttaatcttgagggttcagggcaacttcccttaggacatgattgaatgaaaggagttcacagggcaatagagaaatgcatttcagatggagggattagcttgtcaatgaggcgtttgaagtctgagagtagtctatgtgtttggagcaaggagggatggagttgagatttgagtgaccaagggaatattcgtaattatatgaagagaaaatacggccttctgaaatttatattttcattagtagatgggagataaggacctagctgtgtcactttggacaaattactttcactcagactttatctatgaaattaggttggtttatgatgattccatttaaacaactaggttgaaataaaggataactttaaaaggccagtttgagacttgcgtttagctaccaaatccatggaaccagatctgttaagtgtgaccatctcatgacttctagaaatagttgtatattatatagagaatacttaattgtgagtgatatctaggtcttattgtcttaggccatgtctgttttctaaaaccaccctccgacctgaaatatgtgctgctgtttggtttttaacagacacatacatgttcttaataacattactattcagtatgtgcttgttactgattttatgccagacagttttataggaattacttcacttaatcacaacaatgctttgaaataggtacaggacacttgtaggggacggtgatttcagtacccccacaaataccaagtgagggcgtattcaagtcctgtagtcagccctgtggaatccactgatacggaaaaccagttgtggttactgtgtcctcattttacaggtgagaaaacaggcatagaaaacttagggtgaaaagaagcaacagtaataccactgctccatgtggcagacaaaaaacaaccaaagagaaagtagtgcttcagtaggagtatgttccaattgccttgtaaacttggtttctttctttctgtctttctctttttttttttttgagacgaggtttcggccttgttgcccaggctagagtgcaatggtgcaatcttggcttactgcaacctccacctcccggattcaagcaattctcctgcctcagcctcccaagtagctgggattacaggcatgcaccaccatacccggctaatttttgtatatttagtagagacagggtttcaccatgttagtcaggctggtctcgaactcctgacctcaggtgatccacccgtcttggccttccaaagtgctgggattacaaacttgagtcattgcgcccagctgtaaacttggtttctgtgccacttcatgatagaggtcaaaggccagttactccctggagttggataaattggatttgacctgtatgtctgtactatctcagagatgttcttacaataaatatttgatgatatgtgaacttacaaatacctgtgtttcttttaagcccgtctggtaaacttgtccagattgaatatgctttggctgctgtagctggaggagccccgtccgtgggaattaaaggtaatgaaatgcttcattcatttcagatgcctgttagtagttatcctaattattttggaattcattagtaattaatttatacagagctgcagcagtataatttttaacaattttttgttaatttacagtgttttggagtttaaatagtaataagtctaaggtcattcaaatttcttttcaaagtaaatagtaacacctttatctgttagttgtgatattcacaatagtctttctcattcagaaaactgagtctttttttgtttttccactgattatatcactacttcctggcagtttttatccttataatttaggaaagcttaattataaaacataagctaaatgtgttgtgtttcactttaaaagcctgtatcatttattgtaaatttcatgttataagaatattgggacaagtagacagaaatcccttattttaaaacatgtgaactctcaggtatccttagagtgctttacaaaagtttatgtaatacctttagctgtagggaggatttttttgtgtagtactaaatgaccagtgagggaaaaactgacttaccatttcttaggtaattttggtaataggactccggaagaaaaggttttataaattaaaggaaataaaggagtttgcgtttagcgcatccataattagaaagctgttaaaacagtcttaaaaatgattaaacatttatgtctctctctttttttttaagctgcaaatggtgtggtattagcaactgagaaaaaacagaaatccattctgtatgatgagcgaagtgtacacaaagtagaaccaattaccaagcatataggtttggtgtacagtggcatgggccccgattacaggtactttatactttttatagtgtttctcaccatctcatgaattgattgtaatctgtattttcaggagaaaaaccaaggttgttttcctttaatcttccagttcctctttttttgtgtgctttgtttagcaatagcagcctcgttgagagctgaatttagtttgcctgtataggttactttaaagagaataactcagatgtgaaagaggaggtagatagattacataactcctcttttctctgttcagcggactttctcttctgacatattcctcttctactatccaggaactgggcgtaagggctttagttttcgccagtgcagtttaaaaatgataaaagcaatttaagttataataaactatattttaaaaagtatgaggcaacaaaagaaagtatcaccatccagagttatcttttttcctgttcttcacaaaggaacaaaattctcaaacaccactgcaagttgttgagtgtggcagccaaccaggatcccagtgcttgtgtaatcaccccctttatatttcacaggaagagagaataatcttgttactcagggtaccagcaagttgaaagagattgacagctttctgtgtctgtcatttaaacaagtaaaaggagtattactttattgctcatgattttgtggagcaagataggtagaggcaaagtttcacttcagtgaatcaacgcaacaaggtcagtggaatgtgatcaggcagtgaatcttgtcaccactatataggctggatactgcattgtgctgccactgataggataaactgagggatgggacatgactgtcacacagagggaaaatgtgcatatttcagatcagtagtatatgagctggcaaagataaatcctatttgtcttgctaatatatttgattgttatataatatcttcttaatctcttttgacaaattttacttctgaaaaaaaattttaagagacagggtcatgctgggtattgcttttatcattttaaactgtactggagaaaactaaagccttatgcccagttcctgtatagtagaagaggaatatgtcagaaaggaaagtccattaaacagagaaaagaggagttatgtactctatctccctcctctttcacatctgagttattctctttaaagtaacccagggtcttgcccaggcaggtctgaaactcctggcctcaagtgatcttcctgcctcagccttttaaagtgttgggattacaggcgtgaaacactgcacctagccgaattttacatttttagttacaagtagtttcttactgtttcttaatctctgaagggtactccgtgaagcacaggcagagagattgaaacagtctgcagaaagtagtgacctgaagtgagaaaaatatgcccagaattgtgtgcctgtgtgtttatgtgtgcttgtatgtgtgtgtgggctggggtgagctgtaaaaagacaagcggctgcccttggatgggggtacagtcttgaagaagccgtggagcaagataaagttctcatttttgtacattaaatctgttacttttaagctaactggtactctgatgctctgatattttcttctatatcaactggaatccagtgttagagtaagactagctttgatccaatagccaccattaaagagatacatgttaaacttgtgctgcaggtacatgcctgtaaaaggagaatgagtcttcaggtagtagagcatgttctgtgtaattaaatcttattttttccttgttagagtgcttgtgcacagagctcgaaaactagctcaacaatactatcttgtgtaccaagaacccattcctacagctcagctggtacagagagtagcttctgtgatgcaagaatatactcagtcagggtaagttgctttttttacttgaaatgtgccatgaattgtagggggaagttattttaaagagtaggtatataaatagagtgggacttaccatttctgtatttgcttaacaagtggacagaatcactatgatgaatatttctgatcttatctggctctggagtatttatttaaggaaaaaaatgtgttttcttgttgcttatgtaacagcagaaagcagcttctagatatacaaagttcttttgccagtgattaaaacactttatggacagacaatcattgcaactttaaatttttctttttttttttttttttttttttttgagtcagagtctcactctgtcgcccaggctggagtgcaatggcatgatcccggctcactgcaacctctgcctcctgggatcaagcaattatgcgtcagcctcctgagtagctggcaccacaggcgtgcatcaccatgcttagctaatttttttttttttttgtatttttttggtagagatgtggtttcactatgttggccaggctggtttcaaactcctgacctcaagtgatctgcctgtcttggcctcccaaagtgttgggactgcgcctggccgctactttcaaatttatctttctaaccagaaatgatggtaagcacatgatgaaagcagctcttggacgtattcatatttcttttcattccccagtttcttaagtttgggtgtagatgagatagcatataggtagttgttgatacgtaaacctagtggaaaagctgcattaactgaaagttgtcattttgtaataggtaaacctagtggaaaagctgcattaactgaaaattgtcattttgtaataggtaaacctagtggaaaagctgcagtaattgaaagttgtcattttgtaataggtaaacctagtggaaaagctgcattaactgaaagttgtcattttgtaataggtaaacctagtggaaaagctgcattaattgaaagttgtcattttattaggacactaaatgttactacacacttattaaccccagtgtcttaggtaacactgttcaattcaaatttttttttatttggctaccattcctcactaccataaagagaattagttttgaattgattcattcagaaaggtgttaaatactttctaaggaacttaaaagtctaattcagtttgcctgataatttgctttatttgagagtactgataaattcttgaggatgactttaacaccatgaaaatgccaagtaattttcattttcctccctgcagtggtgttcgtccatttggagtttctttacttatttgtggttggaatgagggacgaccatatttatttcagtcagatccatctgtaagtatcatttaatgtatttgagggatttgttaaaagtgctctttgaatatctaacagaaatagaagccataaaaactttacaatttagcagtattttcttcttttctcttgggctttagaaagtatgaggttgtgcatttttgtgtgtatatttaaaattttggtaatttggtcttctgataaggaagctgtattagttctaccctcttttgccatgttcattaacttcatacacttgggtgatttgttgaaatagttatcaaatgtatttaaacctgttacttcgggaaatactgcaattgaagatgtggatctggaggacagtgttgtagtgtttgccatcagttgaatcttggggctgacttgagtgagttttccagcaaaaacattaatctatcttgaattcagtgttttgcaaaaatgattgtgtaattggtaccttgggtaagttgtctgctctaatgcagaagaatggtatctgaatagaaggtgtttgtaatggataatactactccacatctgtcccatttgctatgagaaccttaagacaaaattcaagattaggaaatgatctttcatgttttatggattattagataattacaggttcactcaatgcaaaccttataatctacttttataacctgagatggcaaaagaaaaatattttggttgttaattaaatcagaaaaataagtattttgggaactttgatagtgttgttactccatctctgagcttccaaagctaaatgacaggccctcttatcttcctttccagaaggtagcagaagccaccatttctggaatcctgattttatcttttgtcctattttcctctgttgtgtctaaaaaacaattgttttcatttaaaacatattggattatgtttcttttggtatttttttctaatgagatgctctctttttaattcactaatgatcaagagttgatcaccatttttcagatttatatgatagatttttaaatcgcttcagtctattaaactaaaatactactcttgattatttgctttaagttaacctcaatttcttttaactggattttttacataattttacacttaattgcatcatcaccagctcatcagtttgatgagttctgatatatgtaaatgcctgaagaaaccattactacaatgaggatatcaaaaatttccagaacctccaaaagtttcttcatgcctttttggtttccatccttctagccttcttaaaaaataacctattctgtgacgttttccattctaataatattctgtgaccttcgaagttagagaacaattaataaagctaaaaattaaatggcagggcaatataattgtatttgtgttttaaaatatggttttttactctttctttcctgattagggagcttactttgcctggaaagctacagcaatgggaaagaactatgtgaatgggaagactttccttgagaaaaggtaggcctactcattgtaactgcattctttagcaaactcactttatggtttttggtgctctttaagtaaattaatatcatgggactaaagaaacttgctatattactctgtatatgaatctagttacagataaaccaaaaacttctctcccttctagtttcctagacttcagtatattaagtggtaattaatattcatttcctaaggagttctctttctacattctatggtttcctaaatgcttttggtttttttactttttacttcactttttgtgccatttcaggagggaaaaaaaagaacattgaatctggaataaaacatttggggagacaaatttttaaatgatttaatgataacagtttacgacagtaaaaaaaattgtgaaaccaaatgcctggagttgaaggtatattaaatatttgatacatgtgcttgataaaaagtggagcactatgtaaaaatctgtcggtgcccaagtacaagctgctcttacttatttccagctgtattctagtctcagtgttactgtagtccttcgggactctccaagcttttgaagaagaaaatgttttatttcttgatatgtaatagttgcacatatttttgcagtacatgtgatattttgatacctgtatacagtgtcaaatcagggtaattggatatccattacctcaaacatctgtcttttctttgtgttgggaacatagcagatcttctagctgttctgaaatatacagtaaattgttaacgataatttcctgactgtactactggacaccagaacttattcctcctgtctgaccgtatttttagaccccttaaccaacttccttcatttcttcttcccttctcccttcccagcctctggtaaccactgtgctactctctccctccatgagatccacttttttagctcccacatatgagtgacaacatgcaatatttatctttctgtgcctggcttattttgcttaacataatgacctcgagttccatccatgttgctgcaaatgacaggatttcatttttttatggctgaataataataaaaaacttcgtaactccgtttaacagatgagccttcacagtacatttttcacgtaacgttaaggttattaaaaatcttaggcctggatttaaatggtaaacttaatcttaggctcttaaagcactttttcatttttcttttatatattaatgagtcttccaaagatttcacattgttatgacatgatatgttatgatttgttttattttttgtttcagaggcattttatttagacaactaaaaataattagatgttcagaaccagtgtacaatgaaagaaattaaaccagttactttatcatgtattccctctttacaaccaaagcaaaaaacaatagcaacaaagacattctgctttaagggaaaagtcagacaaataagccaatatatttttcttctccataatgacataaacagctgcaagaactcttaattgtaataagagaagtcggatgttatcttgtacatattcattaaaaagatgacaggccattgtactacaagaggataactcaacctcccttcatctgatactcttgagatttcacttatgggtaacaccatgttagttgttccagcaatggagctaattcatattcctcattatttattgctgtttttgccttaagcagagagtaactctggaaggctgatgcttttctctgcttgctcgttctagtccagttgtatgctgtctgtggcacatgcttgatgttcaggccttaacttgaggagttgaagaatagatggaatctgaattctctgaagcaatttcttctagctcttctcttgtctttggaaaaccaatctttggctttgccagctcaccagtatcttcttcaggaagcacacatttccaaaggccatatgtttttcctaccacagtttgccagtctcagtgttccatcttcagaaccactggcatagagttctccatcaggatcaaatctcacacagtgaataggaccagagtgtcctttgtaggattctaattcttctccactattatcatcatacttataagtttaacatcttcaccacctgcaacaagaaattctttctcaaggtgaagagattcagagttaatgtttgcaggagcttgaaaggatttaattggttccaaacttactgtactgtcaaaagcactggatcagccataagttattaccaaaatctctccctcaggaatatattccatactactaggcaacataataaaatttagagatttcacttctgtcatagtagcatgatcccaaagtcttaacagttttgtcatcagaagaaagaatctgtttatcctcactgtaccatagggcctttttaatatcagagctgtgatcactaatttcctcaggttctgcttcgggtttgttcaagtcatatatgcaaaacagtttattctgtcccctggttaacaaataattactatcctgcatgaaatccatagtcttgataatgtgtttatgagccagggtcatcagttcatctcctgggatagcatcccacactttgtgaaatctgcagctgctgtggctgctttggtggcatccttatttagtgttgcattccagacagcatctttatgacccaaaattgttccaatccagtctcctgtatctccctggcatagcataggtttgccgtctttgcaagcactgatttagaaatactcataagactggccaggcgcagtggctcacgcctgtaatcccagcactttgggaggccaaggcaggcggatcacctgaggtcagaagttcgagaccagctgggccaacatggtgaaaccccgtctctactaaaaatacaaaaattagccaggagtgatagcgtgcgcctgtaatcccagctactcgggaggctgaggcaggagaatcacttgaacctgggaggcggagtttgcagtgagccaagattgcaccactgcactccagcctgggcgacagagcaagattctgtcttgagggaaaaaaaagcccctaaggcatgatgccactgaaggccaagtcagccacgggccatatgtggccagaacaggtgagcagcatcagtctcattgctatggaggtggtgaacccagtgattgggctggtgggctgagggtcatccttgtcttttctcctctggtacagcgcccggggttcctccaggcttcaccctaacacgggctgagcagagaaaaaggaaaaggtggcaccgagattaggaaggagctagggaggggctggggagtctgggaagggtgagcaacagttgacaatggagggaggaaagtaggggatggggagaaccgaagaaacgacccagccattcttcgcaccgtccacactggtatcggcaggaagtgacatgttatgttttaacttataagaaaaagattttagcaaagttctgatttttctgtgttttaaaaattataataatgccaccacatcctgattgttaaaatatttatacttaagaagtttcctggctgggtgtgttggctcgtgcctgtaatcccagcactttggtaggtcaaggcaggcggatcacgaggtcaggagatcgagaccatcctggctgacacagtgaaacccatctctactaaaaatacaaagaaattagctgggcgtagtgggcgcctgtagtcccagctacttgggaggctgaggcaggagaacggcatgagcccgggaggtggagcttgcagtaagccaagataactgtgtctcaaaaaaaaaaaaaaaaagtttcctaaactaaactcattttagggtcataccgttcatgatgttgggaattgagcaccagatattgtcagtttttttaatctggagacagctacaaggaggtgattaaaagaatgtgtaatttagtatttttaagatgtttagagttttaaaaacttacgttgttgctgtcattgtatttaaatagttataaagaatataaactgatataagtaattttttttaaattcttcagatataatgaagatctggaacttgaagatgccattcatacagccatcttaaccctaaaggttagctcagtattcaacaactggatttataatgatttcatgattaactgcttagaaaattgaccttttttcctccctcctcaataggaaagctttgaagggcaaatgacagaggataacatagaagttggaatctgcaatgaagctggatttaggaggcttactccaactgaagttaaggattacttggctgccatagcataacaatgaagtgactgaaaaatccagaatttcagataatctatctacttaaacatgtttaaagtatgttttgttttgcagactttttgcatacttatttctacatggtttaaatcgactgtttttaaaatgacacttataaatcctaataaactgttaaacccaccttccagccttttaggagttgctaaaattttaacagttatttcctgctttttatcacagttgatttctgaagactacattgccaagcagaatgatgaaatgactttttcgttgtcaggcaattttggttaagtcaaatcttaatgccctcttcgctatcagatgttgcctgtgtttccataaagcaaaatgctgattttggtaaaaaacatgactgcttctagagctgggaggatctgcagactttcacggattcatggaacaagaaaagaagcataggtacttttaggtgccattaggtattgatcagtgaaatcctagggtgctctatgagattgtactaggcctatgaagagtggtaagccaaataggtctccatgggagatacattatgtaaataaataaacaatggtttgctggttcctgttggtgtctccacaagtaggtaaacatgtttaaaggaacccgggttcttagattttgttagactttttaaactcaaggatgagcataagtgcttgaaataaaatgctaatacttaagtgtcaaaactatggcttaaggctcttgttaattcattaatgtaatctcagtataataaatagcttcactataatgaaagttataattaagtatctgcactcatatgaaggcagtgcttagttttttttttttaaattttttttaaggcatcttaggataaaatcattaatttggtttacagaacataaggagagtttataagcataatcattcttaccaacgtgaaagtatagtgggcaattccatgatttaaatggagctcagaagattctaagatttagttaagggcaaaagaaccttattttggagatttttctcagggtccccagttctgttccctaccatcactataacacccatatcttgttttaggtggcaaaagcattaaggagatgaaagatggtaactttggcttcctgtttcaagatgtttatcttggccttgtctaataatctcttatgggctcttgatatattttgactttggcacactagaaagcggacatagtagcaaaaaggtctttgaagtcaagtctcagctatctcacttactggctgagtgactatgtgaggtaattatctcagggttggttggttggtttgttttttgagacaatctctctgtcacccagggggagtgcagtggcgtgatcttggctcactgcaacctcatcctcccaggctcaggtgatcaatccttttacctcagcctcccgagtggctgggactacaggcgcgtaccaccatgtttggtttatttttgtatttttagtagagacggggtttcaccatgttgcccagactggtctccaactcctcagctcaagcggttcacccgccttggcctcccaaagtgctgagattataggcatgagccgctctgcccggccatatctcagggtttcctaaggactaaatttgataacacaagttaaagcctggtgtggttaatagttactctgttaactgccgttgattttgtttagtccttctataatgtccagtatcaaaagagcaaagcaatgtcaaaattctacaaatcaaagaagggaaaattaaaggcatgttaatatttcagaggtaaggaaaactcatgtaggtttttattgtgtgctaacaaaattaggcctaaagaataaagggaggaaaaatcagctgaaccagatttgatccaggttctgttttccacctcctgcccccattaaatgcaaagcccagttccagttcaagctgcctacaacacttctccctttgttctgtttattctttccacgggccttaaaattaagttgttcctttttgtcccagttcttagagttctttgatgtagcaacccactgcattcctaaacattccaaaactcttgaaccatttccagcctgtggattttagcttaagtatcataatgtttctaatgttcagagcctctgccttttggttcattttgtatcttctaacccttaaaacattttaactccatttgttctacttcctcccagttctactgaaccatgaatttaaatttgcaaagcaattaatagcagtgaaacatggagatgtttaaaattcacatacacaggcaataaagaatactaatacagagccttataattatcaagtgctgataacactcaagcatccctgaaggaaaaaaaaaaaaacccaaccttgagataattaccttgcacagtctctcaggcatcaagtaggtgataagtgaacattgaagggttttcatctattgctcagttttcttcatagaatgaaactgccaactcttagtacttacctcacctttttttcaggagtctactcacccatgtaggcaagctctctgagccccccattgcaaagaagagcaagttgatgttcagcgaattgcccaagaacatataggagttgagagttcccttggattagaatcctgatttcctgaaaaccagtcctggtggttctgtatgaaagtcacattgcttcacacagttccttcaatttagagctcctccctc

SEQ ID NO: 13015 - DNA, 26777 bp, Human
aaaaaaaaaaaaaaaagttttatcacttctttttatcacattgtttccttttagtagttgcatatgtgtatttagtgtttagttcatttgtatttctgtattttgaaacatgacattctctttcctaaacttatgcttgttcttcaatatgtattataaaagtcatattttatgtaactaactattccacttatattttgcaaatagttaacagatttatcaactcagtaaaattgtatttttttctcttaggctaggatttattatctctattttcaaaattactgttattcttagaagattttttatatgtttctgtatgagtcagaacatgagtttctttttttgatttttcagcaacttggtgggtatttatttttgaaggactgtctagaactgttggcttatttatgagcattattctttatggactattattttaacagtttagaaaaatacagaccaaaagagcacaaaaattcaaatgaagataccacctttaaactctgctatttttaccaaaatgaacacagaataccatgttgttacttaaacgtttgcaaagccagaattgtagagaaaatatcttaatagaaatggatatatgaagaaagttaaagtaaaaaaaaaaaaaaaactatgctcttctgaattttagtatcctgagtacagcatttctttagtttttgatgtctttttattttagtctaacataagtaatgatgaaatatactcaataggtaaaatgtagctatcacaaacaataatgagtatctgattaggcagaattggcaagttttacatctctagcaaagacatatttgatgaataatactaaaatgaatgaattggtgcattttagaaaaatacattttgaaaagatatggctcaaatcatcttattcaaatttcaaaattaagagaaaaactagaaaactagtatcagctaatatgaaacaagtagatttaagtatagactgatgctcaaaaatgagccaacagatctagacagtcacctcaaaaataaataccagccagtgtattgtggcttttcagaatattttttatataggattggtattatataataatttgaaattttcaaacaatctgttacgtgtctattatctagtttttattcaaaatttcaccattaatattgagtactgcttcatttatttaaagttagaattatttcagcaatacttgtatcattgttataccttgaattataaattcttgttaaatcaggtagaaaagaacagttcatagtattactaatgattaacctctccattgtcagtgtgattatttttcttagtatgtggcagtttaaattttaacatggtgaattaatctcagaatgtttgcttacatacatttttctgtaccttgatagtatttttttaaatttctctgaatttattataaaactaaaattctaatttttaaaataaagacaacggtatatactgacattatatctgaacaagcatatgattaatattttcttaattgttgattttttcttttaatatttatctttcctaattgacgttttcttcttgaaaattgtacctaagtgaatacacagtagaaggatccagtatacagaaatataaaaggaatgaaatcagcaactctttactttggaacacagatgtaatactcattagcatagttacggttattgttattcttatctcttagcgtacctgaagctttctttgaaagctttcaaccttaaatgtggctaaatagcctgttttctgcatttaagaacaaactatatttcctcttctaagtagattcaggaattagtctacttaacatttctgctatttgtttggcttgttgctctccataggaaaactatttttctaagatatttatctattacagtagaaaatgtttttcctttcagactgctttttcatagtggcctatagtataaatttattcctttcacagtgtaatttatcacttttatttttcctataggattttctgccgtctcttggcaaaaatggcaaataatgatgctgttctgaagagactggagcagaagggtgcagaggcagatcaaatcattgaatatcttaagcagcaagtttctctacttaaggagaaagcaagtaagaaaatttaaaattttttgaggagatacttaaaatgaattcatacattgatggagaaaaaataatgtttaccgctttaagttatttaagttttacttagaagtttctgttatatgtagaaaaatatcaaacctgaatttctaccttcaggacttcagttggctttggttttgtttgtttaaatgtattttattttcagtagtcaatgtcagaatagaaatttcaaaatcttttgctgtcactagtagaaataaatgctttcctacgttttgtaagctaatggcttacaaaaacctgtatttactctccagaaactttatcaatttttttctaattttaacataccactttgtttctttttttatagtgtttctcgagattttaaaattatttttcttaaaaattcttactctctttttattaaaaagatgaagagattggacatagtcattgctcatatgatataatatatgttgtaaaccaaattttgtcttctgtaggtggccatttcctagcctcttgataagcattttagttttgccagtttgaaaatctttctacttattcttcacctttatattattctttggtagcctatactggtagtttttagtcatattgctcccaatttaggatgaatgttttataaaatctctgttaatatcctgtaaggaaaatatttcctagaaaaataacctacctatatataattttaaaacatatcttaatcctatatataaaatagagaagagaaataaaaagaaaggtataagtagtagtaacaataatatgtatttcagtaagtaatacttcagcagaattataccactaaaggcagtgtaagagggtcacatgccccatgattcacatacatggaatcatcaagaatgcaataggtacaatgccaactagtataggtatatagtcagactgcctttgtgtaggtgtctcagataccagaagcagatagtgatatagatgatttattcaaactgatgagtgattgattagatagtattttgaataaaacaaggtacagtctactcttgatttatgtggtacttgattcatagaaaatttagggtataataagcatgcttaaaaacactttgtgtttatatataaagaatagttaaaaatctagactcaaataattattaataggatttttacttatacaaatttatgataggccactataaagttctgcaggatgtgaaacagttcttcattttgcaggagtatccagcatactgcaggacatctgacattcttggcttctgcccaataaatgccagtactaacaatcaaaaataatcctacagattttcaaaatcctacctacaaagcagtaccaaccccactgagaaccattatttttctcttatacttttgttaccccattgcacacttttaacacatacattatattttgagcaaatccttgagttatttcactcattgaatgtttgattagcttaactcagactttagcaatattcagcttcttttaaaaggtaatgactaaaaagaaagacatgagaatagtttttgcttgtgtggtaacatctcagaatttttttaaaaatatatatataatttaatataatgcttctcttttttttcagcatctgttattgacattttatcttttatttttaaaaatttttttgagacagggtcttgctctgttacccaggctggaatacagtggcactatctcaactcacactgcaggctcaatctccaagcctcgatcagtcctcccacctcagcctcctgagtagctgggaccacatgaatgtaccacaacccccagctactttttgtatttattgtagagatgggttttgccatgttgcccaggctggtctcaaactcctgggctcaagtgatcctcttgcctcagcctttgaaagtgctgggattatgggattacaggcatgagccactacacctggccacatattgacacttttgtgccagcttcttaagttatttgccattgccttttattatagccgcaatgctgaaaaggtggtaatttgatcttagttagcatcttaataggagctaggaaaatgattcataaacaaagtctttctgttttactcttatttcatatattttctccctctctctctctctctcttaaatagcatgttgttttaataaatattaaactggcataaaggcactggccaaacatttggttacactagagctagtattatcctagctgtagttatactggctgtcttcttttcaaatagtattcatacaaaacctcttttaaaaacatattttaactggatgttcttgatcctagttttgcaggcaactttgagggaagagaagaaacttcgagttgaaaatgctaaactgaagaaagaaattgaagaactgaaacaagagctaattcaggcagaaattcaaaatggaggtaattaaatatagaaaatttgagtaatccagaagttaagaagttggccagtcacaccaacagtgaggaaagaagtaagaatctgtatctaggcaacttggacaacttcataacttctaaatgactcagatttatcaataaaatgggggcatggatagaacctacttcttagagtatgagaattacatgagttaatttgtataaagcattttgaaaagtgtttggggcatagtaagttcataataaatgttagctgttcttatttgcaggtttctcggtttagtaattgattaaatgggaatcatgcctttattctttgatacctcaattatggctaaaatatgcctaattttttggcagccattttatagtctcagacagtggatatttgatagccatatacagtgaatttttcatttaaaaagagttcccatttgtggttcacaatttcatattttttgtcatatttattggtttaatatgaatgacattatttcattttctgtctcagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggtatttttgacctttaagcatatttagctcttgactggattatcagaaaatgtcaagttttgataatgataataataatagtatcaaaagtaaagttcaactttcatgagctaggataaaattaggaacaatatgatattggaacataaaagctgggtcctaaatggtgtgtgaatattgaccagattaacggggtaaaaatgtggcattttaggcagagggactggcataagttaaaacagactgtaaaggttaagtgtagaaacccatatgtagtttggtatggctgaattttggtatctatttgtggtatagtttgagagaagtcacagataggaaactagcttaggaccagttgtgaagataggaaaagaacattccaccagtcaaaacagactgtctgaactaagatttcaagaatccatgagaactaaagtagatagaaatgtcaccatccacttaggcaacaacccttgaaatttagtcatcaaccttaacctgtccctattccctgttcttcatatctaattaaccaacaaattctattattcctgtccccaaaacatacatagaccccagctctgctctttcttttcattaggtcctacctcagttcaggttttcaacgatctttcatctgaattaatattaaagcctcatcttttctagtttatttttagccttgctgctaaagctatttattctaattgtaaatctgacttcctttccccagatatgtctaaaaagttgcctttataaataattatgaatatttctcattatacttaaacttatttactttttttttttttttttggaaaatataacatgcagagggatttatgaactaacccaagccaatttagcctctaaagcacttgccagttcctttggcaaacatcagtaacctctgttagttaaaagtaggtaggggctgtacagcctctgctatacaacttcaccactaggtggtatgattacaatgaaagcaagtcagactaactcttctagtttataaagtacgttaagaagtagacacaaaacaactatataacctgttcttgcaaatttggtggaatccatattctattctctaaggagggtgcactgttctgactcaggattaatcagtcttctagttagagaaggcaacaaggctctcctttgatggaagagggagcacacaggaccacaagaccaaatggagttataagattagaacacttctatccaatggaactttctatgataatggaagtactctatatctgcattatccaacatggtagtcaatggccacatgtggttattaaagatttgaaatgtgggtagtatgactaaactgaatttctaatttaaataattttaaatttaaatttaaataacctatgtggctggcagctaccatattagacagtgctggttatagagggctgttccataggtgtttagctgctagctaggactgccagattctgctcatgcaagggctgtggtgcccatatgatctttctagactgctacatatctttttttttttttttttttttttttttttttgggagacggagtcttgctctgtcacccaggctggaatacagtggcataatctcggctcactgcaacctccacctcccgggttcaagcaattctatcttagcctcccaagtagctgggactacaggtgcatgccgccatgcctggctaatttttgtatttttagtagagacaggggttcaccatattggtcaggctggtctcgaactcctgatctcaggtgatccacctgcctcagcctcccaaagtgcggggattataggcatgagccaccatgcccagctagactgccacatatcttaattgagcgtcactcatttgtcagtgaaggatttctgaaattccttatgataattaacaaagatcttggtatagattttaatatttgcaatcatttctagaatggggattcctgataaaagtatttcaaatgcctaggaagtacattagagttttaaaatatatacaaatgtagatatattattatactacagtatttttaaagtaaatgcatatactttatcacacaaaaatattaagatttttggcatattctggtaattttgttgtacatatttttctgtataatttggatttttaccttttgaaaaatttttgctaatttgtttatggaaaatggaatttttttaaagcttgctaatgagattaaaaattggccattattttaagttaattccatcccctctttgataaacttattgttgtatgaattatgaatacctttacacagaattctcctttcctgcttcatgcagaattattcttcactgagtttctatatttctttgtgtatgtcatgtttatcacatattcattatacatatacatgtctgtcttctttaaaagagattttgagtgccttgacaacatggactgcccatcttactgtttccagtgtcatagcactccgtatgttgaaagattaaataaatgtatagttgagaaagaatgcttccaagctacaatagcttatctctgttctttggattcaaaggtaaataaggttttattttgattttacttttttggggccagaaaagctaattgtaaacttaaagaatatgaatcctctttgcaggttacaattaactcagtagctaaaataatcatgtgttaataagagttacattttcagcaaataaataaaaatataattattaaaacataatcagaataaaatattcttatctgcttaaatagttactgtggataaccctaaaatcctaatatatcttcagagaaatctaagaaatggagaaattaattatatacttactagtgtatataagtgaggaggaaaatatttaatgagtgaaattgcattctgctctagttcattctgtcatttgggtactggttgtggtgttctttctaaataaagtatttatcaccttccaaagagccatagtaaaagtttttagaggattctctattatcctgtttcggggaaaggcaaactttttctgcctaaagcctttgtcacaactactcaactctgccctggtgcaaaagtatccatagatgatatgtaaatgaatgaatatggttgtcttccagtaaaactttatttatgaaaacaggcaacaggctggatttgtcccatgagccatagtttgccaacctcacacaatgtcttcaaatagaaatacaacagagaaatagctaaaataggattcaagattttatgacttggataatttttttctttgttattatttaagtgaaggtaggagataaacattctttttattttttccttttaagctcattggtatggataccatggagttttcatagtgtttttttgcttggttttatttctgatgtttacccattcataaatactttttaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacaggtaatctgtacaactgaaattcctgttgtgtacatacaacattttcattccctccttcttggtatctttccattataattttgtataccatacaacatgtgcccttgttaattagttcagtcgattagtttgaatgtggttaattacacaaaaaaagcataaaaccaccaaaaacctgtaaaacatctgtaaattaagatataatgcataaggataggaagaagaaaagatgtattattttatctatttttaaagtatttttacttttgtattttgcattaaaaaactattggtgtgtatatatatataaaatatatttgaaatctaagtaacaacaaaatacaaaacatcccatttttaacaaataaaggaatactattaaaaattacaagttcaatctccgtgatcccctctcctcatttttcctcaagtatgaaaatattttttgggttttagagaaataaaacttgctctcatgcttttagattggtgctttctgggtttattttacatgattttgaaaagcaaggaattataaaattccatgatgaagcagtgataaaaataatgattatgatgactattgtgttagaagtacttaatagataaatttttttcacatgctattttatttcttactatatacaactgtcagttaagtagtatcaccctcatttacagatgacgtttaggaaagttaaccaagttatgctatatatatacagagatacatatatatatatatatacatatatatataagttggttcacttttttatgtatctatagatatatactcattatacatctgtctatatagatatatatatatatactcatttatctcactctgaggctgattatctttaatccctatactgttcagctttactgtttaccattcaaggtggagttagtcatgaaacttctaactacaggtgctatgtagtttttagagccatgcatatgaccaaggtcataaattacaaactgctgggccaaggaaagaatgcaatcccaaaaagtttcagtttatctttcatagtatttcataaaatacttacacatggaattttacatgaaaatcctgatgtcttgtttcttaaaaattcagaactaagccccacccccacccttcccaaccccctgctattttcttaaggcagaaattggttaacacttagtaatggatagcccctttaggtggaagttagactctttaacacagtttcaaccattccatagttgaggtggaaggtcacttgtgattatttggtatttatctttacttttctgctagtgttatatttacggaaggttaagaagagactcgagtatctttttttaccatgtctcaaaaaaacaagggtgttacttgttttttctgtctaggattccttactcatttcctttacttatttggtagacagttgtatcataattgcatcaaattgcacttttgatccctagcctgggcttttgttttggctctctaatttcagcgttgctggaacacagtacgggtaatggatcaatattgacctatcatcaagagtacaaggaagtgatttcttctacttcctacttaacaagctcatttcttttaggtctccaatgattaattatccgagccagtgaagtttgggttttaagtgtttcataaaagaaattgataggaggttagagtatctccacttttcctttcttctggtgagtttagcaccagggactgtgctttgtgtagcttcagaaaacaaaccatggttacagtttatataatattattccctatttaaaatttaattctttctatagtgaaattagagctgggtatttggaatatgtgaaaagtattgatggtatattttatgaaggataaccttgcatgataaccgttttaaaagcaaattgatactccatgatgatacccttcagagcagtggtttctaactgttgctttttttcttataagctttcaaacctccttctcaacaaaagtttactttcttcctttttctttacttttgaataccatatttactttcttgaagaaatatggtttttaaaaaatctagtaacagtggaaagaatcgaagacagtagcagttttaaatgtcctctttctagatgtcttctatggtggtttgaatcatctacctatttcctctgtcccatggtgcttcagagatattgcaaagaatatggacttcaacattacgatagttctgcctttgtttattgctactctgctgcttgttggttttgtgaacttgaacaaatccctgtgttcattcaattatatttatagctgcaagtatttattaagcaccaagcacctaagtaaaggatacagcaacaaattaaaatacagagatagataaatttcttttttcttttttttttttttggagactcacccaggctggagtgcagtggggcagtctcggctcactgcaaccactgcctgcctcccggattcaagcaattctcctgcctcagcctgccgagtagccaggattacaggcaccaccaccaagcccagctaattttttgtatttttattagagacagggtttcactatgtgggccaggctggtctcaaactcctgacctcaggtgatccgcctgccttggcctcccaaaatgctgatattacaggtgtgagccaccacacacaagcaacaaacatatttttaaaaatagccctgcctttatgaagctcacatttgtataagggagtcagaaatattaccaaggtgtaagtaaatatttagtatgttaaatagtgataagtgccaagagaaaaatagggaaagaatctagtaagtattgaggccaggatgatattgacattttatataaagtgcccagggaagacctcaaaaagaaagtgacatttgagtaaaggtctaagaaaatgaaagcaagtcatgtgtttatctggctgaagagcatttcaggcagtcctgggagaaatggatggctgggatgttcaaggaacagcaggaggccgatatgaatagagcagggttaataactgagaaagtcatgggagatgaaatcagagataagggtgccaaatgtcttatagatcattgtaaagtttggcattttttctgagtaagatgaaagccattgtaggattttagagcaaaagaataacattggtcagcctgacattttaataggatcattctggctgctctgttgatgggaggaagatggaattaaggagatcagtgaagtttctcttatctaggaaaaaagaagtagacttggcatatgcatgtgctttttttactttttaatatttatgttatataggaccagaactgattcataactccttatgaagttaggagccctggagaaaagaaccaactgatcttcagccagcttaaattggaaaaactcctcatttgggcttcatcttttctgttcttataagttgtagactattttttctcttccagcagccatcattcacaaccataagcaaagctatttttataaacatctgtatctaacccatcaagatacaacctaaaataaaagttaaaaaaaaaaagatagtactagtaaacattctataaagtagggacacttagaattcaaaattatatactctgttttgtaggtggtacatttttctagggaaaagtttcatagctatcgtcagatccttaaaggattgcatcttactaatcctgttgctactcttaaacacttttgctgtaacttttaagttctcatatacgtgacattgtcaagttatttgaagcattcgaagagaaatattatttatgaagaccccctaattcatttcgaatttgactcttaggctcatttttttaaatcatagtatttcagagtaaatttgcatataacatttatttataaaaccatcttttatctagaatgcatctttttttctcctttgagcaatagttctcttgtatgattcattttaaacttgttgaaagaatttaaataactatatttcttacttttgctagttggagaaaaaaattaagacacttcaaatatgaagattaaagaaatttccgtttgcttccataaaaaatttgtagaactagccctacatgttagttgcatgatgcatgatgctgaaattgttaaatgatcttttttttttttttttttttttttttttgagacagggtctcactcttgcccaagctggagttcagtggcataatcaaggctcattgcagcctccaggctcaagcgatccttccacctcagcctcccaagtagctgggactatagccacatgccaccatgcccagcgaatttttttattttttgtagagactgggttttgccattttgcccatgctggtctcgaaaaaaaaaaaacactgggctcaagcagtctgcctgcctcagcttcccaaggagctgggattataggtgtgagccaccacacccagccaattttttttaaattaaaaaataaatctagcatagctctggaaatgatcaaatgtgtagggaagaaaatgcacatgtgtaaatgtgtccatttattttaattctaatgctaggctaaatgctttattatgcatgttatgatttaatccttatgacaactcttcaatattatttctctcattttttgaggaaacaggagtgtcaactttatgcattctcattgctagtacatggcagctgaaattcaaaaccaagtctgtttcactcatttattcattgagtaaatttttaactgaaattcctctgctctttcaaccataatgcgttatcaatttggaggaatttttttttcatgtttatgcaaagcttcgtaacaacaataagagactttgggcacacaaagacaaaggtacatccacaaaagtagaacatttgatacttagcatattaggtgtagcttaatgtagtctggatatgattaggcttaatctgtgtacatctttacttaccagtttatatttcacacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggtaggtatttattagtaattacttaatagtttcggaatcagttctcaaagtgatgtttgtaatgcttaaaggttaaaatcagtcctgtgtaagaatcatgagtcttacattaatgaccattattaactattattgagtttttcaagattggctcaagatgacacattgagtaaaccttgtaatcattctcctccccatgaatgtacatgttgtataaaacacctgatatggtttgactatgtccccaccaaaatctcatcttgaattgtagttcccataatccctacatgtcatgggagggacccggtgggaggtaactgaatcctgggggcaggttttacctgtgctgttctcatgatagtgaataagtctcatgagatctcatggttttataaaagggcagttcccctacgcatgctctcttgtctgctactatataagacatgcctttgctcctcctttgtcttctgccatgatcgtgaggcctctgcagccatgtggaactgtgggtcaattaaacctctttcttttataaattacccagcctcgagtatatctttattagcagcgtgagaatagactaatacagtaaattgatactgggtagtagggacactgctgtaaagatatccgaaagtgtggaagcgactttggaactgggtaacaggcagagattggaacagtttggagggttcagaaaaagataggaaaatgtggaacagtttgggacttcctggatactttcagggctcaggagataggaaaatgtgggaaagtttggaactttctagagacttgttgaatggctttgaccaaaatgctgatagtgatacggacaatacagtccaggctgaggtggtctcagatagagatgaggagcttgttgggaactgaagcaaaagtgacttttgctatactttagcaaagagactggtggcattttgccctttccctagagatctatggaactttgaacttgagaaagatgagttagggtatctggcagaagaaatttctaagcagcaaagcatttaagaggtgacttgggtgctcttaagcattcagttgtattcattcacaaagacatggtttggaattggaacatgtttaaaagggaagcagagcataaaagtttgaaaaatgttcagactgaagatgcagtagaaaagaaaaacccatttctgccagctgcagaaatttgcataagcaatgaagagccaaatgttaattgccaagacaatggggaaaatgtctccagggcatttcaaagaccttcacagcagcccctcctatcacagaacctgaggcctaggaagaaaaaatggtttcctgggctgggcccagggcccccgtgctgtgtgcagcttagggacttggtgccctgcttcccagctgctgcagccatggctaaaaagggctaaggtacagctcaggcccttgcttcagagagtgcaagccctaagccttgacagcttccacatggtgttgagcctgcagaggcacagaactgaggttcgggaacctccgcctagatttcagaagatgtatggaagcccctggatgtcctggcagaaatttgctctaggggcagggccgtcatgaacctctactaagacagtgcagaaaggaactgtgggatgggacccccccacacacagaatccccactggggcactgcctagtggagctgtgagaagagggccactgtcctccagaccctagaatcataaatccactgacagcttccgcagtgtgcctggaaaagctgcagacattcaactccagcctgtgaaagcagctgggatggtggctgtgccctacaaagccacaggggtagagctgcccaaggctgtgggagcccacctgttgcatcagcatgacctgcgtgtgagacatggcgtcaaaggagatcattttggaactttgaggtttgatgactaccctgttggattccagacttgcatggggcctatgggccctttgttttggtccaatttctcccatttggaatggtgtatttacccaatgcctgtacccccaatgtattctggaagtaactaacttgcttttgattttatggctcataggcagaagggacttgtcttgtctcagatgagatgctggactgtgggcttttgagttaatactgaaatgagttaagactttggggaactgttgggaaggcatgattggttttgaaatgtgaggacatgagatttgggaggggccaggggcagaatgatatggtttggctgtgtccccacccaaatctcatcttgaattatagctcccacaattttcacctgtcgtgggagggacctggtaggaggtaattgaatcctgggggagggtttttcctgtgctgttctcatgatagtgaaaaagtctcatgagagctgatggttttataaaagggcaattcccctacacgtgctctcttgcctgctgccatgtaacacatgctcctctttaaccttctgccatgtggcggcctccactgccatgtggaactgtgagtcaattaaacctctttcctttagaaattacccaaccttggatgtatctttattagcagcatgagaacagactaacagaacaccacagagagattttgtcctaactaaagcaataatattaataccagcgtagcagaaaagtatgacgtggatagagaacagattaatgtgctgcaaaatctcttatgctgtagattgtctcatgctgcagcacagaaagacagagatgaaaagtttagatttataattataaattccatctaataatatacttgcatatgtttttactcaaattcaggatatagagaaaatatctaagttaaaatgtaatgattttaataatctaaaaggaagtttcattttgtattgcctgttttctctaataaaaatactcctgagacagatgaagcttcataatgtgtgagaaagtttcttcaaataggtctttgaagcagaagagaaaagattcttggcagatatagaataagtatttatctcatataagaggaaggacctgataaaaagaaaaacagttagaaattaagactgcatttaaaggatatttatttgactagagtaattgggaaaggcagatataaatgaagataaatagaattaggtaaaagaacaatttggagacatatttgtagaaatgactgaggatttgtgtgtgtgtgtgagcgaattattttgtaatggtgcaataaaattaaactaaggttttttgggtttttttttttccaacttgtattttaggctcaagggatacagatttcttatattggcaaattgtatgtccttgaagtttagtataggaatgatcccatcacccaggtagtgagcatagtacctaataggtaattttagaaccctcaccccactcccgacctccctcctagtagtactcagtgcattttgtttccatcttcatgtctgtgtatacgcaatgtttaggtttagctctcacttataagtgaagacatactgtatttgatttcctgttcctgtgttgggttacttaggacaatggcttccagctgcatccattttgctgcaaaggatattaatttctttttttaaggctgcatggtattccatagtacatgtgtaccacatttttttaatccaatccactgttgatggacactagagttgattgcatgtctttgctattgtgaatagtgctgcagtgaacttacaagtgtatttgtctttttggtagaatattctatttttctttgagtatatacccagtaatgggattgctaggtcaaatggtagttctgttttaagttctttgagaaactccaaactgcttttcacagtggctgaactaatttgcattcccttttctcttccacctcaccaacatcttatttttgttttttgtcttagtaatagccactgtgactggtatgagatggtatctcattgtggttttgatttgcacttctgtgatgttgagtgtttttgatatttgttggcgacatatatgtcttctgttgagaagtgtcttttcatgttctttgtccatgttttaatggagttatttgttttttgcttgttgaattaagttccttatggattctagatattagagttttgttggatgcatagtttgcgaatattttttcccattctttaggctgtctgtttactctgctgatagtttattttgcagtgcagaagctcttcagtttaatcagctcccacttgtcaacttttatttttgttgcaattgcttttggagacttcgtcataaattctttgccaagggtgatattgagaaggatatttcctagaatttttgccaagggtgatattgagaaagatatttcttagattttcttctaggatttttaagttttaggtcttatatttaattctttaatccatcttgagttaacttttgtatatggtgaaatgtaagggtcctatttcattcttctgcatatggctagccagttattccagcaccatttattgaatagagagtttttttcccattgcttgttttgttgacttgctgaaaatcagatggttgtaggcatgcagctttatttctatgtcctttatcttgttgcatttgtctgtgtgtctatttttgtaccagtacccttctgttttggttactgtagccttgtagtatagtttgaagttgggtagtgtgatgcctccagttatgttctttttgcttagaattattttggctatttgcactctttcctcattccacgcaaattttagaaaatttttttctaattctgttataaatgatgttgtatgtagtttgatagtaatagtattaactctgtagattactttgggcagtaaggcaattttaacaatactgatttttccaatccatgagtgtacaatgtttttccatgtgtttgtatcatctgtgatttctttcagcagtattttatagttctccttgtagagatctttcacctccttcattaggttcattcctagatatttcattttttgtgtgcctattgtaattgggattgtgttcttgatttgactctcagcttgaactttagtgtatagaaatgctgctgatttttgtgcattgattttgtatccagaaactttactaaagtcatttatcagctctgggagccttttggcagagtctgtagggttttttaggtacagaatcataaatcagtgaagacagataatttgacttcttcttttcctatttggatgccttttctttctcttgcctgattgctctgtgtaggactcccagttctgtgttgaataggggtgatgaaagtgggcatccctgttttgttccagttttcaagggaaatggttccagcttttgcccattaggtattatgttggctatgggtttgccatagatagctcttattattttgaggtgtgttcctttgatgcctagtctattgagggttttatcataaagggaggtagattttatttaaagctttttctgtatctgttgagatgattatataatttttggtcttaattctatttatgtggtgaaccacatttattgatttgcatatgttgaaccagccttgcatcccagaaataaagcctacttgattgtggtatattgctttttgatgtgctgctgtatttgatttgccagtattttgttgatgacttttgtgttagtgttcatcagagatattggcctaaagttttcttttttccttgtggtctctgacagtttttggtgtcaggctgatgctggcttcacaaggaaggagctcctcttgctcagttttttggaatagtctcagtaggattggtaccagttctttgtacatctggtagaattcagctgcgaatctatccgatccagggctttttttttttttttttgagacggggtctggttctgtaacccaggttggagtgcagtggcgttatcttggcccactgcaatctctgccttttaggctcgagccaacctcccacctcagcctcctaagtagctaggactatgggcatgcgccaccacaccaggactttttttaattggtaggtttttattactggttcagtttgagaactcgttattggtctgttcatgtttttactgtcttcctagtacaatcttgggaggttgtgtgtttctaagaatttatcaattttctaatttgtgtgcaaagagatgtttttaatagtctctgaggttcttttgtatttctgtgggattggttttaatgtcacctttgtcatttctgattgcaagtagctgaattttattgaatagcaaggctgatgtgattatataggcatgttttaaaattctccgttaactgtgtttaatgaaatattacaatatgaagagttttaacatggaatagtaagacagaaaatatggatgaaagcatggaataatttccttggaactcatttctactctcctaatcaaaagtagactagtctaaaaaaagcacacaggggattttctttttttttacaagtacccatgactttgaatgaatctgtgtcttgaaccttggtagatgagaaatcatagtggtctatgctctaacaacatttttttggagattacatttcgagaaaatctcagtctccatgatttctcagagatgcctaatggctttagattcatggagcatatgctcaccactctactcccaccaagcaaaactaacttgaaaacagtactacagctaggaaacaaagacaatgccaggtctttgtgagaatgcactatttatgatcaaataataagtaggaatttacagtcagacttttaatttccaagatcatgcttatttctattgatatcgagtcgtattaatagtagaaattaatagataattatgaagcataggtttaacttaaaagtccatttattaaaaatccaaattgtctatacttgattcctcctcttgaaaacccattttaatcaggtttctttccccactgtgttttgccagaactgctttgggtaagatcaccagtcactccctgtagctatatgtctagttctcagtcttattattaattaacttggcttctggcaccacactctcctggtggtcctccttcttcactggctgcccctgtcatttcctttgatgattcttccttacctccttagattcttactgttatagggcctcagaccttggatttggacctcttttttttccatgcttattcctttggcaattttacccagtcacttagataagctagatagctgccaaatgaactctttgatgtacatgttccaagggggaaggacacatatcccattcttccccctagactttcatttttccatggtatttttcatcttatttgataggatttccatcctcctagttgcttaactgcttttctcaatctgtacatcttctcctcagaaaatcctagtggctctaccttctgaacataccgaaaataattattaactccaccactagcaccctaatcccaaagccaacatctcttttctgcatatttacagaagtcttctaacttatcatcctgcttttgccctccctgttcttccatttattttcaattagagcaggcagagtgatctagcagattatattactctgctcaaaactattcagaagcttttcatctcacctagagtacaagcccaggttcttacagtgatctcccattattttgttaatctcatgaactccagcttttccttgttcactccacttgagccactggctctttcccaagatagctgcatgattcgcttactcatcttattcatatctttctgaacctcagctttttcatctataagaaggggtttttagttggtatttttcttaactgggtttgtaagctttaacttttgaaacatttagccaactgcctggtattttaaattctttgctataacttttgtgcttcaatatcctcatctgtaagatgagagtaatgaatattacttacatatgtactgagaggattaaacaagttaatatatgtacagcactcagtacaatgaccagcacctagtaagcactatatacgtgttgtgtgttattatgaatgttatctagtttatatggcactttctttctagatctgagaaggttaattttgtgctgcatcacagctttttatacttagggcttatgtctgcttgcagcaagaatttacccacacaatctatattctttataagaagcctgtatgtcagtctgcttcttaactaactcattatcagtttggcaacatccttttgggccaaggttgcaaaggttgcaaatctgagtcagtgcttaggtctccctgaacagtatctctccctctagccttccagaatcctggagtgcctgctttgccacacaatatatgcacaagattatgattatagattaaggaatgatttacaaacaaaaaataaaaatcttatggatctaaggagcaatataattgaactttatttatggttattttttttccattctatttattagtttctctattgtcgaatcaaacgtccttaaaggagtaggagaaattcttattttttataccagtcactttcagtcttagtttcattacaagttctaatgtaggtgtatcattcaattaactactctgttatctctgaaagcctgcatgttagaaggcaatgttgtatgttcttgcagtttcatagtttctgaagagctaataaacaacaaaactacaatgaccaactaatttacacagttttgttattcttatatgtatatgactggaaaataaatactattttatataataagatgtcatcagaatataaaatataaatataaaatatattttatattcctaatataaaatataaatataaaatatattttatattcctaatctaaaatataaatacttccagtaattaagtaattccaagagatctcaacttaggagtcagtgaaaaaaagatctagaaggtttatatttctatcattacttaattatacttcagcaattttttttattacctccaggaaaataattgaatcatcgaagttctacagcttaagagatatgttacttttcttcattgtttcttgaactgactgattcttcattctaaatattgaacattctcagctattgaacttatattaaactttactctctacttttctgtcattaagtagaggagctgtttggtacattacttgtctttaagcctagaccagatatactctactactaatttttcttttattataaaatttatactatgagttactataaatagaggggttgtgggtattaaccacatgtaaaaaggttgtttactttctaaagtatggtttgtcagggggcagagtgctgtactagcagaacaggggctttgttgatcatgtgacattgagcaacttgtgttttctcagcctcagtttctttatacttaaaattagagtcagagttatgtgaattttaggcaacaatatatgttcctagtgcttagaaaatactagtccctgtctcattactcctttctgtttctttacatctcaccgagtagaatgggtaacaaatgaaatccaaagtagttatcatcattagctagagaaacccaaaatttaagccattctccagtattgataagaaatctttaagcactagagcagtgatctagctgctcattttgtattttgaaacatattaaagcataagctgcttctgccagttgtaaaaatataacatatcgaaatatattttcatttcttcacagttttcctttatatttaatgataaaatgagtatattaatccattcatgcactgctgtaaagaaataactgaggctaggtaatttataaggaaaagaggtttaattggctcatggttcagcgggctgtacaggaagcatggcagcatctgcttctggggagcctcagaaattttactcgtggcagtcaaagcaagtcaaagcaagagcgagcatcttacgtggcaggagcaggaccaagagagagagcggggaggtgccacacacttttaaacaaccagatctcaggataactcactatcatgaaaccagcaccaaggaggaaatctgcccctataatccaatcacctccaccaggccccacctccaacattggtgattataattgaacataatatttgggtggggacacagactcaaactatatcaatgagtaccttacattttattattttgataatttggatacaattcattaagctttattacttataaaatataagagtaaaatatgatatctttaatatacataaagaaacaacaacgattttattttaccaatcaagaatataaactgctgacataataaaaataaagtaaatgttaaaagtttgattaggtccaaaaatcagaaaatgttgccaaaacaattcactggaaatctctgtgaatagtctctttaatatttttgtatattagctgtgtaattttcttgtgctttttttctcctacacaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatcttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaagtcttttgtgagttttttgctctaatttttctcaattatattaaatttctttaatataatttaaataatatttcaactacctaggtagttgaaattttcccaactaaatgttgaaatactgtaccccagatcaaattatctaatgttttgttagtgaaacctaaactgatgattaaatcgttcatcaaacctagagataataaaaactattggtcttttgttaaaagcccataatgtagcatcatcagtagctcatttgtgctgaaatttatgacgacttactacaaaagagtacattccaaaaatgtcacatttgtctttctcaagtactatattatgccttaccaaattataacaaatgtccatgcttccctccataattcccacaggtctttaccatgtaaaaatccatgctaaagagtgctaaagagagaaagaagtggagaattaatcagtgatttttcaagttgtatgaaagcattgaccaagttatccattcagccctattcagtacttgttttcacagaaaacttaat

SEQ ID NO: 13016 - DNA, 49315 bp, Human
ttattcaaagacctgttaacattcttaaatatctgctagctgtaataaagaaatcaatgtactttatgttcttagctcccacaatttagcctaaatatttgccctggcatgcttatactggtccaagtgggcattaggtcatagcctgttcctcttccttatttagaggtgtttttcccttctcagcattccacaagttacttcctccttcctttgttctcctctgcctttgcctcttttaagaatttctaagttgctagccaatcaagacaaatacagaatgtgaagtcccgttctagccaatggaaaccagtcacaacagtaaggtggacgggtcaggttataaatgaccctgcctcctttgttcggtgtactcttgtggcaaaactgctggcgagtgtactctttccgcagaaagtaaaaatggccttgctaaagaaattaattttatgttcaagtgctatttctttacggcaccaagaaataagcatttctagcagtccttaaccgccataatgccctaaattagaccatgaccaattggactcaaatactttgaactatctttattgcctgaactttgaattgtttaattttgatcagttcagtttgtggagactcctgttaaggtgtgtacctcagtttattgctatactccttctcgtggccataatagtctccctgatgtgttgttgtcccctcgagagtcttcaatgtctctatgcagccatcctttgtacaccaaatggtgttattacagttagaataacaacatgaagaaagtataatcactcaactaatttgacattgtgacttccatactgagacaaaacaaggttctggtcaatctcgtaaaactgagaggctgacccaaaggaggaaactgttattaaattaaatctggcctaaagttgcctccctacctagcaaagcataatcaaacctaatatgtaaataaactgcaatgtaatttgagagtacgttcttctaacaagtggccaagtcttggccaatcaccgcagcggagcttttagcccattacaggctgcaaaaaatattgtctataaacgcggcttgcccactgttaggggctggagctctctgaacctttactggctcaggatactacatgattcatgctttctttgctcagataaactctgctaaacttgtttgaagtttttttgttaacaatatttaaacataaagcaaataaattaataagaatcctatatcactaagttacagtaattagaaagtattcacctgagtgagaagattggccaagctgctatccagtcttccattatttgacaagacatttctttcctatgctttctaatagtattcgttattccagaaaggttgctctatgaccttaaaccgtccacatgttcactgcactgatagacgtccaacgtcaagatgggtaactaaaggtcaactctctctttaccttccctgagcctgatttttgcattgtaactcatggtcactagacatttgttttgggtgttcgcagtctacatttatttcccttttaggggaaacaatcactgtccacgggattaaaataatcccgagttgattatttggtgacatcaaccaacggtgcacattttgggtccattaccaacacagccaagcagcacatatttcttcagagcctagatatgcacatgtcatcaaaggatagcattttacagagtcaacaccactcacttcatagaacaaggggccagtggcttttcagaagaagggtctgttctcggccccacaccagaacgccagccgccaggtcccgctgctcagcaggtctcaagcccgcgctcactcgggctccggctgctgacagctgcgagcccgcgcgtgtatacccgctcaacgctgggacgttacagccagggccaatgggcagagcgggactcgaggccccgcccccgccttgtggcgtcacggggacgccgggggcgcgcgggctgcagggccgcgtaggtccccgcccccagagtctggctttccgcggctgcccgcctcgcgcgtcttccctgcccgggtctcctcgctgtcgccgccgctgccacaccatggccttcgtcaccaggcagttcatgcgttccgtgtcctcctcgtccaccgcctcggcctcggccaagaagataatcgtcaagcacgtgacggtcatcggcggcgggctgatgggcgccggcattgcccaggtgagcggccctccctgcagcgtgcccacgcgcttggccgcccaccctgaggtggaagctctggcgcgaccggccgcgaggggcctgcacccgcccgacaccagggagttttcaccccgcgcctcccgggtgtagttgaaatatctcgcgtctgggcctgtgagggcccaagtctcactcccctcaaaattcagggttctgggccgatcctcagcttcctcgtttggaaaattctggctgcccccagggcccgctgaaggttccatggagagtggcggtgaatgcattttggaagcgggccgtgcaagagaagaaagaattgtatgtgcacaaggttcaggcataacgcgtttgttcctgctcggctcaaacgggagtttgctgccaaagacatgaactgcgatcagttttaattctatcagttatttttgatttttattctgtaattgtgcagtctttgtcaaagtagttttctctcctaaacggcctcccggctctccccggtctttccttcgcttgctaggttgtaaagaatagtagtagtcatgacttttgtagcactttgtaaagtcacctaatggaagattgctgaggtcctggttttgacctttgaaatagtgccgtctgtgcagagttctgagcttgcgattttggcgctgcagcggaataagtctctctctttttttttttttttttttttttgagtcggagtctctttgacccaggctggagtggagtgcaatggcgcgatctcggttcactgcaacctccgcctcccgggttcaagcgattctcctgcctcagcctcccgagtagctgggattacaggcgccccgcccggctaattttatatttttagtagagacagggtttcaccttgtgggtcaggctgatctcgaactcctgaccaaaggtgatccgcccgcctggcctcccgaagtgctgggattacaggcgttagccactgcacccagccggaacaagtcttttatccattgtacatcttcagggcttttccattgttctgctgagctgtggttcaggctcagttgtgcgagtgattgattacctggctactgtaatgcttgtactttttttttttaaaaattattccatttcagctcacattggagaaccatggttttcgtatcctagctgattatattcttagcatttcagtcctttgcaacttggtttgttggggaaggcggttatagtcatctaatttttcttggggacagtactactgtggctacagtcatgagagagtttactttttcaatgtcttgtttccaaccaagtccacgctttcatgcttgctttttaaaaacaaaaacaaaaaaaccttttactattaggtattatatatctcaattttcttctccttggcaagttttttacaacgtttttatttgattgcattttcttctaaaagctatatccctgtaatgttttatttatatgacttcttacagtctcccatttcctctgagaccataattttggacatacattgccctttttattgtgtggatcccctggctgctaggttatagtatccccataatctatgttgtatgtggactgggaggagtaactccctttaacctaaaagttccacaggttatactcaagagaaagtttagtttgagtacgtttgtattcccaggctccacccaaatctcccaaggctgtgagagtgagatttgttgtgagcaggaatagaacaatgtgttttttagaaacattttaacaacatcttagtaacaaaatattagggccttaagcagcctccaggaacattatgggaaatggatccagaaacttgtggctggtgtccttgaagacagcagtggaaaaagattagaaactaagtagaaagcgtcacttcaacttttgtagaaaatcagagtgcttagttctttgaatgctgcatccatcattggccaaaaatggatgttgtgttgcattaaaaggcagaggggcaatacctaaaattacaggtatggtgttggagctttcacctgacaaaggagtaaggagaaatgattgacattaatggagaacacaggcttgtgcttgtcaatcaaactcttaaataggtggaccagggagtgccttttgaaacttaagggaaaaaaaagctatttatgccataggctggacacataatggaactgtcattctgaaaggttataaagaccagaaatctataaagtggacgaccataagaaacagttccatccttatgtaacacagtttggaaaaacctcagttactttagttgacagctccaatcctctaaaacatttgtgagcaatgctttgcagtggtttagcttatctgcttttgcaccctaccctgtagcatgcagttctaggcagtattgcttcattctttatgctccttgaccaacagcttttggcatagggtaaatctgttttgcttattgagtgccagagacgaattagttgatgtgttttgagtacagatgggctacagttcaatataagaagttggatggtctgcatgctagctctgcctcatgcagtattaacatgggactttacctctgtgtctcggttttctcatctctaaagtagactaatgctagtactggcctcgtagggagagaattgaataaattcaatgaattcatgcatatgtcaagcagttacatatatcaagcatatgtcaagcacttacacagtgtctggcatgtaataagagttcacagaaagttagctgcctttataataattatcttcggcccggcatggtggctcaagcctgtaatcccagcactttgggaggctgaggggggcagatcatctgaggtcaggagttcaagaccagcctggccaatatggtgaaaccctgtctctactaaaaatacaaaaaaattagccagcatggtggcatgtgcctgtggtcccacctacttggaaggctgtggcagaatagtctcttgaacctgagaggtggaggttgcagtgagccgagatcgcaccactgcactgtagcctgggcaacagagcgagactccgtctcaaaaagataaataaaaagaataatcatcatcttcattgcagttgtcctgtccttttgcccttttcccctcatatccactcccatcctgatcacagctgctgaggtaggcctgtaaggtttagatggagaatattggtcatgattccctgtttcatcttgcttaatcttgaatgcatatacccgctgatgctgcagcgggtatgttttttcagggacctctgaaaggagggagaacactttttagttaccccccattttattgttaaactttagtaaagccataaaagtacaatcacaaactagtattgaggttatgttactgattttcattagcttaattttcttgaactttctgacgtggttttaatgttagtcaaggtgcagttctgcttataattttaatagttttgtcattttaaacacgtcagtttgtgctcagaaggatgaaaaaatatttaaatagattttgtgggagcctgatgcatttctcaagcaattaagcaatttaagacaagttcagtgcttaattacatttgatcagagcacaggccatttgtacatgtgtattttccgagagtatctactttgcctgtcatttcttttgtttgttttaaattaaaaaaacaaaaaatcccttagactgcaggttaatatttgaagttaacttgtttcatgtgtttgcttattacacacttctgacttggttttgattgctaatttatcttcactggatacttaggccaataaagaagcttataggattaaatgagccttgagtgggggacaggttgtttttttgctttataaagaggaaaacaagaaaggaagaaagctggtagctgtgtgcatttctccagtattgaatcctttctaggctttgcttcatacattgggttttttcatatgaggagcccagagagaatgcatagctttcattagattacttgtgaggagccagtgggctccctgggaacggggcacttcagatgtcccccttgagacactttacatgctctccgggtgcaaccttctttttagtgcactactcttctttgaggaagtgagaaagtttgcatcttaaagggggttggggataggttcttctctcccaaagcttgctttttttttttcctcctttttaaaaagcagaaagtgcatattttttctagagagagcttctttggctattaaaaacaaagtaagggcagggagagcctgctacgttgcagggattttgtgtgactctaccatgcttgataaggattcaggtagacctgaaagcttctccccagccactggatttgttctctcatctcttcttcttgcccccaaatctgcattttctgatgctgaaaaagagaatgatcagagttgtttcatatttttttagctttattctcttctactgtgagtacagctctgttgagctgtacagtacagtactgctttgcttgcaaagcagtacagatgcctaggagaagtttcaggatcacaggagaccagcagttacctggctgtaagctctccttttgactgttccttatggagggaatatttgtactcccagttgttaccttcctgctgaaggacatgagatgtgtctgtttgttatgaagttttccccctacttcccgagttgttgcttatctttgttgggctgttctctgctcttggttgaggtactgggatgtagaaccaccctctattagcatattagttattggactctgggtgaggttggagatactgtcattcctagagggtagaagaggtagggctcacaggcaacagaaaataatgctatgggatatgtttggacattttttagagcagaaatggcacttcagtcagtcaggttttggcattttcctgccatgttctgcctccagctttaatcacttgccccttgcttgagtttcttctttcttcccctctcccttctctcttatctgtggtaggcacacacacctcactctctagttctcctgggaccacaggaagataatgtggatgttctctgtggctccccctgttatattcatgatgttattatttctggtagtggtattctaatctcaaaagtacaggctatgaggtccctgccagggtttagatgctagccttcctatcctgcctttaggaaccttgggcaaatcacttaactcctctctgcctctttacttacctgggaataatgagactcacctgacagctgtgaaagttaaatgaactaatatacaagctcctagaatagcattagtgtgtttgatagtaactgtctgataaatattagctgctttcacatagacccatcagacctgatctagtgaggatttctcttagattgtcttcactgtcggaagagttttgatatagggagttccagcaattctaaagatgttaagacttatttatgtgggttgttgagaaagatagtgtaccatttactggtttttgtagagctaaaaccactctacaaaatatgacactttattctgttcaaagaattttgatttatttaatttcatgtgaccattacaataatcacccctgcagagatggttcctggggtcaatggtcagaggcagagctggggttagaacttgagttctcttctgttctgctgcctgtaaatccccaagcctgaattcagttctgcctgcacctctggcaagtgctgtattgtggggagaagtgtggcatccatggcaggggatcctctgtggctctctggaatcagtacatcccaggttgacgtctccttggctctggactcaaagttagtctacctgctggtcgtctacatcagggtgctgtgctgccatccttctgcccatggtagactcaaactcacctgccaagatctaattcattatttcccctccagctttttccagagagcttgcccctcctgttgctgcagttgttcttccagccacatgtactctgaagatgggatcacaatcagtgtctccataccagaaaaggctctgtaactttttggtcatgggagagctctttcctctgccctctcctttgcagttcctagaccaggtgtgttaacctgaattgtcatgggagcctcttaattggtcctttcagcaaaaactaaaagaaaaaacccactcatcatggcaaacattgtcatattagtcttcctggagaggcatttggatttataactctcctctacccggaaagtgtccatcatagcaacatcttccagggattcttaaatataacgatgctgttgacatgtctggttatccctttaccttttcagaatttgtgggaggtgagaagtctgggagaggttatctgggttattatgaaacctacacacttactgaattaaaaaaaaactatgtaacacaattctagtctaaaaatgggcgcacactttctttgccttttagaaatactttttgaaatgtaaaattcgaagtctaataaaggagtctgtccaattaatttaactgtttgaagaaaaaaaccagtccaggcatggtggcttacgcctgtaatcccatcactttgggaggctgaggcgagcagatcacttgaagtcaggagttcgagactagcctggccaacaaagttaaaccctgtctctactaaaaatacaaaaattagctgagcatggtgacacatgcctgcagtcccagctattcaggagactgaggtggaagaattgcttgaacccaggaggcggaggatgcagtgagccaagatcacaccactacactgcagcctggccaacagagcaagactccttctcaaaaaaaaaaaaaaaaagaacaaaccagctggttgtggtggtggtggttgacatcctcaacagaacagcttttgctaattgttgaagtcagggaagacaacttgtgctgatggcagagttcaagacattacacaaccagagacaatcataaacccagaaatgccagccctgagagatgcaactgatgtatgacttttttcctctctggatcaaaccatgacaaccgtaaaaggcaggccttgctgttaaggcgctgcagcctctgaagcacagttggcctcagggagctctgactcagtctacttattctggggatctggagaaagtcagaaatcatgtgtggtagatagtttgcataactttgggattttccagagagaggatgaaaacggtggccctccttgtaatgtctaggcacatgggacatccagtggaactgttgagggaggagatgggagggagaccagtcaccagaccagttgatgtaggtctcatagactcaccactcaagttgtgcttcggagaaagctgcttcaaatcttcttgatacatttacaaagataaataaatccagtgtgcttctgcttggcatgtttacttggtcctgtggtcagagtgctctggggctttgacaaatgtgctagtcacttagcctatttttacaactctgaagcagccgtgtctaaaaatatttcctctctggctgagcctgccttccaccaggcctagaaaagtcatggagctgaggacatagccttcaaatatttttttttccattgcagactgcttgtcctcaaggtcttaccagcatgtaggtcactgtaatataaaacatgagttctcaatggattgatttaaattgtggtcactcaaactgccaggaagagtcctcctcatttgttgtaaaaataacagatgtctatgaaaggagaaaaagaaggcctttctttttttgcagttcatttctccactgccttctccatcccagaaagttggcggtaacttgggtgttactgaattactcaggagaatgaattgtacttgtttctctgtagttattttctaaataagaggttacgttatcaggagaggccatcagctacagcagtggaaagagccaccaggtctcatcttgactttaccaacaaatgtctttattcagtcaacattccctgagggccagccacagccaggcagggtctaggttctcagtgtacaaagatgaatgacatttggtcaggagcctacagtagaggagttcagattactataacacagtttggtaggtgctgtggtacacagatgcagggatgttacagggcatatgggggacatctagcttagggctgagaggatcttggggagtaggcttactaactggaaatgattgttttgttttgttttgagacagagtctctctctatcacccaggctagagtgcagaggcgtgatcttggctcactgcagtgtccacctcccaggttcaagcaattcttctgcctcagcctcctgaggagctggcattgcaggcgtgcaccaccatgcctggctaatttttgtatttttagtagagacagggtttcaccatgttggtcaggctggtctctaactcccgacctcatgatctgcccgccttagcctcccaaagtcctgggattacaagtgtgagccaccgtgcccggctgatttttaggcttagttaataggtgaagttggggagaaggtgaggccaagagaagggctggagttgagaggcagatgtagggagctactggccttgtggtggtggtaagactgtcatgcatgaggcaatagttgtgttctttttgtttttttgtttttttttcttagtaatagccatcctaatgggtatgagatcagaggtttttaacattatactgtgatggacattagagatttcatgaatctccttcatggttcccgaaaggttggtaaagattccttctctgacctttgttgtacatattggtcttcaatatgcattcttatggaaaaaggtgttcatggctaaaacatttgagagccaccacactgaatgatctctgggttgtcttcctcctctcaaaattgatgatcctgattatctgtagctaataagcctgaacaataaatgctttcgccaatctcttaaagtagttgagaagctaggtgtgttagtttcccttctgtgatagagaagaaacctgtgttggagagcagtgagcttatgtgtctgtggccatctctgacctgattcacacatgtgcccctcacagacaggcacagacacagggttggcatgcctctagccttacagcctcttggatgaaaggtataagacacattcacatgttggagtgaattaagcacacatccattttgaaatcacagggctggataccacttaaagaatattgatcttgcattgggcaacgcatagcaactgccctacatttccccttttacctagcgtcacaaccaccagtactagaaagcagttaatctgctcaccaaaataacagagagagactttagtggcattttttccacttggtaattgactagactctggctattagctccttttttttccttactatccttttcaaactaataacgtgacttctcataattttaaagtaacttgatgcttacacaaagtttatcataaaggtttctagcaacaaaaccagtcatgacttcttgagaacttatttctaaaataatttacaaattgagacttatgaaaaaatagctctgtcattcaagtgttcatttcatgagtatgaaatatctcccttgtgctagacatcaggccaggtaaaaagtaagatgtgattgctgctcttgagaaacctactgtctagtggaagaaatacaggtatgaacaactaattgtaatgaaggcacagacagcctacctgtcatatctgggatttgatctgaaacagatgaaagttataatagtttacataccttaccttaaagtatggtttttaaatacttaagatgtgatatgacatatagtgtgtatatatatcttatgctaaggaaaaagggacattaaaaaagcttatgttaaaagatatatgtatacattgtactgcctgtatgtttgtgaaatttgtatttactggaaattctcattggcctgtagataggagtgttcctaagcaccctatattgggatttgtggtaacagcagcttgacaacctgaagtggatgatgcaacagcacttttgaaaggtctctccgtactatcttgatttcatcatctaaagttggtgttggcaaagagaagataagtgtttagggtgttggatatcccagttaccctgatttgatcattacacattttaggcaggtatcaaaatgtcacatgtaccccaaaagtatgtacagctattacatatcagttttttaaagaagaaaaggttggtatggttagcttttctatttcaagtgtatcattcatctttcacatctgggatttctcctatgctctggttggttaataacttttattctgaaatcggtgagattcttatgacatgaaatagtctataaccagttaagtttttatttctctgttctgttcacatcctggggactgggctgccattacataactgagcagccattggtggttcacaccagcgccacacccaattattttctttcagtatttgaattcctgcacaaaagatctgctgtatctgcaaatcactagaggcacaaaagaagtgattacctctactaagggttgggagaagtttcactaaaggagagatggtgtccatgttagattatgaagggtaagttgaagtccatgaagcagcaatgagggagccggacatgtatggcagaggaaaccacatgaacaagggcacagagccatgagatagcacagaggagggagacgtgtggtgtggctggggaagactacagaatcgggttactaccgtccaaagcatttgttatttagcagttattgaccagctatcatattcaaggcatgtgataagtactaagggctacaaagaccaaatcaatttctgccattaagggattttaaatctaagagcagagattagacagagatctaaatgacacagtttactttggtgtaaagtagtacaataagagcagtaaaaatctagttctgaggtttcaaaatagaaagtacattcatttggaaaaaggcttcatggagagggtagcatttgaaatgggcctgaataatggatagaacatttctggacagcagttaatggttgggattaaggaaaaagtgttgtccagaaaatggtgacctacagaatagtggtaccagtaatgaaggccaaggagaattgattttagggtcaaggtgataactgcagcttagatagattattttggtttcaggcacagttggaagtatgagaacgattggaatttcagaaggaaattatattggaaacagaaccttgaaggaagtccttgtttataggcttagaagatcaagagaggtcaattaatatggctaaaaggaacagacagataagaaactgaagagtttcaaaaatgaaacttttattggcaatgtacagagctgttgtagaagatgaagccaaagaacaggcattgactttagcaatttagtagaccattgataagttacagtagtccccccttacgaggggagggagtacattcctagaccctcagtggatgcgtgaaactgcagatagtaccaaatcctatatatactatgtctttttgatctgataacccagtcaactaccaagtgactaatggattgggtagtatacagtgtggatatgctggaccaagggatgagtctcctcccagacaggacaatacaagattgcatcacactactcagaatgacatgcaatttaaaacatgcatcatttatttctataatttcccatttaatatttttggaccatagttgactgttggtaactgaaactacagaaagtaaaaccacagataaaggggggaccaactgtatctaatttcatgcagcagtggtggtggaagaagctactctgataggaatgtttgtgttccctccaaaatttatgtcgaagctgaatccccagtgcagcagtattaagagataaggcctttaggaggtgattaggtcatgagggttctgtattcatgaacagcttagtgccatttaaaggggcttgagagaccaactttgcctcttctcccttctgccatatgaggacacagtgctcgtcccctccagagcaggggtccccaacttctggtccgtggcccattaggaaccgggccacatagaaggatgtgagcagctagcaagacttcatttgtatttacagctgctccccatcacttgcattgctacctgagctctgcctcctgttggatcaagagttgcattagattctcataggagcatgaatcctattgtgaactgtgcatgtgagggatctaggtttcgtgtccttgtgagaatctaatgcctgatgatctgtcactgtctcccattatccccacatggcaccatctagatgcagcagaacaagctcagagctcccactaattctgtattgtggtgagatgtataattatttcattatatattacaatgtaataataatagaaataaagtgcacaataaatgtaatgcacttgaatcatccctaaaccatcccctcttccctgcaagacggtagaaaaattgtcttccgtgaaattgtctcccatgtcttcctggtgccaaaaaaggttggggacctttgctccagagcatgcagcagcaaggcaccatcttggaagcagagaacagccctcaccagacactgaacatgctgatgatcttgatctctgttgtttatacattacccagtctttggtattttgttatagcagcactaacagactgaaataagccatattactagagtttaggaatttaatggctcaggagaaagtagaagcaccaagtgtagtgaataaaatagcagctaacaagctttgtgcaccttcacatgcctggcactggtctaagcatgttaaacacattaacttctttaatcctcacaacagttttatgaggtgggtacctttgttactaacctttatgacagatcaggaaaccaagacatagaggcttcatagctcacccaaagtcacacagtgagtgagtggctaaatcagtgtcttagtcttttttttttttttttttttgctgctattaacagaatacctgagactgggtaatttataaagaacagaaatttattttctcatagttctggaggctgggaagtccaagatcaaggtaccagctttggtgtctggtgcagacctactcgttgtgtcttgctgggggaagaaggctgtctgcacatggcagaaggtggaagaaagctagacgaactttctccgtcaagtccttttataaaaacctttaatcccattcatgagggaggagccctcatggcctaatctcctcttaaaggccgcacctctcaatactatcatattggcagtgcctgacttttgaagaggacacattcaaatcatagccaggttttaaacccaggaactccaactataggcttgtttctccacatatcaccatgccaccaagtaatttaaagactttggtggtaaagcaaaggccagcctcaggtgattaaggaggatccttttcttcctccctttttatatggagcaggatcccagcccgtttgtaaaaaaatagaaggacacagaagggaaaacttgaaaatgaaaactgaaaaacaagtcatgaaatcagaagatgtgagatcaaaagcaaaataaaatagtttaccttagaaggctgtgcctggatccaacaataggcctcagacccttgcagaaagaagaagggggcagcccagaattaaaaaaaaaaaacaaaaaaaaaccccgcaagctattgtgatgtgccaggcaccactgcaggtttttgacttgtattaacccatttaaccctcccaacaaccctgttgcccctgttttatagatgaggagacagcctgctgaggttaaggaatgttttccatccccaacttggcacacaggctctggagtctggcccttgcctgtctcagtactgtttcaggctgttgccctcagaccccgccatgccttccagggtcaagaaaggcatgtgagcaggcagcttgagctccctgtcacgtgtagacagtgagaataatgtgccttccccaaaggcagttatgaagatcagaggagataatttatgaaaagtgcaagctctcttgagagtaggggattttgtttgttcaccttacaaggcaggtgttgagtcaataggctgcagtcagtgaaggaatgaatgcagtggcatgcgcagcgtggtggtctaagtggtagttttggtccatccctaggggagcacaagtcttgggcagaggatcaaaagcacacacctctgagaagccaagtgtttttgtctgtaacctttgatcattcaaaaggaagcattttctaacctctgcatttttttacccaaactgtacaaaggcttccttgctgtccaagttgtggtatactccagtgcagctgcctggcttccaagagaaacttagcacttcttgttctgtttgtagcctcaaatcaacatgtaaccaaaagctgtgaatgaataatccaaacttgaagaaccccagattttattcaggaggagtaactggaagccataaccatgaacttccatatctgtcataggaaagaggttggcctcagcagcaatgagggataattctttcaagaaaggaatgaagagagaagttagatggaaaagagatttttaaggtcaaaagaagcagctgaagaacatgtgtaggacagccttaggagttactacacttcaagacctgggtgtctgctggaggaaggaacatgaccctgcggagatgttaagggttgggagagctgagcttggaggctggaagcccagctgggaggctattgttaaagaggtaagatgaccctaaactagtattcaggatgttatgtggtactaaaaggaatgttaaacgaagtgataatactgtattcagtttaaatgtttatttgatactgtaactcaccatatataccttctttttttctttctttctttattttctgtattggaaactcctaatcaagataccttctttcttaatatttgatcttatggttaccaaaaagattaaatcaagccattgtttttcaaactagggtctttggggatctaaaacttacattaaacaatcttaaaatttgcctttttttggatgatcctacaattaatacaagtgtattctggatgatttgaatgtttcatcactaacgagatctgagatatccatccccttatgtgcatttgtgttcatattattatttgtgccaagtgaagccacagtgtctcctccaaggacattttgccgtaagttgaagaaagaaaaatggtgggagaatggagcaattacaggcacttgataatgttggtgttaggacttcgaatgctaaagaatggggcctcacaatggtcagtacagtatttatgttgtaaatgtgtgtgttgcccggattcattctttggaagaataattagttataggcataatggtaactgtgaatgaattttcctcttccaaatatcaaatacagtcatatgctcatttaatccagattttaatatcataattatcttgtttcaaaagaacaaactgcataactaaagtgatgcttcattaaaattgacatttgaccttggagaactgattaaataaaattaaatgagataggataggcctggtgtctggcatttggaacgcactctgtatgggagctgttattagggctggcaaacctcaatgggctctggtttcagttggttgtggagtctttcacggaatttcttctctaggagattcaagattttctcccagcattgtagcctgtggagaagaaaggaggatcaaagctcaaaggtggtggttagtcagccaggagcaggcaggtgaccatcaaggaatctgtacaggggatggtagatgcaagtgtggccagaggtcaaggctagaaaagtgctattgcagagaaaggggctagaacaaacatagtcaaggaagcaagtgcagggcctgaccttcaagaaaggaattaagcaagctttatgtaggactgatggagcaagaccctgatgtgaagagtcccaggcaggaggcctggtggggcttgacctttccttagggagtgtgtgggggaggagtcttcccaaaagtgtcttcagcatagcgtctggaactttcagagagcaacaggaagactttggaactcaattggtttagagcttctcagtggtttgaggagatagatggcaacctaggagtggctggtgtagacagggatagggatcagagccgacaggttattttagggcagtgctcagtatctgggggtgtttttaaaaatagcaatgactaggcaccaccccagactagaggaattagaatatctgtaggtggggcctggggtttgggctttttaaatattcccagttgtttctaatctgtgccagatcagagcacagatcttagagcagtggttctgaaaccttggtgagcatcagagtcacttggaaggcttgctaaaccatagctcactgagccctacccagagtttgattcattgggtctggagtggagtctgagaatttgtatttctaacaagtccccaggtgattgttgctgctggtccatgacccacactttgagaacccttgtcctagaaccacaaaagggttagggtgttctgtgttgcttttgagtctgtaatgctgacatggaaactgtcatttgtctggataggtgcacttgtttatcaggtaatttttgctattactgtgactttaatttgattgaagctgaaggattcttgttgagggtggtatgtgttagtttcacttactagccctggggccttagacacattatttaacctctctaagcctcagttttcctcatctataaaatggattagggttgttggattaatcagaaatagtcttggaaaacgcagattatgaacccggcacatagtagatgctcagtatgtggcacctcttatttttgctgcatttggcttttttctttttaaaggcttaagtttttgtttgtttgtttgtttgtttgtttttgagacagagtctcgctctgtccctcaggctggagtgcagtggtgcgatctcggctcactgcaagctccgcctcccacattcacaccattctcctgcctcagcctcccgagtagctgggactacaggcgcccgccaccacgcccggctaattttttgtattttttaatagagatggggtttcaccgtgttagccaggatggtcttgatctcctgatcttgtgatccgcctgcctcggcctcccaaagtactgggattacaggcatgagccactgtgcctggcaaggcttaagttctttctgagggtaggtagagattgacttctgttggctctctcagcccttggagatctcatagaagaaataagacaagtgtactaataattcagaaataaacaatgtggccttcaggtggcctatggctgctcacccatgcttaagagtaccatagcctgtcgaaccagtctggggataaaagttgtgcagtttttaatggtccaaatgagagaaaggaatagcctgcctaatatcttgagtccatctctgttatggcccatttagactaacgcaccagtaggagatgaacaccaactccatgtggatagattaatcaaagaacattggacctataatcctgtggatatcttattaagcatctaatatgtaccaggcatcaggttatatgtttttcatgcattgattgctcactgtgggtcatgggttgggcactggggtttgtaaagatgattaagacttgaagctgcccttagaagttgctaaccttgtgtctctagggtatgactgtaagaaatgatggcaaggaaccttgcacttttagattgggttgatctctgcacatgggtaaaatgaaaatgctactataatttgaaatcacttgaagttatgctatagtggtagtttattgcaacacaataaattgtgacctgcatcactgacttgaatcattggctagatgggccttggtccgttgccacttaggggaaaaccttggtttggattgatgagggttttgcttttgggacgttgttttactttgctgcctgcccgcagcctgtggaatgtttctgctgatgggctggtttcctgcttgcctctgtccttgtatcaagataattcattgcacgttgccccggttgcccagtcctggttgtcagactttttggtcctgggagcgttttcatgccttggttcccagacggtgctgatgcagcctgcaggtccacaggctcagacatgagcccactgtgtgctgctttctcagggagccatgagtgcagttgaaataaccttgcacttaaaacctgtcttaccattttgaaaactgttctttggaaatcttgccttgggatttgaacgtctttgcctttaggttttgctcttttgtttctgtttcttttactcattggttttctgcttttgagttttggttgccttgcttcaaaaatcttatatcacgaccatggtttgggactatttctgtcatctccttgttcttctctgggcaagttcattccagataacttgcccctctcctgcacactgttggtgtcatcgaggttccaaagcaatggttttgcagggggcttctcagatcctgagggatatctcagttctgctgtcctcttgcatcatttatgattatattaggtcatgcctgtcctcttgcttctggcctgaactaattcacttacacgtgcctataaggtgatcgaggtgacccaatgatcttcttttagccacaatacctattgcatgatccttgctgaagctattgccagacagtgatgaaatagggattgatttgtcactcactgtgactaagctaagctggctgtgtgtgagcttgggcagtttcactaaacattccccttaccctaggattcctccctcagccagggtggcatggtgaaggcagggaattgcccatcctaaattagctgatcccaaagacttcattttcttgggagtcttgtcaccaaatagcccttggggacaggagtctttttgccaccattattagagtttaaattcttacctattactgatttaagggctgtagaagagagaagggccaagaggccaagctgtacaaggggctccagctccaaggagaaaaggatggtggctggggagtgggtgctctgggaacagcctgctgagcactttgaaatatggctagtgccactgaggaactgaatatttaattttacttaattccaattaatttaaatagccacatgtagctagtggcccctgaatggaacagtgcagtgttaaaatcagtacagagaagtatttagagcttggccttcggggctttgattcagattccggctctgctgtctacccattgagtgaccatagggacacttcttaaccttctacagttgtttcaagaatttgttgtattcaatataaagggtttagaacagtgcctggcaagaagtgtgtgtttagttaatgttgacttatcatatgttcactcggtattttgaatggaatggtagtagaattcatgtggaatatgaaatgccactgttttttggggtggggtgtgtgcgcgtgcgtgttatgttttctttcttttaaaaagaaattgttcttttgttgctctaggttgctgcagcaactggtcacacagtagtgttggtagaccagacagaggacatcctggcaaaatccaaaaagggaattgaggaaagccttaggaaagtggcaaagaagaagtttgcagaaaaccctaaggtaatttcttattatcgatgtcttcaagacaagtcctctgactgctttacatttgcagggcaatgggggatttctggctttctttctttcttttttttttttttttttcagtttgttagtgtaaaactcatttttccataactttaaaccaatataataacataattactaaacattcagggggtactgattacaaaacaggagaagtaaataaccattttgttgggtgggatttgaggttgagaagaaagcttgtacatacaggtggtgaactcattctagaagaacatgagaatttggaattgaagaacacttgttttgctaaaaggatggaagaagaagaaacaggaagataatttttatactacaagttaagaagagaatgatataataaatatggtatttatagaaactaagagtgaatcattctacttgccaggagcagaagagatagaagaatttgaggaactctgtggaggctgggaatacaacagcatggtgggatgagaaggagttggtgactaagggccatgctgttttttcagcgcactttcacttaggagtttgcatttaattagaaatacagcacaaatcagccaaacaaattttaatttaccttttgtcatcttgttaaagttgcttaagattgatttccttggggcttggatagaatttctcgctgtatgcagccagagaaaagtacacataaggcatttgttgtttctcacttcaagtatccaaggtggtatatctagatgcttttaaaaatttttttattatggtagaatatataacataaaatttgccattttaaactatacaattcagtagcattaattacactcgcacattcatacttcatgtaagtggaatcatacaatatttgtcctgtgtctagcttatttcacttagcataaagttttcaaggttcatctatgttgtaacatgtgtcacaacttcattctttttttttttttttttttctgagacagagtctcactctgtcaccaggctggagtgcagtggcacaatctcagctcaccgcaacctccacctcctgggttcaagcagttctccttcagcctcccaagtagctgggattacaggcgcacgccaccacgtccagctaatttttgtagttttagtagagatggggtttcaccatgttggccaggatggtttcaatctcttgaccttgttatccacccacctcggtctcccaaagtgctgggattacaggcgtgagccaccactcccggccaacttcattcctttttatggcttaatattccactggattattatcatattccaatttaatattccattggatttataccacttttttttaacccattgtattagtctgttctcatgacattgctaatgaagacatgcctgagactgggtaatttataaaggaaagaggtttaattgactcatagctccacatggctgggaaggccttacaatcatggtagaaggcgaaggaagaacaaagtcatgtcttacatggcagcaggcaagagggagagcatgtgcaggggaactgtcctttataaattaccccccactgggcccctcccacaacacgtggggattattacaattcagggtgagatctgggtggggacacagagccaaaccatatcactcattcatctgttaatggaattgggttgttttcaccttttggctattttgaataatgctgcagtgaacattggtatgctattggtttggagtctctgttttcaattctttgggttatatacctacaagtagaattgctgggttgtatggtaatcctatatttagctttctgaggaaccaccaaattgttttctgtagtgactgcactattttacattcccaccagcaatgtacgaaggttccaatttccccacatcctggccaacacttgctattttccatgtttgttttgttttgtttcttattgtagccatcttaggtgtgaagtagtatctcattgtggtgtttttgttttttgtttttttgttttggaaatgaggtcttgctctgctacccaggctggagagcagtggcatgatcatagttcactatagccttgaactcctaggctcaagccattctctcacctcagcctcccgagtagctaggactatagatgtgagccaccacacccagctaattaaaaaaaaaatttttttttagagacagagttgtactgtgttgcccaggctgctctcaagctcctggcctcaagtgatcctcccaccttggccactcaaagtgctgggattacaagcataagccaccgagtcctgctatcattgtggttttgatatgcattttttccccaatgtctaggtggcctttagatgatggtggagataattttaccttctctaggatgaaattcaaataataaatatcacaggcagattaatgttagaaatgcttgttctttggtgctgtaaagaaatagcacttgaaataaatttaatttcctcagcaagaccatttttactttctgcagaaagggtacactcgccaggatttttgccacaagagtacaccgaacaaaggagacagggtcatttataacctgacacgtccatcttactgctgtgtccggtttctattggctgggacgggacttcacattcaaatgtatttgtcttgattggctagcaacttagaactttttgaaagaggcaaaggcagatgagaacaaaggaaggaggaagtaacttgtggaatgctgagaaaggtaaaaacacctctaaataaggaagaggaacaggctatgacctaatgcccacttggaccagtataagcatgccagggcaaatatttaggctaaattgtgggagctaagaacataaagtacattgatttctttattacagctagcagatattgaagaatgttaacaggtcttagaataaattttgcttctaagaaaagttactatttattcttaattagatggggaggagagtctctttgaagaggaacttctactttactttttacattaagatattcttcacctgtcccttatattcttttttgttgagacggaggagtcttgctctgtagccaaggctggagtgcagttgcgcgatgtcggctcactgcaagctccacctcccgggttcacgccattctcctgcctcagccttttgcgtagctgggactgcaggcgcccgctaccacgcccagcaaatttttgtatttttagtggagacggggtttcaccatgttatcccggatggtctcgatctcctaacctcgtgatccgcctgcctcggcctcccgaagtgctgggattacaggtgtgagccactgcgcccggaccatctgtcccttatattcttaattgtagtgggaccccatgcaggggatgttatgaggagggtccagacagatgagattataagagccctgggctgagggttggagtctaggacagagtgagtttgacccagatagcctgcattttctgcttgtttacagactttcagctaattgtctccttgggctgagtttctgagccacaccctaaagataaaaggatggcccctatgctcaagttgctcagctctggctagctactcctcagaagtctatactcctgaggtttctctcctctgccagggacaccactgaggagggaggtgtcagtttctctgcctagttgacatactatgcttatctagctctatactgaccaccaatataatagctactcacaagtggctactgagtgcttgaaatgtggctagtctagatagaaatgtgctctgagtgtaaaatagacactagattttaaagctataataggggaaaaatatataaaacatctcaatatctttaaatattgagtacctgttaaagtgatggcatcttagatatattgggttaaataacattaatttcacctgcgaatgtcttttccctttttttaatgtggctagtagaatatttctgtataacagctgagatctagctgcttattccatgatgattttggatgcctttgctgattatgactattttgatgccctgtggacaaattacactatgaaataaaatggcggcttatagaggcaccatctccaattctgtccttattgaggtctgtggaaacctggagtcacaggagaaaaatgaggaaacgatgaaaactacaggctctttggcagcagaggctgtgtctagcttgtttcggaaacaacagtttcaggcatatgacagacaataattatttgataaatgctaagtcggctttcttaccctggctcttgcccttgctctaataggagctagtctctgcttttattagagaggaatagtcagcaccacctcaagactaatggatggcagggagctatggaaggataaattacaggcttcgtggacactttgagaacagatagggtaggccaatacaggtgctctgaacacccagtttgctaactggagcagagctaagaacttgaaagataatttccagtgagcccggtgaatgttctcttcttcctcccactgcattaggccggcgatgaatttgtggagaagaccctgagcaccatagcgaccagcacggatgcagcctccgttgtccacagcacagacttggtggtggaagccatcgtggagaatctgaaggtgaaaaacgagctcttcaaaaggctggacaagtttgctgctgagtatgtaacctctggacaatcttctctttttttttttttaaccttatttttgtttttcatttttattttttgtttttatagatttgtgagtacaagtgcagttttgttccatgcctatattgtgtaatggtgaagtctgggcttttagtatacccatcacccacatagtgaacactgtacccaataggtaatttttcaaccctcgccaccctcccaccttttgaagtctccagtgtctgttatttccctctgtacatccatgggtacctgttatttagctatcacttatatgtgagaacatatggtatttgactgagttgtttcacttaagataatggccttcactcctgttcatgttgcttcaaaagacatgattttattcttttttatagctgagtagtattccatggtgtatatatgccacattttctttaatcagccattgatggacacttaggttgatttcgtgtctttgctattgtgaatagtgctgcaataaacatatgagtgcaggtatctttttgatagaatgagtttttttcctttgaatatatacccaatagtggggctgctggatcgcatggtagttctgtttttagttttttgagaaatctccatactgttttccttaaaggttgtactaatttacattgccaccaccagcatgcaggggttccctttctccagattctcaccaacatctgttggttttgactttttaataaaagccattctgactggtatcaggtgctaaactcattgtggttttaatttccatttctctgttgattagtgatgctgagcattttctcatatgtttattgaccactagtgtgtctttttttgaaaaatatctgttcatgacccctggacattcttgacagattctgaggggtccctccctgggccttgaactttcctccttgtttattgctttctcccaggaagggatcctttgaccaagtttatccacctccctctctcctaccccacagctatttcaagaaaagccaatatggtttccgttgttctccatcttcccactcccagtttgcttctgaagcttgggctgctgtgatctgatccttgtcccagatgcgtgtagaattacccatggtaacatggaggggtccatccagggacaggcctatgtttcttgaagtgtgtaggtcatggatactcctatgccagaagctgctctgacgttccttggttcatttcacaccggcatctagaggctgcagagacatctgacagcagacagttaaggacatgtagggtacttctgtgctccactctcgggcataggagtaccctacgtgtccttaactgtctgccaaggaccctcagagcagttctgtgtttcctccttttttggatggagcaaacagaatggtgtaattgaagggaatgcctatagacagagaggactttcctgttttgagcttcatctgggttcaatcgaagtactcttgggagtgttaaaggagcattgacttcttagctggctggcttcctggtggaattcttcctggcagaatgtaccttgggatccagagccttcgagtgtgtgacacctgacccactgatcagtgctcttctagtgacttgtttgactatattttcatgcttcttggttggaattgaatggcagaataagattatatgacaaaagcaattctcagggcacttccggtgggcagtggctaaagagagacacttgcataccagcttgtcggaatgttaaccttcagagatgggtggccttgtggccagagaggccctgcccctgacaaagagaagagacttgcctttctgtcatctgtccatcactgccaatcagtgtcctcgtgcatttcacactggcatctagaggctacagagacatctgacaaaaacagaatatacttgtggtaccgggactggctcccaggccagcagggagccctctgggataataaacagccaccccaaaaaagggagttttgtcaagcagtttgatctttattgaaaagattggtcgctcttggtgacagtgaaaggcctgactgccctccattgtccatgtctggtacagaagaaggatcactggagaaagtcaggaggcctgggcctggtgctgaccccctcaccacctccagccttggaaaggtcctcagtttcgtcatctgtaatgcaagttgaggtgattggggtaaataatttcctagacctttctggctctaactctctaagactagcttcccccatttgtaaaataggagcagcagcactggtacctattgtacagagttgtttaggaaactcatttcatttagctcacatttcctgagtgcctgctgtgtatcaggcactacactaggctctttaacctgaattgatgcaaaacagatatgaggtgtgaaaagaaggcatgacccatagtcataccaaagatgtgactttgctgctgaccttctccacctttcttggcactgtttgtttttgttttagatcaccaccattattgaatgcttgctacaatttttaagcagccgtattgagaggtactttactgacaaattttacagttcgatcctataatgggagaagaaaatatagtcaagtgatacatttcgggttggaagccctgatgaaacagttgcatcctggagagaacatgacttctctagcagcagcctaagacacacaaatgaaaagtatgaccagacgcacaggcagccagatcgaagtcctgactttcccctttagacaaaatacagactcttgaatcctttgccatccccaccacccctcttgtcttctttatactagggtctggggccattgctaataatcactgtgcttgtgttgtcgattttcttttagaacatttaagagaaaagtagtttttttggtacctgagtgtccgaatgaaaaaaacaaaagatggttcaagacaagtgtttccaggaacatgtaagagtactttttttttttttttgagacggagtctcgctctgtcgcccaggctggagtgcagtggcatgatcttaagctcactgaaacctctgccccccaggttcaagcaattctcctgcctcagcctccctagtagctgggattacaggcatgcgctaccatgcccagctaatttttgtatttttagtagagacggggcatgttggccaggctcgtctcgaactcctgacttcaagtgatccacctgcctcggcctcctaaagtgctggtattacaagtgtgagccaccgtgcccagcccagagtacattttgtttgtggatgaaaagactgtcctatgtgtttagtattctctgaagacagtgtgagacttttaggaacaaagtcagcctgaccctgttgggagaggcagaagcagaggtctgctggggagagatcatttcctccttctgataaaatgtgccagagtgccctggactggtgatacctggaactgggctctgatgtcactttattttaccaaatgtgcccaagtttcccctttttgcaggtgaatggcccttcaaacattctacaaaaaggggtattacgattgtaatactaatctttaaaataacactttcttttcttaaggggagtgtggagccacagctggcacagccttgggcccaggctgtccctgctctgtttttgtggttccaggtgcttgtggtgcaggttgtgtggttgaacagtgcttgtgttggccacacacattgttattggaagaggatctttttttcattaccttctgtaatggggaatagtttatattattttccccaatgaccaaaagcaagaaactttgaaaactgaaattttaagaccttaaaacaatgtcattttttttttaaaaaggaaaccctggcatttaaatggcctaccttggaagctgttggagaaggtggatgtgctcatacctggaaagagaaggctctccgctgcctacccacactagtctcgccttttacctcttttccctcctttccaaataactggtttcttctcccttctcttcctcctctcctcccacccgcccctgatttgagcagattatagtattgcctgttaggtaagcagaaacccccaagcctggtcagtaagggatcctttcctttcctgccctgttacagtccatcttggttggaatcagcaccaggcctgtttgtatgtttttatccgcaaggtggcgctgcaggaaagcctggaagtcaacctgtttaaagcttttcctctcatgcttttggcacgccactttactgtggccttaaagaactaaatttggtttaagtcagtatggattttttttaatgaataagttaatgtcttatatatgcatatgcctatatcctcttttccccatatctacccatgtaaccttaaaatttttttgaaccatgttggtgttcttgttttcattttaattcccattcaattgaaaaataaagcttttcacttcagggaaaatatcttaattcatgtttattatcatatgtttctgattgaggatttatgtgttcatttagaattttgttgcttttaggtgtctttctttcattattttttgatcactgagtttcgtttgtgactggggttggttaagtagcttgatcaattagccacctcttgttatctcacataccttggaagttaactaatacaagtaggtaggggaaattttgttctggaaaatcaaggaaggattggtgaaggttaaatacctcttcggaacaggaaattccaattttatttcaaatttaaaaatttttaaaaagctgaagtcacttgatttcagcctcttatatgaagatgtgtcttctccctcattcccccaatgggtcaggacaacagatgtggcagtaagcagtcaccttgtgcattgcatccaagagtcatgctgttttgaaagaagagattcactctgatactcccactatattttctcttcacagacatacaatctttgccagcaacacttcctccttgcagattacaagcatagctaatgccaccaccagacaagaccgattcgctggcctccatttcttcaacccagtgcctgtcatgaaacttgtggaggtcagtgggtgtcagcttgtgtgtgtctgcccgctctgccagctctctcagtcctgcttttctgtgttacaccagccctgccaccagttgcctaggatgggttttaacctgagggtagaaggttgtccctgagcctcatatctaggagggcttctatgctttgtttcttcacagccctgtgtcttgcttagtgatatccagaaaggctgttaactttgtggaatgtcatttacttatttgtgccagagctgatgggcagtgctgagaggcatcagaatgggaaggcagcactagaaaccgtgggctggatgggaccacacagagggcagctacatgtgttcatattatctcatcgaggtcagcttgcccatgctgtaaatgcagttctcattagatacactatactagcttgtccacagttcctggggttaattctgaccccatgtaatggtgccttagcattgtccccagatgaggtacatctcctgtgcattgtgatcagagctattaaaaccagctcccattgggtgcggcggctcatgcctgtaatcctagaacttttggaggtggaagttagtggattgcttgagacccaggggttcaagaacagcctaggcaacatggcaagaccccatttctacaaaaaataaaaaatcagccaggggttttggtgcacgcatgtagtctccagtacttggaaggctgaagtgggaggattgattgagcctgggaggttgaggctgcagtgagctgtgattgcaccactgcactccagcctggatgacagagcaagatcctatatcgaataaaaaaaccctaaaagtaaaaaaataaaaccagcttctgatagccttgagcctcctgaccataaacctggaaggtggagcggggaggcagggagggcttccccagcatcctgtttggaatgcttggagactccaatatgttggagttggagtcacagtaggcaatttgcacctgaaatgggacaacttgccttttacagggtcctaattacagggtctgaggagcagccgctattaaagtagcatttgttctgaggttgaggagttattgccctgcgaagtgtgggggacgctgatgctgccatgtgggtgatgtggggccaggcaaacctacacacactggctgtggcctctctgggagtgtgtatcgtctgttttcttcattattgccttttccaactaccttttccttcctttatcctcctcattccctcaccactactcagcataagcatttttaataagtcataataatgaccattttttttagcattttctctcaagtgacaactttgaccatcttgcaatgggactttttctgtcttactaacattgcttctcagcttcctcctattttctcctatcccctaaggctgattttttgaagaaattgaagaatgaaggggagggatttggggaacagaagaaacagcatttaacagctcttatctcatgcagattaagagcaaagaagtggcatgcatttccaacatttcagtacttagggactagttgatttctttagttattatattgtatatataagtgttttggagataggcacattctgtagatttactttaataatgttttcaactgcatttatctggtaatgtatgcttttgtctttggaaatgtagtgtgttggttgttaacagctgatgtttagcaaatgctactattttttagaaagtattttgtaaaagtgttcttctctattcagtttttattgtttaactttagctcttccttgtgttgctggtggtgtacaccaaaataacttgtataataagctaagtggctcctttacttaggactgggctcatttaaatgtatatatatatgtattttttttcagactctgttggaactaggagcagcgtatctgtacaaattactgttcgttgaatgaatgaatgagtgaataaacatccatctctcctgtttaaaaagaaacaaaccttcactattattaactcccttaaaccaaaaacttaatttgaaaactccatagtcagcagtgtttgtcccccagctcagtctgtggttttgatggagactttttagacctcctttcaaacagctctgggattctgtttgatttgtggtacccgcagggtggcttctggtctttctcgtcctgctcctcttctccatcttcactgtgtcttttcctgtttccatccattcacttctcttgatgtcacgacatgacaccatggcccaggctgtgatcacacgaaaacaggagtgagaactcttctttgtttatatagcacctttcatccctgcacagacactagctcattagttcaccgagtcagacggccctcttgcacagggaagacatgcccatgatccccattccagagaagagaggtgaggcagttgcctaagatcccatgaagggtctaaagtaaaccctttgactccgattgaagttctttactggcctttacattttacatatatatgtgtgtgtgtgtgtgtgtgtgtgtatgtgtgtgtgtgtgtgtgtgtgtgtgtgtatagttgaatgaatgcgtgaataaacacgcatctctcctgtttaaaaatatatatatatacttcatctggttctttccatttaccattacacatgagttctctaactgcttactgagggctgactgtgccgggcatcgtgcttggtgccgtcccctacagatgccagtagggcagcccttgtgcccttgcctgtacctcacagaggtcaggagggctgctggagcaggtggcaggccccgcttgctgtaaatgaaagccttccccagaaggatgagtctgttctgaagccaaggggccactggcctctagagcatctgtgtggcagagggtggagtcatgggagaaatactcaggaatccaggagaactgtcacttgggcaaattactcactttcctggggctcctcctcctctataatagaagatcaggtcccatgtagaagactttaagggcaaccatcatatacttccagacttctaataattaaataatggaagtcagcatttattgagcatttgtgcttaggctttgtgctttactcccaatgtaatttcattctcacctcaacttcctgaggtgaacagagtgatttcagtgtcatttcagtttcaagaaacatactcagggtcacacagccagtaagtggtgcaactgaacccaggcttgtctcaacaacaaagcctgtaaaactgtcctatacacacacgtacacacatatacttgtattttaagccgtgattttgtacattctacagtacactgttgtcttttttttttttttttgagacggtgtcttgctctgtcacccaggctggagtgcagtggcatgatctcggctcactgcaacctccacctcccaggttcaagcaattcttctgcctgggcctcccaagtagctgggactacaggcacatgccaccatgcccaactaatttttgtatttttagtagagatagggtttcaccatgttagccaggatggtctcgatctcttgacttcatgatctgcccgcttcagcctcccaaagtgctgggattacaggcatgagccaccacatttggcctctgttttaaaatagtcattttgggaaatacattgtttctggcttgagattcctacttctatgctgaaactcaaactatttttgttgcctatatggagccttttgatcaatcattccttgaaccattctactgaagttgcttgctgacactctggtcataattctctgctttgcatttccaggtcattaaaacaccaatgaccagccagaagacatttgaatctttggtagactttagcaaagccctaggaaagcatcctgtttcttgcaaggtaagagtatgggtagcttgggaaggaggtagttcttttcttcttggaccctgacttgttcctggtagaattcttctcatagaatgatgtgaaagaaggagtattgtatactgcaagcttgtccacgtgctgtaaagagcaatccgtgcctcctgttctagtttgtagacagggaaactggactcctaagccatgcctaaggccattatgtggatagtctgagacctgaatggagctcaggacaccagctgagtagaagacacgggactgctctctgtcctggcttttgtctcctgatgaatggctgcattttcataaatgattttaggtacagcttggtaaacacatacatccctaacagaaaatgagggctttacttttgcaggaaatactacagatggtgaaataaatgataagacagtgagagagcaacctgccaaaatagcaataaggaacctgtttctcaccgggaagttgcattatgtttttattgtttgttgttttgtttttcaagaagcagcatggtttagtgggaagcctgcttgacctccatcttttttttcccctttcttaagctgcccagttattgtatataaaataatcccagttgctgaaatgataacctacctgaaggtaattattttgattaccttcagtttctccatttgctttagttcctctttagttcccccaaaactcggggactatacttatgcatgactttgcagtttttcttaaggggtagttgtgtcacaaaatgctacaccattacaaagatttacatataagtcatctactttttttttaactgtaatcctttgtatcattatagttctcatagcaaacttttgctttctaaaatattctcgagtttgaacttacagtactgtactaacccatgaaaaatcatgctgttcatgaatcacctgaagaagccatctgttgaggtggactccagcagccaaagagagcaggcttgtgtgtcctgctcctccccgtccatgggtaaagtgttgttagggagtctcatgctttaacacccattttttgtttgtttggttctgtagttttaagtcatctagatttctaaactcatattaataattggatgttatgattgtactttcttacgcagttatgctttgttagtggaagaaagtagtaatggtattgaaaagaacatctgtgcaagacaaaaagatatggaaacagaagtacagggaaaagctaatgattatcttcagcagcataataattaatctacaaagtaatgattcagtcttccatcagagtggccacggcagctgcagagatgggaactctttgttctcattaaattatcttgttaggtcattccagaactctctctgtgtggtattctaagggctttcagagggtctttctgggtcagttattgaagctctttatgaggcatctggacaatatatggcaactacataggacaagggtcagcaaacttctgtaaaggaccagatagtgaatattttcagccatacagtctctgttgcaagtagtcagttctattgttgtagcatgaaaacagccatagacagtatatgcaatatgagtgtggctgtgctccagtaaaacttgacttacaaaaacaggctgtgggctacagtattgtactttaccaacacttgacatagaagaggggcattaatgtgcctggaatgtgccttcctagtgagacttcatgaggggattgtggtatataggttaagggtatgaactagcccaactgggtttaaatcctggtgccggcacttattagctgtgtaaccttaggcaagctacttaacctcgctgtgcctcagtgtcctcatgcttcacataaggataattatagtacctctgtcacagggttattatgaggaatgaataaattaatatttttaaagtatttagaacagtacctggcacacagtaagtacagtaaataaaatgtgtttaataaataatctgaaaaatatgaatttgattacataaaataaaattactttatttaaagattgtgtctcctgctaggcacggtgcctcacgcctataatcccagcacttcgggaggccaaggctggtggatcacttgagcccaggagttcgagaccagcctaggcaacatggcaaaaaccctctctacagaaaaatagctgggcatggtggtgtgcacctgtggtcccagctacttgggaggctgaggtgggagggtcgcttgagcccaggatgtggaggctgcagtgagctgagatcatgccactgcactccagcctgggcaacagagcaagaccctgccaagagaaaaaaaagactgtgtcttttcacattccaccaatatactgatagcatctgtctctctgcattctcaatagcatcaaatattattacagtgggggaaaaacctttgataatcttgttggcaaaaatgcgtatttttttgattactagtgagtttatttatttatttttttatttttcgagatggagtcttgcagtgtctcccaggttggattgcagtggcgcaatctcagctcactgcaacctccatctcccgggttcaagcgattctcctgcctcagccttctgagtagctgggaccacaggcgcgtgccaccacacccggctaattttgtatttttagtagagacggggtttcactgtgttggccaggctggtcttgaactcctgacctcatgatcctcccgccttggcctcccaaagtgctgggattacaggtgtgagccactgcgactggccagtgagtttaaatatttaatgagtcttggcactttttccttattgagctctatgagctttttctgtagaagatattaactgttggagcttcatgttctcaggtaccctatcttgagtctatagtgaaccttttgaagttgaaaagagtatttttgcctcaattataaaatctgtattgttccataatcttaattaagctgataaaacttgtttgtgcatctttgtgctcatgtggcaatagatggggttagggcttggtttcagtttgcctagggttaaaggaggttcacatcctttgtgttactgtccagtttccccgcatgcagtcaggttagctctgtgaggagtgcctggtcatctgtaattcagacattaaggaagtacctggtgtgtgctagaaacagaatgcagagttcaggccagggtgaggatttctgccctcaggaagatcacagccttttgacaaaagaggaggcaccatttgcctagtggaaatcagcttcaacaaaaaaatcacctgcttttctctacaagtccccggaagagatcagtagataaaatccaaatcccacacctgtcctccagagagatgattaatgttagttactgagaagggaaatggatgaaaggcatatgtggcacaggggtcaccgcaggatgcagaggtcttagggggtgtgccgtgaaaggccagctctctgtcagaggctctgctcctttgtcggagcacgtgccctcaagtcagctccactgcagtgtgcgctggaacctgagaagttgctgagtagccgaggagtggctccaaggagcctggaaagcagtcctcctttgaggaccattcaaggtggagtgtgacgttttgtcgattcttgaaagggaattgggaggaaagaggaggaataaagggatgggtgtagggctgtgtgtacagcattttatgtgttttctgatttatcttcacaactttgagacaaactgtcacccccagttcacagatgatgaaacagattcagagtgacagaaggaccaagagagtattcaagattgaacccaaatctgtctctcccaaagccatgctcttccaggtcacacctgtgccttgatctgtctttatgtcaggatctgtgcagtggggcatctgggtttgaatgtttttttaagtactatgattgttggataaattgtcatatgagatagaaataaggccatgctgcaaattttgaaaatgtacagcttgataaatgggggcaaacatgatccagggtaagaaggggcaatttggtgacttcacaaaagataccatttaatgaaaatttactagttttttgtttttctgtctcccaaaacaggacactcctgggtttattgtgaaccgcctcctggttccatacctcatggaagcaatcaggctgtatgaacgaggtatccttctgacccaggccaggagcagcagacctcagctcctggcgccactgtctggaattctcagtgtctctaggaggggtcgggccgtgcacaatggaggaagcagtgtctgttttctagctttgtgagctcagctgcaccctgagccctggtacctttttcactgttttcccagggcctcctggcttccctgtgggcctctgagaaaggtttctggaactcccaccacccccactacagtcccagccagagcaattgcatggccggcccagattgatatcctggatctctgcttttgattaaaaggtttactgcttttaaaaataatcataatgtaaaaatcactaggctaggagatcttgaaagttccttaaggttctaaaacttgtgactgacaggtgattagaaatatgtgacaaggccgatatgtggtaaggacagtttttagtagtctgtccttactgagtgatgtcatgatgtactttttgtaaccttaagaatggtgtaaacagttttcctcagtacttgattgacaaagaatgcttttctctgctgtagaaatatcagatttgggacagggtccaggcctctaaattgatctgcattctcctgcctgctttccctccctggtttctggaaaggtagctctcatgtctgcttcaaaggcaaacaagccttaataggactggataaaaagcaagtgtaattgttttcaattacttcattcataaatgctcactcctgagagtgtcattttttaaacaaaacatttacaccagctcttccagagagatgaaagcacatttgcttcctcaaaatctgctttaaatattaaaacttttctctatggtttatggaagcaattgcctcacttttgctccaagatcaaaccaacagttctggtttatctatcaacaaatatgcctaattacacctcaaagaaagcacagagcattttaccctaccttgaaaggcagttgtatgtcttttttttttttttaacaaaatgtaatgttttagaatgtagcatgtgagagatccaccttttaatggtgttttcctcactgtccatttgatgcattctccaatgcaccaagtatcagatggtaagttgaaagccctcttcttgtctgtggtccctttctgcataggtgcatgccctttagccctcaccatccctggccgcctgtgggctgaagctggaagagcaggacctggcctcaggacatgctcttagcttgctctgggcatgggcttcaacagcctatcattggctggtccctctgcttctttttccaccaccttctcagaatctgcttctgaagttgctgggtgtcctgcctggggtgggtgctgcttccctactgcacactacagtcacaccctaggcctcttaccatgtccccccgcccaccacctgctccctcctctcagccaacacagaggagtgctcagagcatgcccaccgtgccatctccgttcatacagttccaccttgaagcttcaagcatctggaggctccttctcgtctgccacatctgttcatcacttttgattccttcctgtcatgcctgttccacctcttcatcccaccttttccccatcccagtcaggctgccttcatgaggttccttaggtagcagagtaattcacgctactcatgtcttttcctgactggtccccgctactgcacttactgagaaagtatcatattgtccaggaagttgagacaccgcctactgcatctgcccacacaccccctgcacagcctcggcaggagctctgtgactgtttctgaactcatgcaaggagaaattttctgtaccccactgttgatacacctggggttccaggcacatggtttggccaatgctgccttgagtggtgcaggctctctggaaggatgtgtgtgctgttgtaggtcaggcctcctggatgaccgggcctctgccactaacacttcttgccagtccccatgggatctcgtggaggctcacgcccttttgctctgctgtttgtccactcattttggcttccatgttgggccttctttcccagtatcccagctccgtcctcactcttcctattgctcttgttcgttcacactgtgactgaggcctgatgcatgccccagtcactctcactcctgtgagtcagagggacagaggctggataggctgtgtctgacagtggactgctgcccttgccaggcacccactcctaatggccagtgtgggcaggatggtggggccaaatggtcagctcttctcaggagggctctgctggcaacaggcctgggagcaccatgagcctgccccccagtcaccatgtgacatcttgctcacattgtcgcccctgctcaagacaggctcagtggttctctggtttcctgccatctacaagctctgccagagagccttccttctggccaacctctgcccctgctgttatcaccgccaactactcctgccattcccacgttgccccacctgagtgtctgcagagctcccagctggacatcatctctgtcatcacaactcttcttgctttggctctcccttgggtcacttgtcactgtcttccctgtggcatggcaggtgttttctttcccttactatactctcttttctggggcactctggctcctcctcatcttcatatgtcccaaggtgctgtgtagggcgggcacataggcagctgctgatgagtaaaaatgctgtttctgagttgttgctaagtgcctctgttgttcatgctaagaatggttggcaggtggtgctgctgagccagacaaagaagcagatgttgggcaagtcccaggccctcagctgtgctgatctggagttcactgaggaagctttcctttgctgtcttgtctggagttaggggctcttaactggagggaggtaggagagggtgtccaatgaacctcctaaagttgacgcagaatttggggtatatgtgcattttttatggaaagggtgtctgattgtcagaagtacttgattctaaagaagtttaagaattattagtttaaaacatgattccacatctaactgtcacttggcacaccaatctctgtattttgtttctctgtttctgaaagtttgcctcttttgctctgcattattgagaacacgatctttagagttgggctgactttgtagagttatttagatatttttctatcatgtgctgtatcttcatattatttcttgaaataaaacagtcctcaagtgagtctctgaatatggaattacagcgttgcttctagggttaattgtcctgtccttgaatatagatttcattaaatggctttagctgagttgcaaccattatgctgtcagatttctgtcccagggagactgccagtaacaaatgaaccagtacataagcatgttaggttgtgatgagtaattgtggagaagaagatagtaaggggtggcaagagtcttgtcctagtgtcctggccttttctttagtgcagggagttgctttttttatatatgcagggaggagaagaggctgtcagaagtatgacacctgagcagaggcctggaggaagtgagagactgagctccgaagctgtctgagggcagcacctaggcacagggagcatatcccaagcctgaggagcctgtgaggccggcacttccagcattccagggctctaccagcacagaagctgcggggcttcctaatgaaatcctctgagtagaacccacttttaagcttcatagccacaccccaaatatgctgtgttccttcccattcctgcctctgcatgtgctgttctctctacctagaatgcccttcctggtctgctcatctcaggattatcttcaccttccaggacccaggcatgggggtggttttggtgaagccctggcagtgtgagtaaatctctccatctttactcacacagagctgtgtgagtcatgaatcttcaggtcttattatgttgaagtttttggcttacacatctgagttctcccattatgtcatgagtaccttgagtgcttgtctggtttatctttgtctcattctacatctctggtgcctgctacataatgaatagaagttgaatgaatgaatgaatgaatgacgctgcctatatgattatttttgtttctttgctttcttatggcctaacactcaaatcatgatttctcaggcgtctctaatcctaattagtgtagttattagtaatgtcaaccataataaataattgtggtgtattttagtcaccttaaaatgccttgaaatcctttggaattactttagtaatttatttgcttttaaaaatatatcttctttatcgatgtttaagtagtttctctctgagtgtcttaacatttttccctctttagctttgatctgattgacttcttaatgctttggaacaaaattctagatagccacctgttgcagactattctacttttctgatttcaaagaaagggaacagattgttctccataaaggcctcttggggccaaaggacatagtaaatttccaagggaaaagcacattgatccttgtcgtagtctactcaacagacttccaaacgtgtggtgattctaactcgggtttgggcttttctttaaaaggtatcttgactaaaaggtttgtgtgaaatgtgatgccaggggaatactccttacttgtaaaacccaaaaaactgggggaaagaatacatacaataactatacatacaaaagcagaaagcttagttttctttttaagaaagtttatttataaatcaaaaatatgctgtagcattaaattatactttaataaatgattccagagttggaaaatcccaatgtatttgaaagtagctgaagtttcaggcatggagacttctgtctccatgaacagggtatcagtactccaaaattcacctcagtggtgcgtagctttgaaaatcttgggccacacactgtggcttacacctgtaatcttagcactttgggaagctgagacgggaggatcacttgaggttgggagtttgagcccagactggccaaatggtgaaaccctatctctactaaaaatataaatattagccttgtgtgggggcgcacacgtgtagtctcagccactagggaggctgaggcaggagaatcacttgaacccaggaggcggaggttgcagcgagccaagatcgtgccattgcacttcagcttgggtgacagagcaagactctgtctcaaaaaaaacaaagtcttatgacctctttggcatgtactttagagaggaaatcttacccaagccagaaagtctcagtctaggcattttttttattgtgcaagcatataaaattctagtaattctggggctaatcctgtgatagggagaattcaaggaaaggtggtggtgacccagtgctgccgttttctccttaggtgacgcatccaaagaagacattgacactgctatgaaattaggagccggttaccccatgggcccatttgagcttctagattatgtcggactggatactacgaagttcatcgtggatggtaggaattggaattttttgttgtctttaattgaggtagtttttctgaactgtaaattataatgcctttttaaaaaaagttagcaggggtcttaataaagaccttccaaaatcctgcctcaccaggttgagaattcatgaacagatgtcaggagaaggaagaatgtgactgtctagtgtctctttaacagggtgaccttgaagaaaaaaaaacctttatggattcacaggaagttacaaatatagcacagacaggtcttgtgtgtgtgcccttcacccagtttccaccagtggttatatagccatagtacaatattaaatcccaggaaattgacactggtacactgtgttatcacatcaatagatttgtgtaacctccattgcaagcaagatacacatccattttaaaaaatatatccattgtaatgtaaaagctctgaagacagggtaaaaataataattaaaactggactactgaagttgaatgtagctatctgttcccaagtttcacagaatgctagttgaagaattaaattttgaatcttatgtggatgcaaaataccaatggcaggaatgcagattttttaacgtgtattctgaaagttaactgtgccagtgatgaatccaaccagcaaattaatggcttctgtcagtgtacttgggcctttggccttagtgatttctgagaagacactggataagtaggaggaccatagtagggccaggcttcaggcagcacaggtgggtggcagtgcagcagctttggggctgatgtggctgcaccagcacagccttccttggtgcctctgcagtggtggccggaggggcgccatgcctggggggctctcccacatcagaggcaggcctccagacttgtccttggaaatgccaagatgtaaaaataaacccagcacttcatcctgagttctcttccctccgctcaatagggtggcatgaaatggatgcagagaacccattacatcagcccagcccatccttaaataagctggtagcagagaacaagttcggcaagaagactggagaaggattttacaaatacaagtgatgtgcagcttctccggctctgagaagaacacctgagagcgctttccagccagtgccccgagtgcctgtgggaatgctctttggtcagacattccctcacacagtacagtttaataaatgtgcattttgattgtaatctatcgaagtgattattacaccagttacagcagtaatagattctccattaagaaataattcccttttttagtctgttcatttctgtgtattttctaaacagctttacacccttggtgccttggagcaaacatgttttttgaaccttgtcatttttgtgaagaattgcctagattccttctctcatcaacgggaaagtacttcctctgagagtgcgagtgcaccatgctcactgttgctgcgtgggagagtcacaagccactggcaagcaagtggtatagtctgtgaagcactgcagcgagcagcacctggatcttgcctttataagaacattttactacctgcagctttgagtcttgccctacattttgggcatgacataagatgtgtctttattcagctcgtcgtgaagatgctgctgctgaatgggtcagcatatctctgtttgcatggtttgcaggaggtcggttttcatggtcattcagttccacagatctgaatgattactgtctgtctgtgtcttttttccatgagaaatcactgttgcaaattgcctataaattgactctactaaaataacaatgtttcagtctgaaaatttgaattgaaaaaaatgtataatataaaattgtaatacactcaaatgattataaaagtaaaagttggtaatttaggcagaagctatttctcctcttctttgacctgctgttaatttttaaagtgggagtgacggggagggaatggcaggacaaggcatttgtgtaaaacctgcctggggccgtcgctgccagatttcttaccaggaaagcagtaataagggcacagagaacaatttttaaggaacatctgtttcttctttgccaacaaagtgaagtagtgtaacgtaagcttcttttaatcattggcttaagaaagtgtcttccaagatagaattttggagttggaaagacatcagaaatcctgaggtccaatagcctcattagcagaaagcttaagggatgtgcccaaagtcactagatattttgtcacatagcctagactagaactaggttttgataaaattaagtacaaaatagcccatttgaaaatctccgatccaaaatttcagacaggactctccctaaaatgggcatccttgtttggtgttctgggtcataggtctaatagtcaagagattttttttcttcattttatgactgataaaagggagcttattaattttaaaaattttgaatctataacatagtgggaaaataaatacatcggtgcatttgtaccgcacatagaacctgggtaggacacttttaggttattcttataaaatgctgcctaacgaaccaaaggaagcacctgtgaggccacccgcatttccatcgctaaaggttacccttgtggtctgacagctccctgctctctcaggctggctcttgacctttggcatgagccctgggcctaagtgggggcttcacttccttactgtctcaccagagtccccataggatgcaggcccttgtcctggaaatggcagggttctttcttgaccactgaattccaggaaagatgtaactcagcaatgcaactatcagactgccgggatgagaaggtaggagctgcagcagtctttctggctggcattttaaaatacactttaagcctaccaaatagtcaaaaggcctagcctctcaatatccttttatcgttttcaaaaaatattttccatgcaccgtgtttgggaccaggaaggaattttgaacatccttcctttagacatgggaggtgagggagtagctttttctttcccaactccatgtctctgcgttctcaggtgaacgtagctgcttgccacggagagctcttggggcggggggagggaaggtcatgtcagtcaggttctctgcttccaaatataggcccgctgctgctgtttgcttcagtctgtggttaagaactgagcctcagtgagagccccaggtgccttgcatcatcctccactgtgttttggcagcacttgttcaagagggagggtgggtcctggcagtgctgctgggcctggtgtcactgctcttggttctcctcacctccccaaacttgcctcctaaccgtcatgaatcttttatgacacttgaaagtaaagaccaagttttaggtcaagaggatactttttttttttttttgagatggagtcttgctctgtcgcccagtctggagtgcagtgttacaatcttggctcactgcaacctccacctgccaggttcaagcaattctcctgcctcagcctcccgagtaggtgggactacaggcgtgtgccatcatgcctggctaattttttatagttttaatagagacggggtttcaccattgctggccagtttggtcttgaactcctgacctcatgatttgcctgcctcagcctcccaaagtgctgggattacaggcgtgagccaccgtacttggccactttttttcctctctcctatgcttccccttagtgatatttttatttatttatttgttttttgagacggagtctcgctctgtcgcctaggctgaagtgcagtggcgcaatctcagctcactgcaacctccgcctcctgagttcaagcgattctcctgcctcagcctcccgagtagctgagattacaggcatacatcaccacgcccagctaatttttatattttt

SEQ ID NO: 13017 - DNA, 8167 bp, Human
ctatactcagaatggcttgaggacttgttatttgagttgtaaatagcacatgatgttttatgtggcacatgtttatttccattgaaagagcatgtcctatttttgaggaaggaaagaaacttgtaacttcaaatgtttgttgcaaaacaatttgatgaaataaatgtaaatgaatcagaaacatgtgaattgtatttcattaaaattaatgggtttaaatgtgaagggggtaaaatgcttgggggaaagagtgtggtaaggcgggaagggatatttgttttgttttcatcagtcttggattcttgaaaaatggcttaatagtctgaatttcatctcactaagattctcttaagcctaatggtggagttacagagtggaacaatgaaatgcaaatttattttatagctttgtgtggctccagttataaagtatgcatcaaacattgccactatgcagtccttcaaaataactttcaatttgaagttggtggtttttctatataattctttaaagggtaaacaagaaattgtaatgatgctaaaatacattttttatctctcagactcgtacataaacttcacatttcctttttctaactgaagatgatctgatcacctaaacggaaaacatgtgagggctcaatgtgtagacatatatgcaggagatgggcaggaggagaagacactggaagaaagggaaagagtaaaagaaataaaaggaaaaaaagacatgagcaatgcaggccgagctataccatcaaacctaattcataagtaaagcactgaaatctcactaagtatttgagagccataaccattttatcccatagtttatgttcaaattatttatggttgcttaaaaacaaatacatagcttattttatattttgtattttcaattaaaaaatcatctattactctgaaaatgagaaaaatatcaacttcaaaaaagaaaaaaaggtttacaaatgagtctccctgcctcaaaatctgagtaagtttgatgtgggttatgacattttagtttctcaacttccagtctttgaacacagggacatttttaatgttccaaatacttccaagaggcaaggggtgcacaaatgggtatatatgtatgtataacccctgaaatcttcattttcctaaactctgaccaccttctgtattatttcacatgtatttttttttaagataatatatgacactgctgaagtagccttctggacatacccctaggtagagaaatgtatgaacagaggttctttctttacaatagaaggcgtagtagcctgtggggctatttcaggtctgtaaggagtctgcttttgtgcttcctgggaatataatgatataattggagcttagcatctctctggctgctgggagctcaactgctgcttatcaccgtgtttggaatgaggatcctgttccttagtgtctttgtgccaaataattcactgcctcatactgttctggaaatgtttctcctccttgcttttataggcaggaactgaaagggttcacttttaaaatatttgtttcataattgggcaggagatacattttggcttctagcatagccctttgttgttttatttaacatttctctcatcgttctttaacaggtgaaaaaatcgagtggctaagatggctgtgtcatttttaccttacaatagcatcaatgcaataattacaactgctcttgagaccccaaagtcacacataagggtcctatgaatcaataaaagtctaaattctaactctagcgttgtgtcaatgaaaatatacaaacagcgtcagctttatctttgtcatcaagcaatagatatttataaggtcctcaattaagtgtgactacttaggctctaggttcagaacattatgatgatggtatagttccttccgggtgagatatattgtgattcattttctatcatgatttgctatagtaatgtttcataagtgaaacacgatctaatcctttacttctggtgttgttccacttgatgacaggcctacccttgtagcagtgataaggagtgtgaagttgggaggtattgccacagtccccaccaaggatcatcggcctgcatggtgtgtcggagaaaaaagaagcgctgccaccgagatggcatgtgctgccccagtacccgctgcaataatggtaaaagatctcactaagtgttaatgggcctctttcttttcatcatcataagcctgtctctcaagtcaggctatcgtctccttactcagactcctgaaatataagaagcctggtagaactggtttaggtagtgtaagattacctggattacctccccaaatcttagttttcctagagtctggctactttctatattttatgacctacactgatctagaatattgccatgttgaagtgttgtgtataaatagcaagatgttctatttcagtaaacacataagtgaatgcatgtaaaagaaccaaagaaagaaacttgatatgatttagtaatgcagttgcaaatatctattccagttttgtgctttgggtttagtcaagatgttctgtggctcagtcttatggtagtagagtgattggttcctccaaagggagatgcagcattttattccccaacctggcttcatccaatatcaatgaatttataggcagacaattcagtaataatgatgaaatggatcacagacaagatgtggcaaaaacattaaataattgcagaaggtaattagaaatatatacttaatcatataaaacaacataatcaggctcattttctcatgcctattcctgacctctgggtgtagacctactgtgagtctcttgcacaggaggtgaagggaagaagacctcacaccattagagaagtttacagtgtaaactaacattatgttgttaattaataaaggaatctggatccagaggatgtatgtctgatcagattctttaaaaatagtaatagctaacattgattcttcacatatattcacaataactttgtgactatataaaattatgcttttattcccagttttgtccaaggtcacttggtcttgagagagacaaaattcatattaaagaagtttcactttagggccaaagtatgctcagtctcaataaataagtaaatgaatggatgggtggatagatagatagatacacagatagataaatggcttcatatttcacatcaagagagtatgtggataagtatcacatttcatagaattgaattagtctaactgattatatgatcatctccaggcatctgtatcccagttactgaaagcatcttaacccctcacatcccggctctggatggtactcggcacagagatcgaaaccacggtcattactcaaaccatgacttgggatggcagaatctaggaagaccacacactaagatgtcacatataaaaggtagggatatctgtagttctggggtttttttaaaataaagaaatagaagaaaaatatagataattaattccattggttttagaaaaaattacaaggaagtttctttaatcctagctagtcattaaacttgttatttaggtggcaaataatggaaacagaccataatagatttatgtgataagaggcagagccaattggtatcaaccaagacttttcattataaatggtaacaacatagaagatagtataagtaaaaatattttatgtgcttctgattgcaaaatagaattttttttttctgaagtgtcagggtaacatctattggtcatcatctctgcagggcatgaaggagacccctgcctacgatcatcagactgcattgaagggttttgctgtgctcgtcatttctggaccaaaatctgcaaaccagtgctccatcagggggaagtctgtaccaaacaacgcaagaagggttctcatgggctggaaattttccagcgttgcgactgtgcgaagggcctgtcttgcaaagtatggaaagatgccacctactcctccaaagccagactccatgtgtgtcagaaaatttgatcaccattgaggaacatcatcaattgcagactgtgaagttgtgtatttaatgcattatagcatggtggaaaataaggttcagatgcagaagaatggctaaaataagaaacgtgataagaatatagatgatcacaaaaagggagaaagaaaacatgaactgaatagattagaatgggtgacaaatgcagtgcagccagtgtttccattatgcaacttgtctatgtaaataatgtacacatttgtggaaaatgctattattaagagaacaagcacacagtggaaattactgatgagtagcatgtgactttccaagagtttaggttgtgctggaggagaggtttccttcagattgctgattgcttatacaaataacctacatgccagatttctattcaacgttagagtttaacaaaatactcctagaataacttgttatacaataggttctaaaaataaaattgctaaacaagaaatgaaaacatggagcattgttaatttacaacagaaaattaccttttgatttgtaacactacttctgctgttcaatcaagagtcttggtagataagaaaaaaatcagtcaatatttccaaataattgcaaaataatggccagttgtttaggaaggcctttaggaagacaaataaataacaaacaaacagccacaaatacttttttttcaaaattttagttttacctgtaattaataagaactgatacaagacaaaaacagttccttcagattctacggaatgacagtatatctctctttatcctatgtgattcctgctctgaatgcattatattttccaaactatacccataaattgtgactagtaaaatacttacacagagcagaattttcacagatggcaaaaaaatttaaagatgtccaatatatgtgggaaaagagctaacagagagatcattatttcttaaagattggccataacctatattttgatagaattagattggtaaatacatgtattcatacatactctgtggtaatagagacttaagctggatctgtactgcactggagtaagcaagaaaattgggaaaactttttcgtttgttcaggttttggcaacacatagatcatatgtctgaggcacaagttggctgttcatctttgaaaccaggggatgcacagtctaaatgaatatctgcatgggatttgctatcataatatttactatgcagatgaattcagtgtgaggtcctgtgtccgtactatcctcaaattatttattttatagtgctgagatcctcaaataatctcaatttcaggaggtttcacaaaatggactcctgaagtagacagagtagtgaggtttcattgccctctataagcttctgactagccaatggcatcatccaattttcttcccaaacctctgcagcatctgctttattgccaaagggctagtttcggttttctgcagccattgcggttaaaaaatataagtaggataacttgtaaaacctgcatattgctaatctatagacaccacagtttctaaattctttgaaaccactttactactttttttaaacttaactcagttctaaatactttgtctggagcacaaaacaataaaaggttatcttatagtcgtgactttaaacttttgtagaccacaattcactttttagttttcttttacttaaatcccatctgcagtctcaaatttaagttctcccagtagagattgagtttgagcctgtatatctattaaaaatttcaacttcccacatatatttactaagatgattaagacttacattttctgcacaggtctgcaaaaacaaaaattataaactagtccatccaagaaccaaagtttgtataaacaggttgctataagcttggtgaaatgaaaatggaacatttcaatcaaacatttcctatataacaattattatatttacaatttggtttctgcaatatttttcttatgtccacccttttaaaaattattatttgaagtaatttatttacaggaaatgttaatgagatgtattttcttatagagatatttcttacagaaagctttgtagcagaatatatttgcagctattgactttgtaatttaggaaaaatgtataataagataaaatctattaaatttttctcctctaaaaactgaattcaaagctccttgtcttttgtctacgggaagaattttcatagaatcatactttctgagagttcaactggacttggtctgattttgaggactgggtgtgaatcatttggaggacatcagcatgagataactcagagcagtttactattacaaaaggtagtttatttcttggcagtttagctgtaattgttagaaagttgtttctgtttttttttttttttccaaaccaaaatattccagcttgtgatttacacccatttagtcatattttgccttccagaacaacttggaacgagaatatgctcttcacaaattcttcaaaatactttaagacaggtaacatataccccataatcttctctctaggctaaagttttccaaaatggaaatactattatgcttagagtattggttcatttctacatgaaccaatgaacgtgagctacacgatacctttttctgtgtttggagagaaactgagtgaaatcaaatccacttcctgggaagcaagtctttcctctgcttcctgaaccagagatgtcaggagtgttttgaggaatagtgttcaccaagtatgagcagggatgctacaagagcccatgttttattagacatcagaatgggctgcatatgtggataataaacattctgtgacatagtgaatgaattaaatgtagctatggctgcttcatgaagctaaaacagtcccacagctagaagttagagttaaaaataccttaagcattgctgaaatactttccaccatatgttaattagtcatttaaggatattcttaaatcattggccatttcctcaaattgagaatatttatattttctagttaaagtgtgcttttgactataacaatcatataggcgatctttttcttttctattgtgctcagtgagatgctctgagaagtgacaaattgtcctgacatttttttttttttagttaagaaataaaatacccttaagtagccttagtattttaggggaaaacattcagttacacttttgtaaatgtaattgtagccttaggattttagggaaaaacgttcaattataattgtcttcactcaaaatcaggccagttgaaaaacagatttttttaaaaaatgggcaaatgaaagattactctattgctggtgaagctgatattgaaaaatgtagcatatacctgtgagcaagaagacattctaacactaaacaccagaaatagattctgtgcccattcacattcaacaccagactatatcagttccatcttatgggagctgccctgtaaaatttataatatggatgggcagaacagaatgacaggcctccttctggcagttaacaccgaagatgaagtgggtggaaagtgggctgaactatgcatttctcattcaaaaatctcatccaaaattttccaaagctggacaatttgtactacatgaaaggagtgagtgaggggtggagtgagacaaagatgatcattccatgccacatcgaactcactttaaagattgagaaagaagaagccctcctcatatccttccccagatatttttaacccattgtgcataccatttgtctatggtgaagatatgagttttagccaaaatctgacctgctacctcctaggggaagtgcctgatgaagtcttttttcctaatgacatccatttcttctttatggatcctctcaggatgtggtgtggtgggaaatttagctgttgtccccaggagctagcaaaatgtatgaaaataatacattaattaaataaacttcaagaccactctatatccaggactagaaaataattctctattcttttaactgccccaaattatatccatcatgtcatctaacacagtctattagggattttgcagtgagactaaatgatgcattgagtatatgataataaaatatgtgaaagcatttcattaataaaattctaacaatgcagagatgccccacctttgaatataaatcttcttccattgaaaatttcttaggga

SEQ ID NO: 13018 - DNA, 51273 bp, Human
  misc_feature (1)...(51273): n = A,T,C or G
agaattagtgaattgacctgtgacatttacctactcaaaggtgtttttgcttactttctggttgttgaatttagttggtttaagtgacggttggattacccaacactgtagacatgaaaacgtcaagaaaaaggtcatggtctttaaaacaagccattttgttgaccttgtgctgcattctcatggcacctagactcagataacaaaatccaaaggaattcattagagtctcttagtcacttttcatcttttcttgtatgaaaaaaatgtagttttgagaatacacacacacacacacacacacacacacacacacgagagaaggtttagaaggtaggtattttaaaatttgttgtggaagatagtgccaattaagtaattacccacagcttttaatagccctgctcaagattaggattttaattagcatataattagattttgatggtagtctaccgcaaggtaagcaaaaaagtaatgggtaaaatgtttttctaggattaaagctttaattttctgtaagtgtacttcccacattattatatatatttgtgcgtatgaggcaaagtaattttcattgttttgatactggaaaactgcacttcatataacctttcaaggaatgaatgataaacgtatggatttgatacccaatttttcttgttgctttgaaaataaatatgatttatattatatatggcagtctgaaagtgtgagtttgaggggctctttagcagttttctattctcatccatccaggattacattcaaaacattccatatagatgtgtacgtatcagatgctgtaaatcaagatggttattatttgggttagtgtaactgaatgatatctgatcagtgctacaaagtaagagtctggacaaggtcaaattccataatctcagtttggatttcctcaaaatagaaattttagtaaatattggaagacacaatgggggccatatttttcttatgtttaaggtcacattctgttgatttttgacctaagttttcataaataggttgacaaaagccatgatagttttcacgaacaaatttgtgttttctcttatgcaaagtatgtgttaaaactgaaatgctctcatctttggttctggtgggtagatttgtgtttttattattttatttcttggtttcttatagggaaggaggcttattctatatatgtatttatatttgccagtacaggcttgtctttacaaaggatagggtgcatgagataacccccttccccagataatctctatattaagttattgattgatgttagttttcgctaaattacaatttaaaaatatcaaacattaatagttaagtagccttgacaaattgcttctacaagatgtttatgcaatataaatagtttaaagtagttttcttcccagttagagaaaattaacataagccaaaagtttaaaactgtactattatattaagtatatgtgatcacattgcattacataaaaaattaaatattcttataatactatgaaaacaattttaaaaatatcgttttaggaacagaaaccacagtttttttttctgaaagtgtggcgtatttccatgacataaaggagtgtttcttagaattaatatttactttctttgaattatttggtttgtggttgatattagccttttctagattttaaaatctcttatttaatgtttacacattttcttacactataaattaaagaatggatgagaaagctcagtgtcttgccttttgggttttattccaattaatatttctttggcattcacaatttttcagattttttttattggacctcaggtgtacagaactggattaatcataagccttgttttgtgacatgctctcatcattggtccatacatgtcccacattgatttatatatttagttatgtaattactttccgccttcttctaatgagagcattgaccagtttaagaaccttgctttgcaatttggtgacatttattttctttgaaattctagaaaaacgtttcttcatttcaactcaaacttgctgctaaagcgcctaaatctgaaaaggaaatggacccagaatatgaagagaaaatggtaaatgtagtcttggataggatagtgaatgctgtaattaatttttatagttgagatgttaaagatgaaaaaatacatgtatatatataatgcatagagaatcattgattttagaattggaaaataatttaatatacaatctatcacaatattttctgttgaataaattaacctcctcattttcagatgaggaaataaaggatcagggaagctatatgtcatagttaggactagaagtcacatctcattttggttcggtgctctctgtcccataataaagtgctttaagctagaaatatttatttatgaggtgaaaatatcagtggtaataccactgtggctttgtgacctgagagaaatccagtcacaaagccagattgacgtatttttgtttctttctccttctttggacatatgaataaatgctacacattaatgaaatgtgtaatatgtcaatacactttaaagggaagaatatttgtccaatgcatgaagatatcacatatttaagcagcataatcttagttatacttacatattgcttgctataatacatttaattatttaatttttagttactaaaatacatattttagctttaattttaactaaactcttataaccttggatctttcaagaatttaacaggtggttgaaatggatttttttttcctctgaggggttgtttttgcagtaatattataaaaataagtatagatgaaatatattttttggttgttgatagctattttataagacttaatgtttaaggccacatctaatgtaggtaggcaatgttttaacaactctaaaaataacattccagtgaggataatataaaatggaaagtttttggcctccttccagcttgtagtctgaatttatctaactcttatgtttatgttaatgaactcttctgtaagttttctgggttattaattatgcatccttcattagcaatcaagtattctctactctgtggttggaaagtgactttgaataaataaatagtctttattttttcctttatctagaatgatgtatatatcttttgatcttttaagatttttttagtgaaacaaagttttattgcctgtatatggtacacgttccctgaccttttacaatttattgagaaattagaatacatatcaacttttaatagttaataaactatttcacatatatgtgcatatgtttatatatttttcccaaattctgcttactttggggagaaagtttatacgctactagcacaaaatacagttttctagatccctgtgagtgaagagaggagtgtttattacattactataccatgacactgaaaatattttgagacaagatgatactgtattttaagatttaagttatttctggatacaacttggaaattcttaagagttcagtttatggtatatatatcatagttaatttatatttcaatatttgggatatgttatatatttgatgcttaattttgttactattttatttaataaaatgatgttttggaaagaggatttgctttatgattatgactctttaagaagggtatttcttattggggaatttactgtctgtcagataatttttcttcccttcaaactatttgaaaatacattttcaaattctgctgcttattagctgtgcaaggttgggcaaattacttaccctctctgtgcttcagtatcatgtagttacaatggagatgatacttgtaattacgtcataggtttcttaagagaattgaatggattaatgtttcaagtgctaagaatgttgttcaaagtaagtatttgttaaataactttgaaggaatgaaaaggaaagtccttacttttcttttgttttgcaaattagaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagagtatgttggcacctctctctctactttctttcctttctcctaccttttcttcctcctgtcctcccttgatcccttcatgcaccccttcgctcttcattgttcagtataccttcatgtgacaaaaaatattgccattataattatgttttgaagacaactatatttttttctcactagaggctgatcagtaaaaatgtaggctggttctactgatttctaagcaagaccttggacaactcattctttttctataaaagataatagccatgtacactgatttaattgataccttatcatttaggtcgaatatgaagggatttccttttttaatttcagctaccgccataggcgcacagagcaagaagaagatgaagagctactgtctgagagtcggaaaacatctaatgtgtgtattagatttgaggtgtcaccttcatgtaagtacttcatcacattggtgagttctttttcaatttagttttagaaaaattttacttgagtatgttaatgaaagtatgaaatgtccttgcattttttcaccagatgtgaaaggggggccactgagagattatcagattcgaggactgaattggttgatctctttatatgaaaatggagtcaatggcattttggctgatgaaatggtaaggaattggtagctaaaaacacattctcagttatcaatgatttttatgtaaatttgaaaaacctgagcttacctgcccccctgatgcctggaggctttttaaaagttgttatcatgtaaaaggtattttgtagtcttagaattattattatttttttgagagaggatctctttgtgtttccaggcttgagtgcagtggtgcaatctcggctcactgtaccctcgacttcctgggttcaagcgatcctcctgcctcagcctcctgagtagctgcgactccaggcacgtgcccaccacactgggctaatttttatttttatttttagtagagacaggtctcgccacgtcacccacactgattttgaactcctgggctcaagcagtcctcccacctcgacctcccgaagtgttgggattacaggtgtgagccacagcacccagctagaattgtttcgttaagtcaccgctagaacacagactttcacaggccataaaactcttactgagctttcctcaaatggtccaaaaaccttctctgtacttttgtttttgtttgcattttggcttccaggaagcacagagtcaagatggatgcccaaatgatgcctttatgtaactttttttttaaaattttttgagatggagtctcgctctgtcacccagactggagtgcagtggcacgatctcagctcactgccacctccacctcccaggttcaagcaattctctgtctcagtctcctgaatagctggggttacaggcgcctgccaccacgtccggctaatttttttgtatttttagtagagatggggtttcaccgttttggccaggctggtcttgaactcctgaccttgtgatccacctgcttcggcctcccagagtgctgggattacaggtgtgagccacccccaccctggccttatgtaacctttaatggtctgccctgtgtgtccttctgtcttttcctattctttatctacttgtctttcttactttccttgtcgtctctttatttctattttgccattaatttatgttccatgttttcattgtaggctacctgaaatccttttgggaataaggtggggtatacaaaccaaacaatatgtaaatgactgcctgaatatatgcatgtgtgaatgattatcaatattttgacttgtgaacaatcaaaaagtgcataggtggaataaggaacgaataaagagtaatgttgaatcttgatacagtacagtgcatggtggggctttggaaatcagtgaaggagttataaatgtgtaaataaaataactgaacaggaaaaagtaaggcatataagatgctaattcatcagctaaagggggaatacatgaaggcttttttttttttgagacggagtctcgctctgtcgcccaggctggagtgcagtggcatgatctcggctcactgcaatctcctccttctgggttcatgccattctcctgcctcagcctcccgagtagctgggactacaggcgcccgccaccgcgcccagctaattttttgtatttttttagtagagacggggtttcacgatggtctcgatctcctgacctcgtgatcctcccgccttggcctcccaaagtgctgggattacaggcgtgagccactgtgcctggccccatatttgtattttaagaccaaattaataaaatgcgatttaagagagggcagggaaagttctaaatccatataactcaatgatactcatatttatgtgactctgaaaccatacttgtaatcactattatccagaagagccacatgatgatacgtgccctatggcgtctagtatagttggtagtcagtcgcataagtactcatccctggttgagcaactgttaggtgtgtggcagaggatcccttaaagcaagggtctgtagctccttatatttaggtattctagtttgaagactgttgtcagctcagagggggaggagcttggttaattggacaatggaaggaccaggattatttgccccaagcagctcttggcttcagcctgtctaaacatgaaggatctgatctttagtgatgaatttgtgctgatatcagatatatgtattatatatataatatataatatataaatatatataatatatacttactttttttaatatatatatataatttttttttgagatggagttttgctcttgttgtccaggctggagtgcaatggcgtgatcattgcttactgcaacctccacctcccgggttcaagcggttctcctcccccagcctcccaggtagctgggattacaggcgcccaccaccacgcctggctaattttgtatttttagtagagatggggtttcaccatgttggtcaggctgttctcaaactcctgacttcaggtgatccatctgcctcggtctcccaaagtgctgggattacaggtgtgagccactgcacccagccgataccagatatgttttaattactaaaaaatagacacttttaaggagtatagaaaatttggaaaaaaatgaataattaaaattaagttataattctgctacttagaagtaaccacagctaacattttggcatatttcattttagtctttttcttctggatgtacttattttgtatagttgaaatcatattgtatatataatttggcattctgatttatttacattcatacatatgttccatgtaattaagacattttccgaacataattaattattgcataataatccttgggcggtaccataattttattcaacttctctcttattgctgttcatttggattgcccgatgtgtagtgtaaataatgccactataagactcttgtaatttagtttttgtgcacctctcagattatttccgtaggattcctagaagtagaattactgggttaaggagtataaacattttaaggttttgatgtatagtattcataaaagttgtctcattaagtgacatatcagataggatacaataaaaaaatagctttaagcagacatttataaaaagaagtatatatcttgctcagagataaaaccgaaagcagttttaagaggccgaaaaaggacttagttccctttcttatgggttaggtatgggttcatagatattgaatatattattttttaaaaagtcctctggagttggtgatctctctcaggttctttctggctgcaaagttctgttttgtggttcctaaggttcttaagagtgtgagatgcaagtacagagccacaagccccttgagacacatagtctgaatatttaatatctgggctgtaataatgttaggaacaataggaaagaaagaccagtatctaagcaggctggcaaaggaagcgggtctttataaaacaaacacacagaaaattcctaacttcagaacaagaagaaaaattatatagtagattgcttgctcctttaggaggaaaatgttctaaatagaaagttgctttgttgagcaacattctgactgcaagttattggtttctgtttgtgctcacggtaagtacaatactgaattggaatgatttggttatcttctttaaaaaaaggtatttggtatttttacttttcattggtagaaacataattgcctttgcgagatagtggacaaagatcttttgttatgttgttcctaacaaaatgtttccttacagaaaaaatgttcatggatttttttccttgtgatgataatgcagggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagtaagtgagaaacaagtgtaaaaaggcagttaagaataatatcatttctggagtttagttacatattattgctgttaaaaacatctgagttgactactactaaataagacttaaggtgtatgtactctaagctagactctgttttaagtgctttgcatctattaatttaattctcacaacactcccatgaggtagatatatcacctattaataatagacaatccattattatgcttcatctacatttgctttagttcattaacctaagcatttttgaattgtactttgagtgacttttcattaaaaacatcttattttattgacagtatatcttaccagtgactctcatttgtgctattttgaagccaacaatatataaatttgcattacttaaaattttatatttaagtttttgacttttgacttggtgtacacacacgcatatgcatgtacacaactggaacctcttctatatgtacagagagcctcgtgttttgtgtttatgcatagacgcagctttcagttttggtgtttgaatagaaaaatacatgtctgtatatattctcaggtaatattagaaactgggcattttaggggggtgtttaaatcagccatttgtcagtctagtaggctacaatcattttaggactgtagaattaatctaaaaataatatattatgtaaaaatactaaaacagataatctgcttagaaagcttattattaaactttgtctttatttgcctccagagaacacagtttagagatgtattcagttttccatatttagataggttatctaaagatatcctcaaaagaatggtagtgcaatgaattacataattttatccttatcattttgcttgaagaaaaattacttaaatttatttaaatttaacttacaaataatttaaatattgaaatactgagctcataagtttacaattacaggccagattcttccctatgcctaatatttccctaaagcaaattagtcacttagaactctttctggtcaccattgttatctaatgtaataccactccatataaactttgcatttctaaagtattgagcttttgctaaaattatttcttaaagattaaaagcaaaagataaatatctaggtttgtgttttcataatgtctcggtatatttaatttatgactgccctatctctacttcctggggaggctgggattctggtggcttgaaaaatttctttgtttctttttccagaggcggggtctcgctctgtcgcccaggctggaatgcagtgatgtgatcatagctcactgcagccttgaactcctgggctcaagcgatcctctcacctcgggttcctgagttgctgggactacaagtgtgcaccactgtgcctggctttgaaaaatttcttaatcttgaaaaccggtcttcaaagttagtgtttttcaaattgtgagttgctacccattagtgggttgtgactttagcttagtacttggtaaaacaattttctgcaacattgagagagaatggaatagcaaattgcagagtgtttcatactataataaggataaatattgctttgagaaacttttaagttgcctctttctgtgtacacacactcaaacatatatgtatatactggattgcaattcaaaaggtaattttactgtgggctatggtcaaaagagtttgaaaaccaataattgccagttacataaataataagtgtaccatgttcagcacttagagattgatgtggatatgtatagaggaagtccagatcattacatatagacagatttgaatcttggtagaacataggatagatatgttgggtctttgtattttcctggtcttctgtaaacattttatgaaggtaatattttagtaataaaaatttgatgtaggttataataggcatttaattgagttgggagattattagagatactcttgatcctgtctgattgataccaatgtgctttgtggccccttccttttccacgccagaggtatcaaagatagtagacatagaaatgggtttgatttcagttgtggctttgctactgattgtgtagggttgagtgagtcttcaagggccttaattttttcacctctaaaatgagagcttttggattatgtgacacctttaatgttttatcgagatgtttaactctaaatgtatccaatagttacaaaaaattcaaagcagagctaatttaaattaaaaatatgcatttgttgcatgaaacttgtaggcgaaaccatgaaactgagagcttcacaaaatcaaataaggataaggtgttagcacgactgaatggggtctggcactctacttctctttattttgtctcctattccctaatgtcttaattaaatttataaatgtgatcacttcccagggtgcaactgagatctctgaaaaggcctttttttttctgtcctcctcttcagtccaggtgattctcttatacatagtagacaatcagtaaatatctgttgaatgagtctgcagtgtgtttagtgcatagttgtgaattatgaaataaagactttgcagggaacagttaattttgtttatgcactgtaactccagatttataaaacttttttttttttttttgagacggactctcactctgtcgcaaaggcttgagtgcagtggtgacatcttagctcactgcagcctccccgcctcctgggttcaagcgattctcctgcctcagcctcccaagtagctgggattacaggtgtgagccaccatgcccagctaatttttgtattttttagtagagatggggtttcaccatgttggccaggctgttcttgaactcctgacctcgtgatccatctgccttggcctcccaaagtgctgacattacaggcgtgagccaccatgcccagctagatttataatactaatcagcctcttcttaatatagattttgctgcttcccattaacttttgtggttttattttgactgataacatctggaattcagctcatacaagttaaaaatgctctcagtcaacttacctaccatgttggccactgcctgtgaagacttaaaaatagttttaaatagtctcattgttttccatagcctcctgtactagacagagcaagtcccctttatgaaatcatatttgtaacctcatggcaagatctggaacttcacaaaaacattagtgggcttccatgaccttttaacaaagtatatgagtcagcccagctagaaaatgaagaagggacatacaagagttctccaaaggttggaatcattcatgcacattgagttctatttgttgaaactgtatcatgttggtaactcttggatcttggcaagaatatgttgttcagaaagagttactttgtctatgttcttttggatgccccatgatatgaagacaagcccagtaactttgtgatttctggtcatacgaacttttctaggtcattgaatatgccatatttctgtaagggaagcctttgtttctcttctgttaatgaatatattagcaggtcatccagataattgaccacacaactatctttgggcctcagttttcccatctctaaaatggatgaaactaaatgatcctcagggtctcttagaattcttaatattttcttgatattttaattctgtgatcatcttataacatattctaatataaatatattctaatatgaagtattttattttgcattaggctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaaggtaagttatcaatatctttattaaagtttacatttaattaccaggttggtttgttcacttttctgtattcagaataaaaaatgatggaacagccggtgtggtggctcacgcctgtaatcccagcactttgggaggccgaggagggcggatcacaagatcaagagattgagaccattctgaccaacatggtgaaaccccgtctctactaaaaatacaaaaattatcagggtgtggtggtgcatgcctgtagtcccagctacttgggaggctgaggcaggagaatagcttgaacccgggaggcggaggttgcagtgagccgagatcgcacccctgcacttcagcctggcaaaagagtgagactccgtctcaagaaaaaagatggaacattgtgattttattcatggaatgtgaatgcaaatctaaattattgaatacaagacacattaaaattgagcacagtttttaatgtaaagaaaattaagtgttcctttggtatacctcctgtgcctaactgttatgctgtagtattttaatattgttgagaatatttagtgtgcaaatatcgtttgtattgatttattttttattgaggggctaccttatatatatttatatggatgagagaaaataatttcctggaattatctgacttgtgtgaattagagtgtggtgttaacactgaaaaatatcaatatttcttgccattcaactccatcaacagtaggaaaagcttcaattatgatgaacctctctttggatcactgggctaatttgggagaaacagggacagaactggagcaaaaccaccaggtggattatactaatttcaaattggaactaatatctgataagaggacacatgctagagaataattttttatttaagagcattataaaaatgtgcatttttgttcatatgattaccattcttttgtgctttttgtgtcttaatttttctggtcttatgtttagaaagttaatataagttactgggaaaatcggctcaattctggggcttaaaaattgtgaccaggccaagttagaacgtgtctgggcatgtagatgaatgtggttggtggggagatggagattttattgtgtaaaatggctaacctggattccatggagaagttctgacctttttctgtgagcccaaaatggagaaatgaaaattttgaagttggggggagggtctcaggtataaatatgatctgcattcttcttcctttttttttttttttttttttttttgagacggagtttcactccgttgcccagggtggagtgcagtggtgtgatctcagctcactgcaacttccgcctcctggattgaaatgattctcctgcctcagcctcctgagtagctggaattaaaggcgtgcaccaccacgcccagctaatttttttttgtatttttagtagagatggggtttcaccatgttggcaagtctgtctcaaaccccagacctgaggtgatccacctgccttggccacccaaagtgctgggattacaggcatgagccactgcgcctggcttgcattcttttaagtatagaaatgtttagttttgcctcactgcagcattgtcacctgaactagggtatttttccatagaaaattttcaagttatattgtagtcaaaaatatattggttggataaattacagtataactgaatgttgagcattctaataagtaaaataatcctcatatgagtattattttctagctttcagagattgttcgtgagttcaagtcgactaaccgcttgctcctaactggaacacctttgcagaataacctgcatgaactgtgggccttactcaactttttattgcctgatgtctttaattctgcagatgtaagtttaagccatacgttttaagtataactttcttattttcactgacatgtgttttaaaacattatagattgaaatttatggtactttttaatttgtaattttttatctgcatgttttggttttcttaggaaagagttctttaatagagttttaaaatgaggatctttggagaaatagtatgcttcttgtctttgagatcaacttgcctgttcaattttgtctctatcacattactcctaaaacttatgatgtgaggctgagtccatagtagtgcattcaccattttattttcattaagttgaaggggtttgaaacatatttttatatactagtttggcaggtggaagctataaaatgatctttgattattgtaggcattgacatttggtgagtgctaaagagctcagagtatgtgatttgaaagacagcatattgtgtaaatgtgttatttatatatatatatttttatcattaacacaaatttatgctaggacaccaaactaaatggaaagatttaagaactttggtgcttgatttttcccattattattattattactattttgagagggagtctcactctgtcccccaggctggagtacagtggcacaatctcagctctctgcaacctccgcctcccgggttaaagtgattctccttcctcagcctccccagtagctgggattacaggtgcccgtcaccacacctggctaattttttgtatttttagtagagacagggttttgccatgttggtcaggctggtctcgaactcctgacctcaagtggtctgcccacctcagcctcccaaagtgctgggattacaggtgtgagccaccgtacctggccccattatgactgttaattgataataaaaagtagcaagtttggccataagttgctttgcacactttatcttgcttttgtttgttttattgtttggtaaaattaacattcttattagcattatgtctttgattttatattctacttttcaaactagatataatattgctacagtatggggaagcctaataaatgtcttttaaggaaaaagttgatggaattcttacacagtggggctcaaattttgttaactgctccagtattttacctattttcagaagtaaataatagtagctatcacagctgataatatttttgaaagtactttttaaatgcattatttccgtattggttgtataagaatctacagaatatcgggtatatttaaaaaaactgtgcactcattggagaatttccacccctctacaggactttgattcttggtttgacactaaaaattgtcttggtgatcaaaaactcgtggaaagacttcatgcagtaagtaatagcagacaagaacattcagtaattaaatagtatacacaaactgacccagaaaacaaaatgctatggaatctgtttgaacttgtgtttgcctcttggctcaatgtcactgtttctccctcctaacctttctgacagcctctttgttttttttttttttttttttttttttttttttattcctctatgtcctcagcctctctctagaacagcttttttcctttggctctcccctgtgaataatgtggtcctctccaatagagaggctgttcctgctcccacaccccacagttcctcaggatggtatcggtattctcctagttcacccactgccacttctaagctactgcttctccactgtcatgtataaagctcttcctttgaagcctaagctgtcttgcagttttatcctccacccattctgtttcctgttaatctgttcatcattgggtggctccttaacacattgtatgccaggctggagtgcagtggcatgatcttggcacactgcaaagtccgcctcccgagctcaagcaatcctcctgcctcagcctcccgagtagctgggattacaggcgtgtgccaccacgcccggctaatttttgtatttttagtagagatggggtttcaccatgttggccaggctgatctcgaactcctgacctcaggtaatctgcccgcctgggcctcccaaagtgctgggattacaggcgtgagccactgcatccgacctttcttttcttttctttttttttttttttttgagagagagtctcgctctatagcccaggctgctggagttcagtggcatgatcttggctcactgcaacttctgcctcccgggttcaagcgattctcttgcctcagcctcccaagtagctgggactaaaggcacgtgccaccacgcccggctaatttttgtatttttagtagagacgggttttcaccatgttggccaggctggtctcgaactcctgacctcatgatccacccatcttggcctcccaaagtgctgagattacaggcgagaaccactgtgcctggccccaactttctattctttgatcgcaatttctcatctctttctagtgctttcgttcatgttaatccttctgtacttgtcctgttacctcacagagacctctaatccccagacctctgcattttctccccatctatcagcttatttctgttgtgacttttttctgtatccagcaatgaactcattttctatcacttgaaccatctttggctagtactcctaaactcccttgctcccttctccgtctgccatacctgcctaaaaaccgtaacctggaataatgtaatgtaactgtctctctgtcttctgggcttcaattttgcttctgctgcttactagcagagtggacatctctgtattggggcagcccaacactggtaaagaagatttcacaactgtccaggttggaaccactgtgattccatgttctctaacataagctgagatgtcatgatactggtgatccttcagcatggccttctacagtcttctttcctgtttcctataacaactatttcagaccttccccagtctccccaagatttctatcccaggtatctcctgccctccttctccctcatcaggtaacatcattcctttctcaaaaagaaaaaagaagacattaggtaggaagtccttcaaggatgtccaccttctaaggaggtctgcatctgtgttaccttctgtttgagtggaagaggtgtcttttctctggtcagtggctaattcttccatgtgaatccttgatctcatctcttcctattctttatggactttcccccatgatttatctttttagttgactatattttctacctctttttaattgactatattttctatctttttaactgactgtattttctacctctccatccatattgggtcttttccctaagtgtaaacatgctcaggtgtctcccttattaattccaaatccaaacacgtacccatccaccctcacacatatgcaaaacagtgctccctcaacactgtgtccctctggctgtgattccgttttcttcccttgatagctaagctccttgaaagagtagtttatcctctccatatctactccctagtctcctgtttactcttgaatccattggccactggcttctatccattccatacaactgaaatttgtctcacagtgtcttcaatgactttccagttgctgaattcagggtacgctttttggtcagtatcttggctattgctttgaagctgctaactatctcctcctgctggaaactttgctgcttggtttctaggatactgttctcttttggattttcttttaccctttgtccacccctatcagtccctttcgtgggcttttctttctttgactgtctcttataaagtttaacattttataaggctttgtctttgactttcgtacatgctctccctggggatccactcccatggttttacctaccacctatatactgacgcctcctaaattgacctctctgtatccttctcctaagcactatactttcatatcccattgccttcggagtctttttgcttaagtatctcacaggcagtttaaactcttaaggatatcttttagaaaactttgaggctcacaccagaagccagaagtcttcttttactcttcccctgtccttacctcccatagatctctaataataatagctacagtttattgtctgctatatacttaagttctacacatgtaccaccacaaatttccacagcagacttggaaataggtatcattatccccatttaaaaatgtttggccgggcagggtggctcacacctgtaatcccagcactttgggaggccgaggcgggtggatcatgaggtcaagagattgagaccatcctggccaacatggtgaaaccacatctctactaaaaatacaaaaaattagctgggcgtggtggctcgcgcctatagtcccagctactcgggaggctgaggtaggagaatggcttgaacctgggagacggaggttgcagtgagccgagatctcaccactgcatttcagcctggtgacagagtgagactctgtccccttccaccccacctccccccccaaaaaaagtttggcgggccgggcgcagtggctcacgcctgtaatcctagcactttgggaggtcgaggcgggcagattgcctgagctcaggagttcgagaccagcctgggcaacatggtgaaacctcatctctactaaaataggaaaaattagccgagcgtggtggcgtgcgcctgtagtcccagctacttgggaggctaaggcaggagaattgcttgaacctgggaggcggaggttgcagtgagctgagattgccccactgcattccagcctgggtgacagagcgagactctgtctcaaaaaaaaaaaaaagtttggtatatacacatatcatatatttgtttttggatgaaccgatgaggaaataggcttggaaaaattagagaactttcctaggctcacaacagctagtcaggactgagctgattttagaattagcctgatctgggtttgaattccacatctaccacttgctagcaaagttcctttgatggccttactaaaatagaaatgataacatttctttcagatttatcgtaaggattaaataatacatgtaaagttcatagtatagtatctggcacattgtaggtaggtactctatagattgtagcactattgtcttgtgatataacctgtcttccaggtatacactgactattttatctttttttctctattcatctatattttccttcatattgaatattttctcctcatttatatatttaactacagtcatgcactggcataacagcgttatggtcaacgatggaccgcatagatgatggtggtcccatcagattataatggagcatatatagagacctgatatatggcacttgatactggcattgcagatcaagtaggggaaatgattgatagtgagtaatagtgctgggacacgtggttttctatatgaaaaaacaaataaatacatataccatgtaggtttgtgtaagaacactctatgatcttagcacaatgatgagatcacttaacaacacatttcttagaacatatccccatcattaagtggcacatgatggtactttgaaatgacctgcatttttatttcatttttgaagactccctgatcgatattctgacttcagatttcctctcaggtttaaaaatcttgttgtgggctgggcacagtggctcacgcctgtaatcccagcactttgggaggccaaggtgggtggatcacggggtcaggagttcgagaccagcctggccaacatggtgaaaccctgtctctactaaagatacaaaaatgagccaggcgtggtggtgcatgcctgtaattccagctactcaggaggctgaggcaggagaattgcttgaagccaggaggcggaggttgcagtgagccgagattgtgccattgcactccagcctgggtgacagggtgagactctgtctccaaaaacaaacaaacaaacaaaaaaatcttgtgttacagcagcttcttttttttttttttttaagggttctttggtgcttattcagcaaccaatagtcttgttgtcttaatttttcatgtattttgtgccatgaagtcatgaatgcctactttaggtcccctattctgattttctaatggactcttacttggtggttctttaccaagaaagttcgcaactggtattggtagtatttgtcagactatgcagtgggaagtaaatttcacattaatgttgttaatgaaatacattattaatcatattaaatgtttcataaacttttataaaaatgatcaccttttaggttttaaaaccatttttgttacgccgtataaaaactgatgtagagaagagtctgccacctaaaaaggaaataaagatttacttggggctgagtaagatgcaacgagaatggtgagctatttcatttcctttaaaacttatttgtgtgtaagaatttactaaaaattagctttgtagttgttcagttatgccattagttcaaaaattacattttatatttaaatggcaagttaagtagttcagatattttcagagaaaatttgtaagtattttatttaaccctttgaaaagagtataggttttggagtctatagatctgtgtttgaattccatgcattaccacttaacagctagttatcttgggcaagttacatagcctaaatttccattctgtaaaatggggataataatatttaatttatgaggatggtgttaggattaaagggggtaatgtcagtggcatgcttgttagttaaaaagcattctttaaaagcattctttggccaggtgcagtggcttacatctgtaatcccagcactttgggaggccaaggcaggaggattgtttgagcctaggagttcaagactagcctgggcaacaaagtgagaccccatctctacaaaaaataaaaaataaaattagctgggcattgtggcacacacctgtgtttccagctacatgagaggctgaggcaggaggattactggagcccaggaagtcaaggctgcagtgagccatgtttgtgccactgcactccagggtaggcaacagagtgagaccgtgtctcaaaaaaaaaagcattcttgctttttccttcagtgaaaataattataaccatattactagtgttgatgaaaatgttggtgattgtggatattacaaaaatagaatctggaatggttagataaatgcacttaaagcaggaaattgacaagggaagtcacaaggaatcataagtgggaagtgttaataatgtaatagtgctgctaataggagcaaaatgttacgtatataaatacaattagatcatgtataaaatatatgatttctttactacataagccagtatagggtagagattaagagtatattctttggactcagactaagatcacagcttggttttgtcccttctgtgaccctgagtaagttgtttaacttctcttagctgccttaatttccatctgtaaaatggggatgatactagtaaatactcagaattgttatgaagatttagtggcataattcgtataaagcccttgacatgatacttggcacttgcactcagcaaaagttgataattattataattacatattatcattgatcgggtgtatatatatatgtaagtctctgtgggggtggaattgtagaaaagagaatgaaaaatatttataggatcagaaaaaaatgacctgtgaagacaggtataagaaattgaaattgtttttagttcaaacaagtaaatgttggatgtcaaattcaggcaaatgttgtagttactgataattagcagatagaattctctaaataattgtcaactgatggcagtttcttgtcatggataaagcaggaggaaacaggtttataagcaacacacaagttcacatgttcaaatattcattactttgtaggttttgcccattagatttaatctcaaatcaaatcttgtttatctttaaacaggaatctaatctgatggccaaaggaacatttgtttatgacattaactttctagtaattgatgattaattatagtttaaatttttaggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggtgagtaataaatttttaaattagcatggaataaatttatattaatgacttgtatataaataaaattttccatattcattcattcacttattcagcagacattgttgagtacttaccatttgccaggaattgtcctacaggctgggtgtacaaagatgaataagacaacaatctttgccttggataagctcacagtgtagtgaggaggaatagttgcaattcattgtgataagtgctatgatatgttgagaaactgggagttgggaaagtcttcacagagatgacctttgaggtgagcactggacaatgtgtaggagtgaaccatggggaaaaggaggggaagggttttccagggtaatgaaacagaggcgtgaaacaagggaacacagagagcatatggtacttggggtagagtggcagttgatgaatctggaaagatggatggagccaaattatgaacggtattttaaaccatgccttaaggagttaggacttttattttgaaggcagagggagtgtcagagaagacttggctgtgaagagtgacaatcggagtatgtcactcttacatgttaggaagagaaccttgaaagcagtatgggggtctattgaggatgagagactaggaacaggagactagttgggagactattgctgtagtccagtgagagagcctgtggacccatcattcatccttaagaaaaagtaaaggnnnnnnnnnnnnnnnnnnnnnnnnnnnnnnnnnnnnnnnnnnnnnnnnnnnnnnnattttgaagaccttaaaaaatgccaaactcaacaaatgcataattctatatatagcatctcttgaaggtgtgtgggggtgtgtgtgtgtgtgtgtgtgtgcacgtgtgtgtgtgcgttagtggagtgttcatgtgctctacatttatgttgcatatgtttattttgtagcttttaagttagtttcacacaagttgtacaactcactttttcttggtgaaatgttttaggttcaagggttctcattttcagccagatgactcgcttgctggatattttggaagattattgcatgtggcgtggttatgagtattgtcgactggatggacaaaccccgcatgaagaaagagaggtgaggaagagaaaataaaataagatttcagaaatcagagttcaattaagcaatgtatatcaacattaggtagttttgaacttttgccttttctttaggtgggtgcattgaatttctcattagcatctctttctctcttcaatcttcagtgtggcttccattccattgattctttacaaatcatctttttcaaggtcttcaaagacatcaccacttatctaaagggcactacaccatcccatccttattttctctaatcatgcctatctctgaccttttaaattactaacagtttctcaccttactctctaacctccaatttcatgtcattttcttttcctaatttgccagctatagcagacctttgccatttgtggagtttaatggttgagattttgccagtttataagcaaccctaaagactcatgaagcatagtaatccataaagggaatgatcttggttcttatagagctcttgtaaaaactaaatgtgacaaaataggtataggtatttatcatgaatttaaacattgggacactaaaaggttggcctgcaggaatgagtcacttagtgagtaagcttatctagtatgcagtatttttctcaaacatggaaattcttacagatctttagattattcctcacaaatgtcatgggtctaatgcgtttaataccctttaaagcacttttgcttggaaggctttgctaatttatcttctgttttctgtgatccttcagagctctgtctttggcttctgttttaagtctgtacagcaagtcctcacttaatgtcgttgcaaaaaaaaaaattagctgggtgtggtggcgcgcgtctataatcccagctactcaggaggctgaggcagcagaattgcttgaacctgggaggcggaggttgcattgagccaagatcatggcattgcaccgctccagcctgggtgacataatgagactctgtctaaaaaaaaaaaaaagataggttcttatagaaactgcgacgtcaatcaaaacaatgtatgatgaaatcaattctatcttaggctaattgatataaacaagatttaagttctggccaggtgtgttggctcatgcctgtaataccaacgtttgggattgggaggctgaggcaggaggattgcttgaggctagtcagtaaagactagcctgagcaacatagcgagacccggtctctacaaaaataaaataaaataaaatttaaaaaagcattagtcaggcatggtggcatgcacctgtagtccttgctcctctggaggccgaggcaggaggatggcttgagcccaggagtttgaggctgcagtgagatgtgattgtgccactgcacttcaaactgtgtgacaggacaagaccccagttcctgtggcatatttctggtcacaaagacatcaccaagcttctaaataaagaccaaaacacttataatattaaacatggaaataaatgtgagccatacatacgtttaagaaagattaataaaaacaagtaagataattatttacctgcttattccagttcaggattacagtggttggagcctcttctggcagctcaggaccccaggcaggaactagccctggacagaatgccattccatcacagggcatgctcgcacacacaccactcacactgggaccatgtagacatgccaatttgctttttgtgcacagctttgggctgtgggagggcacagagaaaactcatacagacatggggagcacatgcaaaacccatatggacagtggccctggccaggaattgattgtttttttgtcatcagttttataatgaaatgatgttacttgaggacctgctgtactcatgctttgggtaaagatcatggttttatggtatagtggaaaatgcactgaacttggtttcagaagacctgaattttagcaccaacttcaccactttgcagcgtgtgcaagccatttaattctctgagcctcagtagctgtaattctaaggatagtaacaactaggcttctttctctgacaatgttgtgaggatataataggtatgagcacagttttaaacggcatattgcagtacgtactgcaggtcatgaaattgcacccaggcctttctcccttacacctttagggccccatctcaggctacaaggactctctcttagcccgcatccctctccttctgtagctgcaatgggcactccgttccttgtgtgcctccttattgaagcctgtttctagcatagcatagtgttcacagcaagcacacagacccttttcatattaaaggtcttactgctacctctatggggaaacagttgcaataacatttatacgtatgaggatatttcaaggcttacactattccgtgtgctatagttttttcactctctctgagatggcaacttgaagcgttactgagcttttgctgacttattcctgaggattggtttccctgaatccatactaaataaggccctatggtaccattcaggatgatccttcttcctaggacaaagagaatatcatggcagagcagtacgtgctttctgacctcaaatagccaatttgcatttctgactgagctgtctactgtttacctatttatgtccaaattgttctggtttttaaaaattccaaacaatgttatcccctcagagactctgaatttcatgtattgactttaaatatagcaaagtcagagctgttcctttcttcttggaaatgccctgctttccctttatgttgtccacaccatcatttcatctattttcccaataagaagaagaccacgtttgattccttactttgattgtgtgccagctgtgaataagtaattctttctcaacagctctcagattttccctttctccattactacagctaaattcagctaacaaagccactggtcatcgtctgactcagttcctgtaacctctgcttaattggcctcctcacttttatagggaaaggaactaacatttgtcaagcaactactataagctaggcaacttaaagttccaattgaattctcccagcagcgcggtaaagtattggtataattttctccatttgaaactgtgtctcagagagattaaatacttgcccagaatcacagatgtaatcagtggtgaagttgtgattcatgcccaagtttttgctatttcctctacgccaaggtgcctctcactacaccacgctgctttctatactgccccctttacctgctctgctgactgtgacggtggtagttaccttctctgcctgaaactttgaccatgccatccatttattttaaaaaagattgcccatactttgtgattatgcaagtaatatatgactgctgaaggaagttttgaaattaaatacaagtatttctggcctatctttttaggtatatgtaatatgtataagtaattggtatcagacttcctatactatatgtaaagtacagtatcctgatactatttacttaatattatattgtactttttaatgtccataaaaaataattgtaaaagtaattttaggataatatttcaccctatggatgtactataagtaattcatcccccgattcttgatcgtttaggttgtttcaaaattttcactattataaataatgctatagtgaaagtccttatacataaatctttgtgcacatctctgattatttccttaggataaattcctagaagtggaatttctgggtcaaagggtatgaacatttttaaggctcttgatgcatattgccaaattgctttccagaaaggttgtaccaatttatactcccagcagcaatgtatgagagtgcccgtctcaccgccccctcatcaacattgagtattatcattttttttaaatcttcaaaaatgttattatgttgttttagtttgcatttatttgattactagcgagaatgaacattattattgtgttttctaaccatttgtatttgttctgtgagttgtctgttctttttttctgctcatttttctactggactttgtttttctaattaatttgtatgagatctttatatagtaagaatattcatattaattttaacattctttactaaatatccctggattgtcatcctgattttcttcattacttacctgcttgttccttgttaccatactgatagaaatcttcttactttcccctttatccgttgccctcattcccatttgtaaaccattttctctgttggttgatcttctaaactaatcattcataagctaatggaaatgaagttgagatttctgatattttacctcctagatatatttcagctctcactcaaaacgttttcattattattgtttttaaataatgtaaatgaattattacttgcttagttaaatttgtgtatgtaattgttctaaatttgtatctatcgatgtaagcttttaaagattaggaacttcatttatataatatactttctacagaaattcacacagtacagtatatgtatagatgcttacatatttttgaagatggaagaatattataaagtatatttataaggaatattataaagtgtgtgaagattttctatatgtattttaaatgtttttatttgtttcttaaggaccctgatggtctaattttatttttctctttttcttctatccctttatcaataaaaaataaaggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggttagtaatctttaatggtgtcagaaatttatcatagctctgaatactattgctatttacacacataaaggtcatttatgataaaaaggtaacaatttttgagagattttatagaagttacagtagattatcctggaaaacacagttgctatgctaattgcaaaaacaaaagaaatgaaagcgaacaacaaacacaccccagatccaacttatagcatttatgtgttgattttggtttttttcatgaaatagaaatgtcagttttttcccattcctacagattgaagaggacacataaatttgttttaatgaaaaggattaaaaaacaatctcttgttattattctgttcaacaactaaatatattaaaatccttagtactgaaattaagagaggtaggattttaactttcataaaaaacaatttgggagagaaggcaaaaaggtaagaaaggaatatattccagaaaaacacttgctacttaataatgataccatgcaaaagctattctacacttaaaaacatttttttttagggagcaaagtttctctgacctttcatcatgacactacaggtaacccctttgatattttggtgtcatttattgaactagagctacaacttctctcaatgtgactcacattttcagataaagaaatataatttagaagtaaaaagatgcaaaataacttcttaggttttgaatatatagctatggataagtgtctttttgggagcaatgaaaagtcatatgccaatgaggtataacttagaaggctttccttttataatagagaattgaaagggattgaccactgggacattccaaaatcaatatgctttggcgtaattattattgcattacgatggtattgaactacctgtttgatatgactaactaggagtaagccccagtaagttacagtgttactgaactggaaaatctaatagtgatagcacttcatttccgtagaagtcttagtgtgcatcccatctttcaggatttgctggttcaggtttaatgtaaatatgtgcaggggattgcattctgtttgaaaaatgtgctgtgttgaaactttgttactaggctctagtgtttttatatttagtacaaggcctgttttgaacttacattttttttttctctaccaccctcctccctttacctatttgctctagcagcttctgtgttttaaaaatactctccctagatggttttataccactagaagttcgccacctgtcacctgtaccaactataaaccataggaccagtcctaggctactgaatagtaaggatagtaatatcccattaatttttataactctttactgcatatccctcagtaagcagaaagaagtgcctgatgatgaaataaagcagacttttgccaccatagcaaccctaactacttaataaaattccttgctagtttcgaagatgtttatatttagtggcttaaagttacttagtaactcaatccagaaactttcagctccctcttttattcatcttacaggtgctttgccctttgtcctggaagtttcccattaatggtacaatataatatttgcagatttctttgttcccagtggtctttagatattctcaatattcatcatgctcttttccaaagtgtcagatctagagaaaaataactaattttatttttagaattttatagcatatgatggctctaaattttatccagaatatccaatatcttacattagaactctttctactaggatcgagcacatcgtattggtcagaagaaaccagtacgtgtattccgtctcatcactgacaacactgttgaagagaggattgtagaaagagctgagataaaactgagactcgattcaattgttatacaacaaggtatttatacatagaaacttaattaggtgttttttgtaaaacacatgtagttttcttcaaaggagattacttttaataaaagttgaccaaaatttgaaaacttagaggaaaaattgaaacatcactgtgtatcccatgagtctgtacaattgttatgtatcacctaaaaataaaaggaaaaaatttaaaaatgctaattgaggctgggtgaggtaggtcatgcctgtaatcccagcactttgggaggccgaggcgggtggatcacctgagatcaggagtttgagaccagcctggccaacatggtgaatccctgtctctactaaaaatacaaaaaattagccgggtgtggtggcgtgcaccagtagtcccagctactcaggaggctgaggcaggagaattgcttgaacctgggaggtggaggttgcagtgagccgagatcgcgccactgcactccgccttgggcgacagagcaagacactgtctcaaaaacaaacaaacaaacaaacaaacgaacaaaaaatgctaattgaaatcttctgaattgaaaccctggcatttgatatatggagtagttgaacatcactagcttattcttgaatgtcagtagcatgctttttgaagtacctgagattatttagcagataaaatggctacttttaaatttttgaaaacatattagagggtaccttttcatatagagaagtttgatctgaaaacagagtttgaacatgaaaaaaagtttctgtccttctgggttttaactgagttttacagaagggaatttatatagaaatagaaagtatgctagaagaaaaacttgtagggtttattaaacaaataaccttaatgctcactaattttttgttctttaaagctttatgtgtggttaaatgtgataatgtctgattagaatgattatgccttctttggaatatgattgattgaatatgtacaatttcaatttttatcattaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaaggttagttaaaatagcattttattttcatgctggattgttttaatatcaacatacttcagcatacttatattttcattgtacatgtttatctgcattatctacatgtttcaggtagctcatattctctccaacaacttgtagatctatttccaggggtagattaaggctttaaaacttttttttggtgagaaagactaagaaccagagtttaaaattgagtgaccttatatctaatgctttattgaaaatactatatctaaaagccaagtaaattttgtgtttaatcacatgtataaggaatgcttttttttttttttttttttttaaagagacagggttttgctctgtcacccaggctggagtgcagtggtgcaatgataactcactgtagtctccacctcctgggctgaagtgatcctcccacctcagcctcctgagtagctgggaccacaggcatgtaccaacatgcacatctaattaattttcttttttagagacagggccttgctgtgttgcccagactgatcttgaacctctggccccaagtgagcctcccacctctgcctcccaaagcactgagattataggcatgagccaccatgcctgaccaggactgtatttttataatcttttttttttttttttttttgcactggactagaaatcatctactgatacattggttaattgaaaatcttttataaaacatttcatgaaatgctaaatcactatttgttaaagcataataagttgtttcagaatattgtaattttgtgtttagttcaccttcccctctccacaaattatggataattttaaacataagtaaaagtagacagagtagtataatgagccccgaagtacttatcacctgtttctaacaaccatcaaccagtcctgttctgtctatatccccagttatctttcccctccttggattattttgaagcaaatctcagacatacttcagctgtaaatagttcactgtgtatttctaaaatagaaggactctttaaagataatcattataacattgtctcacctgaaaaaccccaataattctttaataacaccaaatatccagttagtattcaaatttacaattgtgtcataaatatttatacttaaaaagttttcttttcatttttaaatcagaatgcaaatcaaaatacaaattgccatggttgagatttcatctctatcttttaaaatctataggccccctctcctgccatgtattgtattccttgtaatttatttgatgaaaagactaggttgtttgccttttgagttaatcacagtgtggattttgctgatttcatctccatggtgtattttactatgtttgttgcatatcttgtaaactggttgaatttgcttttcagaagaattttgtagttcaggtaataacctgcattttaaataatcttgtgttaatatgtttcataccagtatgcaaaatgtgtatttttagtccatctttgcctttctcttagctttagctatttgtcccatttaaattatgcaagagcaattataatgtgggtacaacttcactgacaaaagattttaaagaaagcctaagtgagagtacttgggaagcaccatttaaatatttgaaatacttgggcaagtaaaatttgcacttcaggtttgatgttagcattgcattcataccttgtaaattagcagactggatatttcatgtcaaaacctgactattaaaaaggtagagaatccacagacttttacaagtaattcagtgataattttctcatttcaatgttttcacctttagactgcagagatgaatgaacgcctgcaaaaaatgggagagtcttctctaagaaattttagaatggacattgaacaaagtttatacaaatttgagggagaagattatagagaaaaacagaaggtaactttttactctcaaccattagaccctcaaatgagcatttctccccataacaattataaaataacactggcacttacctattataataccctgctctagagtgaaatttgatataggtctaaatatctcatgcaaggtatatctttcgtttattttattggtttatcgtcgtcgtcgtcatcatcatcatcatcatcatcatcaatttttgctgttgctgctgctgctgctactactactactactgcttagtactacttttgttattgagaagcagtgtaggattgaggttgaattcctgaattctggagctgaaatctcaactcttgtcactaattaagtgactctgggtattctcaattttctcatttatcaaatggaggttataatagttacatcatagagggattctgatgatgaaatgagttaatactcataaagttattagaataatgcctgacacttaatgttaactgtatgaataataatattagtaacatttagttacttaaatgcagaaggactttgttacatgtggtctgttgaagaaatgggggttttatttatcttgttttttaaactgaaattaaggctgagattttaaaactttttatttttaaattactttagacttacaaaatagttgtaaaaatagtacagagctaacctatagccttcactcagcttcccctaatattaacaatttacatgttagtataatgatcacaaccaggaaattaacaccagtttttctcctaatgtcctttcctgtgccaggaaaaggacattggttaattatctaattaactggtgttagattccaggggatctaatctagtatcccacagtgcatttttaaaaaaatagactttattattttttccttctatttttagttgacacatactaattgtacatatttatgggatacagagtgatattttgttacatatatacaatgtgtaatgatcaaatcagggtaactggtatatctactgtcttagcacatttgtgttgctgtaaagggatacctgaggcttggtagtttataaagaaaagaggtttatttggctcatggttctacaggctgtaagagaagcatggtatcaacatctgcttctggtgagggcctcagcctgctttcacttatggcagaaggcaaaggagagctggtgtgtgcagagaccacatggcagagacagagagagagagacagtaccagagagaggagggaaatgctaggctctttgtcaggaactaatagaatgagagaactcactcattacctcgaggactacaccaagcccttcatgagagatctgcccctatgacccaaacacttcctattgggccccacctccaacactggggatcaaatttccatgtgagatttggaggacaaacatatccaaactatagcattctgcccctggcctcccaaatctcatgcccttctcacattgcagattataatcattccatcccaatggtcctcaaaagtcttaatttgttccagcatcagctaaaaagtccaaagtctcatctcagtctcaatgcaagttccttacagctgtgagcctataaaaccaaaaacaagatatttatttctaagatacaatggttatataggcattgggtaaacatttccattctgaaagggataaatcagcctaatgagaggggtaccaagccccatgcaagtccaaaacccagcattaaagctccaaaatgatctcccttgactctgtttcccccatcctgggcacactagtgtgagaaatggggtcccgagcccttgggcagccctgcctccagggctttgctgggtacagcccacgtggctgttctcatgaattagagtatggtgcctgcagcttttccagataggagttgcttgatgctggtggctctgtaattctagggtccctgcaacacccccaattccactaggcagtgcccttgttggggactttgtgtaggagttccaacctcacatttccactcagcattgccttagtagagtcgctccacagggcagcgcccctgtggcaggcttctgcctggtaatccaggctttccaatacattgtctgccatttttccctctgtaattgataaataccttgtggggagatctttctcagacttttactcactgattttagcatgtactggtggagcttgcctgcagtagttattattgtggtgtttgcctaatggtaattttgtattttcttcattccatctatatgtatttattaattgatatttttctgtgtggaagatctaccccttctccccaatttatttgtgtcttcagttatttatttatatcagtatggactcatggatgttttgagttataatccagttctatctttatatattttgttgctcaaattgctctataaagctgttatatttttgaactgacagaaatgaattttcttaaaataaaaaagctcattcttaggtacttattttactgaaaaatgagaggtgagacattttggttttgcactgtagctagtatgctgataatgctttgtttctgttactgcttctgatagcttttagtttcttgatttgtatttgtcaggttgtcctatctctaatcttcacttagacggcttatattttatcctgctgagatggaggtgatggcctatctgcacagggtggaaattgcctttctaatatgcttttgagatctcattatgtgatataagttttattaattttacaattattcctgcagacttatggataataggagtgttttatgaagtggaaaaattttaaacaatgaagtctaaataccagtggagcttcttatccacatttttagagaaaaattagtaaaatacttggctatctgtaactggtttccttgtgcttctaattttagcaaagtaatgatgcgtaaagagaattttaataaccatgatgacttgtatttttataattaaatgtctgacagtaacagtggtgtccagaatcacatttttttctgaatattctgagctgagattatattttatttctgcctctttgtgttttctagataggttcttaaaataggtttaaattatcttttgaggagaagtgaaaacttgaaagaatatcatttttaaatcatggaaactatacattgaggtagattttcatatatggtttgttgaatcagttgcattacttttacaaccatacctggtaaattaaatcatgatggctgtgatcctgaataaattaacccagataagttagcattaatgtactcttatgtaaagtaaactaattcggtatgatttattcttttttttgaaagttgaggaattggccttcaatgtttgtttcaaatttgaatgcctagaccatcaaacaagtataggttaaatagctaaatacatcacttgtagaatgttggtttaaattattattaatttatttttactccaattgagaaagataaaatattggttatttataaaatatctctttcattactgtcgcttcacattaatccatctgaaggaaaagcgaaatttgtttcattgctgtgggaatttctcattttacttaataatctcattataatatcggtatctcaggctcttagagttagaaggtcatttatgttaagtttcttgtaattaagaaatctcatctttagcatccaagacagatatgcagcctctgaacactgtagtgttgggaatcttatccctctcagggtagtttgtttcactgttttatattctctggttctcagaaaactttttatttgagttacaagttccttgatgaaagagattattttattcatgtgtatatcactgacactgacttgcacataatacagtaggtaattaatgaatagttaaattatattgagtagccatctactttctctaactttccacattgattttaatcttatggatcaatgaaggactgtgttcttttctatttgatagactttcatatgcgaatgtcaccgttgtgtctgtctttagtcattacttctctagacactgtgagaatttgtagatctctaaccatactggtcatcttggtttattatccactcttaaaatacgatgccaaggttggaattcagcccttagattagatcaagtagagtgagacaactaatggtggattaatgcccccttttatgtaaagatactaggctaaggacagaaataaagaaaaatatgaattaggaagccatttctcagactccagaacattgtagtgtcagttttgtctgttgactgttaaattatattttctagctgataatagggtaaaattggtaatgctgccaaatcatggttgatgctactttggatgtttaataatatcttgcatttaactcttggcagtttacttaatgctttcacatatatgatcatatgtaatcctcaaggtaagtattattattctcattttgcaggtggaaaaaaataatttccccaaagttatataactagtgaagtagcagaatcctggtctttctgtttccaccacttttccaactctgccatacctgtgtttccagaaggtctcatttgaatatttctcttgatttgaagggatatatgcttatcatgttgacatttattatttacccctttcatctgtttctttcttttttttcttcttttttaaatttttttaaattatactttaagttttagggtacatgtgcacattgtgcaggttagttacatatgtatacatgtgccatgctggtgcgctgcacccactaactcgtcatttagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatatgtgtgcatgtgtcttcatagcagcaagatttatattcctttgggtatatacctagtaatgggatggctgggtcaaatggtatttctagttctagatccctgaggaatcgccacactgacttccacaagggttgaactagttacagtcccaccaacagtgtaaaagtgttcctatttccccacatcctctccagcacctgttgtttcctgacttttcaatgattgccattctaactggtgtgagatggtatctcattgtggttttgatttgcatttctctgatggccagtgatgatgagcattttttcatgtgttttttggctgcataaatgtcttctaattcatgcacgtattacagttaccacagtcaatgttactcttccgtctatattagctaccttttatttatttaatttgaccaaaaaaaaccagattgtacagattcttctcaatcaccaaggaagaactaactttaaaagctactttcaaataaaaataaagaaaactgtctttgcatctaaacttggtgtaccactatgttttggaactttggaggtaaattgtgatttataaggcaagttttgattcttcctgatggcttttgcttccttatgtttctgcagcctcgatgtacttgattttgataaaactgttgtttggagtcattaaaccccttgttgttgtttgttgtgtatagcttggcatggtggaatggattgaacctcctaaacgagaacgcaaagcaaactacgcagtggatgcctactttagagaggctttgcgtgtcagcgagccaaagattccaaaggtaaaactgtacaaggccagtttttatgtcctaaagtagatttctgttgcaacatgatctatgggtcagatttacttgtatcattgccaaatcatagtctctaaaatataacagtacaaaaaagtatctgatttggcccagccatataaatggattttattgtatttattgttccatatatcacagaaatagtaaaagataagtaagtttacttcatgtactgaaaagaagtatatataatacattttcctccctcataggctccacggcctccaaaacagccaaatgttcaggattttcaatttttcccaccacgcttatttgagctcctggaaaaggaaattctttattatcggaagacaataggctataaggtattttttccattttttaagattaatataatataatctttaaaaataatttaatctgttaatctagactagaaggtgttgcattttaatttgagagaatgtgacagcaaatcacaacagtgatgtttttaaaaccaaagaggaagtttaactagatgtaaaacatctaaccactgaatcaccagtacagtcatcactaaatgagattaatgaagaattatgcaatattttgaaatagtaataacattatttttataatgccagtgtttgaatagttaaagaatatgtagagagaacaataggtatgcggttaaaagcgaatgttaatatatgataggaaatttttgatcatttccttaataggtccaagaaatagtatttctgtctttattgcctatacgttgctgaaagccttgctggtggttagtagattgtagtcacttaggtgttaaagataatgataaacatgatagtgaattatacaattttaaaatgatcttttggtatttggaattcttatttatataggtagatagaatcctagttttcatgagtgaaatttaatatttgtcacactaaatctgtcatattgggagagtaagcataccaggtaatttctgtatgttgaaattgacttcctagtgaatggagagagatgaccaaaggtataataatcactaacattaaaaaattataaaatactggccgggtgcagtggctcatgcctgtaatcccagcactttgggaggccgaggcagaaggatcagttgaggtcaggagtatgagaccagccttgccaacatggcaaaaccccgtctctactaaaaatgcaaaaattagctgggtgcggtggcaagcgcctataatcccagctactcgggaggctgaggcaggagaatcgcttgatcctgggaggtgaaggttgcagtgagctgagatcgcgccactgcactccagcctgggcgacagagggagactctgtcccaaaaataaaataaaataaaataaaataaaataaaataaaataaaataaaataaaataaaatattaacactattttaattttatgaagtgttctgttttatgaattaacagctgtgttttaaattttattttgtaaacctttgtcacaactggaactgtgacccattattttaattagtagctggaatgtgcctagaaaagctccatgtatataagatacttatatcttaactcattatattttggaactagagtagatctctagggtgaacattcatataagacataaaactagtttcaaagaaagtgaaaacagtgatacaccagaagaaacaggtaagttataggttcaaatataaaataaaaataggaaaattaatgataattattaacaataattattaattgtttaataatgaagtagttatcttgtgaggtaaacaaatacatatcatctcattaaggtttataataatttgaggtttagaatattattttctgttacgttcattaactgttgttagtgagacttgaaaggagaattaattgaaatgttagacctcagtaataaatcaaatatttgcatagaacattttataatttacaaagtgctttaacacatactgaggtcgttgattcctaacaacctcatgaagtaggtgttattatcatctccatttaataggtgaggaaactgaagttcagagaggttaaatgaccttgttcaagatcatggaactaacagggttgccatgggtcctggtctcacaaccagtttctcagtattcagatgttctattcgttccgctcagacgttctgggctctttctgcatgcgatgtaaccctgcttctttctgcagtcctaaataaggactgtgtttacaatggtgtggcatgacatttgggagttgggccaagtggtagtcaagtagcaacaattaaaaaaatcatctctgatataactttatgctccttctttggagatactgaaattttgttccccatgataatttacagtgaccaccacattctggccaccggtctggtttgaatataaacagtgcctttcattacaggcagtttgtggttaggggtgaagtcttacagtgactctttgggtggtggccagctggaaggagatggagaagagaggaaacctcagaagatggaggaatgaagggacagctgttaagggtggtagaaaggaaggggaggaggagaggtataagaatagaggaaagggatgaatagggagaggggagatggcatggaattcgtgctattgcaccttattgtttgctcttcctcacttccctgaaagaagcaagaggagagggaaaaagagtaaaaggaggacctttttttaaagtgtaatacctatttattgagcaatcctttgtgccaggtactgggccaagtacttgggataaagcagtgaataagacaaagtctttcatctcatggagcttacattctaatagaggagataggcattagatactacaatgtaatggtggtggcatttgtgtggttctgtgcttacaaggggtgctaatgagggagtataacatgggtatctcatgtggactgggagatcagggaagtgttccctaaggaaatgtcatttaagctgagtttccagagatgtgaatgagctaagtgaagtgtgggagagaaaagctgaggcaggtggcacctcatatgcaaaggtcttgaggtgggaaggaggatgactccttttgggagctttaagaaagccagtgttgttagggactggtgagacacagggtgacttgagatgaggctggtgagtgggtagagtcaaatcatatggagggctttgtaggtcatattaatgaggttgaactttagctttagagtaaaggaaacccactgagatgtttttaaggcagggaggtgggtgggtgggtggtaaagtaatactaatagcagatacttagtccttacatgtgttacttattgttcaagttatttgtaaatgttagctcattatcctcctaacagcctttgaactacatccttattttacagatgaggaaactgaagcatagagaggttgagtcatttgccctgaataatttgctcagggtcatacaacttataaatggtaaattatgatcagatttacaatttttttttgagacagagtctcactttgtcaccaggctggagtgcagtggcgtgatcttggctcactgtaacctctgcctcccgggttcaagggattgattctcctgcctcagcctcccaagtagctgggactacaggtgcatgccactacgcccagctaatttttgtatttttagtagagatggggttttaccatgttggccaggatggtctggatttcttgatctcttgacctacctgccttggcctcccaaagtgctgggattacaggtgtgagccgccacgcccagcccagatttacatttttaaaagatcactttggctgcgatgcagagaatggcaggtttatctagggaaaccagccaggaggctgttgaagtatcaaaatgagagaagatggtggccacttggactgcagtggtggtggtggaaggagaaccaatcccctactactctactcctagccttggactctcttcagccgtatcctagattgcttctgtattgtcttaagacttgccttgatcctccttatgcatgcttagctgaggatttaggtgacaaataagaatacattctggatatttgttctttctggaccttgtctcttccattctttactaggaactatggacctgagctaaggtgggttctttaattgggtggttttttgtttgagttcagagaatagacagatcagcaggcatgttaatcatcttaaaaagctcccttttaaggatgatgtgatatataaccgttagacatatcttctcaaggcatagctagcattgctttatttcccccttgcaccttcagaaaactcatcagggccacaaagtaaatagagcactagtttatcctcaaatgaacaaaacaaaattgctttagtggagttacctggtattctgtgtacacagattctcaaaaagggactctttcccccttttctgcctaaaggattgttagccaaggggagataggtgatgcccatagctgggggcactgtggttcatggttacgttttatctatgttgagtctccaaaggcttattctgttgtgatttggagtggggctagtgaagggcccacaagttttgaagcagttggtagagagtggtttccttgtacttcctggttatttgcatttttattttctgtttttctccccctttccctccctcatattcagcacaaggtcacagcaatattgctgataataagatctggagttaaagagttttgttttatttgaaggtgagagaagtatttgtttcgccctaaccacgtggtggacagcagtacataatgtgcccattcttgctgctatctaagctttgaccttaggcatattcaaaagctgcattgctctttcgacttaaaggagttgttatttaatgcatgcaatcacttggtcactaaaacctttatattggaagaggacgacttaattgaaatttcaattacagcataaaaaatccagaatatctggacgttccattgagtctaaaacctggaatgcaagagttttgccacattcgaagctaaagaaagctatagaacattctaacatttatccccaataaaaaattctttagggacaaatataaacatttgacaaatggaggaagttccataatctttgtgagttttggtaatgtgtcattgtgggccacctactttttcagtggtagaactaaaataatggtgagctgatttcaggttactgcttttattttgtgtggtgtcacatttaattcagtactccatatttcctatgcaatgcttgctaaactcctcctaagaaacaaggccaaaaaaagtttttcactacttcatggaatacatttcttaatcacaaattccttagcatctgagtagaaatccaaataataattgagatttttactttagaaagataacattttatatattgtgttgctggagatcataatgagacatagagtatgaggactttaaatacctcctgggtatctgttcagtactattggtctgtaatttgtctgcttaattctttttttttcttttgagacggagtctcactctcttgctgaggctggagtgcagtggcactgtgtcagctcactgcaacctccatctcctgggttcaagcaattctccttccttagcctcccgagtagctgggattacaggtacccattaccacgcccggctagtttttatatttttaggagagacggggtttcatcatgttggccaggctggtcttgaactcctgacctcaggtgatccacccgccttgacctcccaaagtgctgggattacaagtgtgagccaccgtgcctggcctatctgcttaattcataatgtagtactttgaaatcattccaggaagcttaatgctgatacgaacctcatgaggtaaaaaaaaaaaaatgtatgtcttattaaaatgatgactattaaggtttttttttataggaggtgtattagtctgttttcacactgctgatgaggacatacccgggactgggtaatttataaagaaaagagatttaattgactcacagttccacatgactcgggggcctcacaatcatggtggaaggcaaggaggagcaagtcaggtcctccatgttagaagggaagagagaacttgtgcaggggaattcctctttgtaacaccatcagatctcatgagaattattcactatcacgagaacagcatgggaaagacctgcccccatgattcaattacctctcactgggtccttcccatgacacatgggaattgtgggagctacaatttaagatgaaatttgggtggggacacagccaaaccatatcaggagggagatacaggaatttagaaactttgagccttttctaattctaaacattttagcagctatttgagtaatttctagaattaaaatagcaaacatagctttcatgaagtcattcttgttttgctatgttaattaatatgaccactggatatagaataaattgcagtggattctaaaatctaatggttttataaaatattctgattttgcttttattagaagttgaaaggggaagtttttagtatggggatgtctgcatgggaataaacagttttattttattttatgtgggtatatttattttctgtcatgaattggatgtttataaaatattttcattttgttaaaaatatggtttgttggacatggaaattttgaaaatgtttaagagaaggatatcttaagatcaaagaggtttctttcaattaaaattaaaatttgaaaccaaagtaatttcacataccagcaatttaaggggtctattaacttttaaaactgtatctgtacttttaaaaaaacattatgaaggatttttaaaaatacaaaaatgttgaaataattgtacagtgaacacccatatataccccacatatgtttgacaatttacatcttatggtatttgctttttcaccgatttttccatttctctggccctctatcatacggatatttatcttattattatgcatctcaaagttgcagacataagtacattttacccagaaacacttcaacatgcatgtcattatccagagtcatattttgtttatgattttttaaagtaacatttacatagagtgaaatatataaaccttaagtgtaccattcaatgttttttcacaagtgcatacacttatgtaactcgaactcctcctataaagatatagaccatttctgtcaccccagaaagtgccttttcccagtgaccatatgcactcctcagaggcaaccactgttctgatctttccctccatagattaggtttttaaatttttgttctagaatttcacataaatggaatcatacaatatgtataaggcttgtttcacttagcataatgttttagagattcagccatgttgtcccatgtatctatgtggctccttccttttgattgtggaacacctattccattgtatggataggccacagtttgcttattcattctcttgatggtcatctgggctgttttctggcttttggctatgatgagtaaagctgctgtgaacaatcttgtcaaagtctttgtatagatacattttcctttctttgggtaaatacttaggaatggaattgctggtatgcctgtaattttaacattgggtttagctactgaagagaagttgtttttaatcatgctatgactgggctacatttcattttaaatgtacaccttttccatttccatttgccaccatcctagtccagatgatcatgcgtcatttctagattatgatagtagagcaggttctcttacctgttagtcgctgccccacttcagtccattcagcaaaaggcttccgggtgaaaacactacattttgacactttactcccttgttcaaaagtctgcagcaccttctgtgtagtgtcaagaccctgtaaatctgtctctacccttccttgtttcttatctcttttcaacataaaccccatatgcgccttcctgcacatttctgccttcatgcttttgctcatacccctagcctagaatattctttcttccttctccatctccctagatccttagagttcttaaggtacagctcataattccacaactagtttgtgagctccttgtgggcaaggaccatatctaatataggtagagtttccctcattcaaaaatctgaaatctgacatgttccaaaatccaaaactttttgagctctgacattgcgtccaaaggaaatgctgctcattggagcattttttggatttcggattctcaagttagaaatgctcaacagataagtataatgcaaatattccaaaacccccaaaaatctgaaatctgaaacacttctggtctgaaacatttgggataagggataaaacctatgcttatattccaatcaatacttatcatagttctacaaacataatagacatttagtcaatacctgctaatttgattgcctgatactgatgattacaagtgaatctaatttctcagtatttctttttaatgctcagttaggttttatacctgaagaactattgtacttaatagttaatttttaagttacttttaagttacaatgatatagttccaaactctatgaaatacatataacaatgagaaaaatgcactctaatgtgtattataattacagggtagtaaaaccatgactacctgatgcccctagggaatgagtcatgtgtgcatttcaagcagtggaaggcttactgccagcccttttattttcatgtttaatggaatgctataaagtgtagtacacatgttatgtacttgccctcttaaatcaatgtgcttccttgtagctgcagatgcacatagcgatggtatcaggctttaggctgagagacttcatttgttcctccatacacacagtatagttcagccccatactgctgaaccacattggttatatatgctcactgtgatacactgaggctctgcaggctacagttttgagatacaggtgacaacttgctttcttggagagctgagcttctgtccttatcttttgaactcaagttctcttctcagttttcactgtatttgcagttctgtacccaaaacaccatatatgatttctgttggtcactgctgttgtagtcttttcctccttgaccactggtcctatcatagctatttgtgtgctctactatacccttccctcttatattctctgtttcctcttttttcttcattatcctgttaactttttccaaactttccattttatgtaaaaatgctctctccccttacataccttggcaggcaataaaagcactcctttctttttgcatgttgaactgatcagactgttggatgtaatgttcaggtgcgttgccacttctccattctgctctgtgttgccaggggaatatggattcttttttgttttttaccactaaactttttgtttgttctgtatattacaatagtataagggtagactttgttccagggtataatcatatctgaaatctaatgtggcatttgccagtgagttttaactatggaatatcatgtggcacaagaatggtttttacttcaataggatcatggtagcagaaatgtggagaggaccgtgtgtcattctggctatgattttatattgtttactcttgaaataactctaaagattgatatgtgtatatacagccttagtaattaatttttctcatcagtttactcttagtttatctcttgatttataggttccaaggaatcctgatatcccaaatccagctctggctcaaagagaagagcaaaaaaagattgatggagctgaacctcttacaccagaagagactgaagaaaaggaaaaacttctcacacaagtaaaatattttcaatggctgtaatacttacagtcaatcaatagaaaaaaagaaaatatagatcacactttttattgtatgggcctagtatcctagtgtgacacaccaacaaaactcagggctattttgtaaacatgtttagaccaaatctccttatttttaaaaattgatcttatagaatatgcccttttggaaatagtggatagtatgtatatgcaaaatataagtgtcaagtattagcaatttgacatacattttgccaattataataaggtcagtgaatccacatttgaattctgatagacagtagttattaacatattcttttttgttttttgagacagtctcgctctgtcacccaggccggagtgcagtggtgcgatctgagctcactgtatcctccacctcccaggttcaagtgattctcctgcccaagcctcccgagtagctgggattacaggcacccaccaccgtgcctggctaatttttgtgtttttagtagagatggggttttgccatgttggccaggctggtctcaaactcctgacctcaagtgatccacccacctcggcctcccaaagtgcaactgatactacaggtgtgagtcaccgtgccaagcctgttattaacatattcttgaaaatttaaatttcttttgtttatagatgtgaattgtctcctgaagttatattctactaattttttattaatggaataatttcataattttcaaaattctttttatctttttttataattttcatacaatgatgagagatttctgaagcttttattattattattattatttaaggtgatcattgtataacaattattaaattaggaaggtttccatttgaacaaaatattaatgcttttaagtcattattgctatcatgagttttacgagtgttctacttctaaaataaactatagaagataaaaatttcagcatagaaggcttgcaaaataaacaaaatgtgtaccgtaggacattactttagtatagagggttgccagcaagatttatttattcaacaaattttgaacaatgtgcgatgcatagtagtaggtaattctccacgttaattattgaaagatagtttttatatttgtatattatttattatataggttttttttgctataacgtaattttattgtatggattttcacaaattacattcataagtttttgagccaaatgcctggaagtaataaagtttagtttgaaaatataatggcagatggctgaatattagaacttaccacagaataaaataaaacatttaaatattcatgttctattttcaaaatgtatttcctgaatgtaaaagtaaagttatggctttagaatgctacatgacttggagtatattgtgaatgtacggtataacatgaatatacagtctcaactgagataatattttagtttgtaattagaaatataatcagttttctgcttctcctagtatatgaattcatttttgtccttctctgctgccttaaataattaatctttttcaaaaaaccatggcagtacgtaggaacaaaatgtggggtcatctgaaatctttatcaactaaaagccagggatagagttttgcagtgtctggagtatcacatttatgtgagttggggctcgaggagtggaagacaaattcttggtcttgtgacttcacagacatgctaataatgccaagggaatttaaaacactggctaaagtgttttatgttttagtaaagaaattgagtggctccaataacgttctgcttgtagaagttctatttatgaacataatttagaacagaaattatttattcacactagttcagaatgatgtaaagagctacaattttttttttgcattatcttttggttattcctcagtgttcttttgatttagtgcatccacatttctctcttttaatttatgtaggaacagatctgtgaaaaaaatcattgaagtactagaatatcacgacttcagcatttatatt

SEQ ID NO: 13019 - DNA, 91062 bp, Human
  misc_feature (1)...(91062): n = A,T,C or G
atgtatcagtatacattcattgattgtaacccaatgatatggttcagatttgtgtccctacccaaatctcatgtcaaattgtaatccccaattttggaggaggggcctagtgggaggtgacttgatcatgggggaggacttcccccttggctttctggtggtagtgagttctcatgacatctggttgtttaaaagtgtgtagcacctcccccttctctttctcctgctccagccatgtaggccctgcctgcttcccctttgccttccaccatgattataggtttcctgagacctccccaatcatgcttcctgtacagcctacagaaccaccagcccttctttataaattacccaatctcaggtagttctttatagcaatgccagaattacaccaaggtaccttactattgtatgatgtcaataggagacactgggaatgggatatatgggaacaccctgtattatttcttcaatttttctggacaccaaagctgaaaaatatagtctattaaataaaaaaagtagtgatgatttgattataacatcagtgtagtgatagagatatctataaaaacagcaataaggaattagctgttgtttctattggaaacaaagtcccaggtactcctaacattcttgtggtttgttgcctacattatgtttaaaggacatgctaaatgctaaatttcagttagaagttagtgaaactaaaaatgagatttttcccattatacttaatctgtataaaaggagtatatgaatagaattccatttatacagattaagaatctcctgctctatggtaatattaacgggctaatgttatgaaagtgagtctcagagcgatgaattaagctgttctagctttcaaagagcatatattctatgaccaagaattctaactaagttttgttggaaagctgttggctacattatcacctaactttgggactgatagatggatggaaacatctcatttagcaaaggtgcttccctggccttgtgcaattgcactgtttaggttgctggacaaatccatagtgtaaagctggcctgtatcaagtgacggtcaattcaaacagcaaggcaagttaaaagagggaactccattccacagaaccctagtgtcaaggaacctcccgactggaaaatgactcaacagctaggcggaaaccctggctcagctacaaagagagcaaatttagtcccatttttccttaaacattcaaccctcaaacctgaagagatttgggaaagaagcaaaacgggagggtgggggagagagaacagtcttgttaacagctagtgttaatttaaaaagagaaggaaagggcttatatgaatacatgcttatttcattcccaaagcaaattttcataaatccttagggaaagagagatagtcatttgctaatgtagactctgctttttgattcccaaatgttacagctgtcaccacaacagtttgcccaattatgtggcagggaggggagggggtccagagcaaaggaagtaggaggaagagatgttagagggaacatctgtgcacaagtgcaccataaacacaacaaaatcatggggccaccccactgtttctttgagcgctttctctggttggccccacttctccagtcttttaggagattcccgttctattacgtaggtgagagggcgaaaggttctagctttcaaaattgtgagtggtttggctgtgtgcatacgtgtgtgtgcgcgcgtgtgtgcgtgtgtgtgtgtgtttgcgtgtgtgtctgttggcgggggcgggggtgatggagagagctatgaagggcttagaaagcttcattaccaatttaaaatgtttttgtagtgcttgaatgtttatcttaaaagacaattcctgctctcaaattcagccaaatgaacaatgctgataaggaagatgaagagggtgggaaacccacaggggcaaatggaacagtccatgcagccggggtgacgggggagcgctcggaggaaggacgctatgcagagaaagcccccctggctcttctctctcaatccataatccagcgatgctgcagctgtaaaagcattaatagaaaatcaatccacaacctcgcggggcagcgatcgtcgagcgccgtttccaggctgccttccctggggtcgggagcggccccgctccccccgtggctggcgcggaatgtggtgatccgtcccggggcggggatgacttcatgcagccggagctccgcggcgggagcggaggctgctgctggcaggtggggcgcgggccggcgcgagctgaccgagcactcggcgggcgcggcgggactgcggcccgtggcggcgtgcgcggggacctgcgctgactaggtccggggaaggtaagcagcccggcaccggtgcgccctggccgcactgcgtggagctttccgcttggttaataatggggtttgcagcacggagggaagaaggggagaaccccgctgcattctgcaatgagaaaaggagcaacaactaggatggaaatgttgggcggccaagtgcagaggttggaggagcagtgttactgggcaaacaaagaaggcgttcttgcctctatactcttttgaacgtgatctaccatttcagtgccagattcgcgtagacagtgaagaggactcaaaatttaaaataatttgagttactcttttgctttctgtgccttttaccttcgcttgagtattttgaggatttggagcagtaggtccctggcagcagcctgaggtaatcagaaatcgtccctcttcctgtagtccttggtcctctccctttccagttatcagaatgggtctgtgcccctctcaatggcaaaacacctgcttcaagactgaacctttagaaagagcctctatctggaggggaaacttctcttatctcctggagttcagcttgggttgagcagcacttgacatcgcttcttccttcaattgccattttctctgtcaatcatttcattgatctttttcggagatgctgtgcccattcacagaccaactctcgtcagctcttatccaccacctgggttccatgactgattttgtcaaggtcccaaaaagggcattgcctcacacagatttcttattcggtattctccctgtatactgttacctgtgtccttcccccaaatgcatggaatgaaatatcctgcttgtggccctgtaccaacatgttatcccattaactcccttcgctgtagtcactgtggctacttgaaagctagagaggacagatagaatctactggagtgtgagggatgttccctatgcataggcataggtagaagtaaaaatgtgaatgccagtccatccagtttttcttgaagcaattttagtccagttggattttgagacagctagctgttaagatttgggacaaatcctttccaaaaggcagaggagtccgtttgcctctaggattcctcaagaacctcaaaagagtttccagtgaggttttcctcgtaggcagtcagaaagccaatggagctgcccaatctaagcctctggttgagtatcctctagtttgtcttgccatttgcaggttcctatccctcgtcctaggattttccccacagaccccttgctactgagcccaagtgcctatccttgttgccacctagagatgtacatttgaataatatgctgtgaaatggttaagatggctgttatggggattgcaaacgtgccacttcaccaacagagaacagttgcaataagccagattgtggggtatctgtgtgccaatgttctatttaaaggaagatctgttatctttaaacttaaaattacagagactgtctgactcaacagccatgcaattttattttagtaaattaaattagaagatcaatgaaaaagaggggcagagttggtagcttaaaattttacctctttctttcctcttcaaatattatttttaagcaaagacactagtatggaaaatcgtgttaatcatattatatatcattattgcctttctattacaaatttcgtttttacaaaatgcactttagaaagatttgaatttgtttctttgtctccatcttcagtatatgaggcatagggtgagggtgtagggggtgggcaaagcccactactgagtgatccactccaggaactgccccttggggtcttaataaccttatgttccttttttgttgttgttattatgtgttaaacagggttttggtttgaaatattaacttcttgagattctagaatttttactcagtcacattaactatgaggtaacaaagaacaagatcaacaacaaaccctgtattctaccaccttttttctactattaaaatacttaaccatatacatcattattctgaataatactaatatagaataataatgaattttaatatagttattctaaataacctaaggtatatgaaatacagattagtacaattgatcttagaaatacaatgcagtttctgtaatgttgacagtcacctttctgttgaagagcaagtgcgtgagaatatcctaatgatggttagaaattcgaagtgtctatcatttagtttctgaagaaactaaactctttggcaagaaataggttcaggattaggagactggtgctgcctaaggtggaataatacttgctagtgattttgcaggtgagttgaacccactaagttatggactggagttggagaaatcttgttgagaagaaagaaaacaagttagaaaatttaattttcattttagtacaactgaggaagataatcaaactgaagggattcctgaatttggactttgttgtgtttaaacaagtttgaggaaagtttctaaatttagaaggctaagcagaaatatatgtatgattttatgtctgaaactgatttatgactttatatcctttccttaaaatgtttcctagggagaggaaaaactaattggctggtgttcagaattgaaagaggaatgaaaaatggaaggacgtgcatgattagatgctaaatgattagatactaaatgaactgcaggcacttttgtgtttgacaagatagaactgaagtcagtctactgctctccaattgtgtaaaaaaaaaaaaaaaagttttgtctgctagacagtgttaccagatatttagagagtaaaaatttaggagttaaagttgccctcttctaacaaaatatctttttctggtgctgcattactgccattaactacaattgaaatagccttaagatttgaggctgaggcaggaggattgcttgagcccaggagtctgaggctgcagtgagccatgatggcaccactgtacttcaaccagggcaacagaatgaaaccctgtctcaaattaaaaaataaaaacttttttaaaagttcagaaatgttgaaatggaaaaggaaaaagaatagcaataataaggctcaaatagaaatgtcatttctattcaaccagtgactccactgagaatgggtagaaaaaagtgctattttgaaagttgccaatgacctcttaattgccagatttctataatatttcaccctgttcattttataagtcctcttctatgttattcttggattcaatatttgtgtttaaaaggtaatattaagtactatgtatcaggcactgtgatatctcttaatctaatttgtcactaattcccttaaagtaccccatgcccaacctaaaccaagtggatcttctttccaatttgtaccccatggtggcatgcctatgtgttttcatttattctgttagcccatcctcttacatgtcgaaaccttgttcacctcagatactgactcacttatgaagccttccccatacccatcttccttccccaaccagatgtgcccctctcttgtttaaattcccatagcacattctattttgggttatcctttcatgtgaacatgctttgtctgctcttctaaaaaaaactcttgaaagcagggtctgggaataagtttttattacctgcaactctatggtgtctagctacatatatgtattataggtgttcagcaatttgattttagtgaagaaataagttattttccagagttataaatctatctacctacactcctctaccagccaagttaagttctcaatatatgtgcaaatgctaatttggttttttaaaaatcattatagtaataataaatatactgagagtacattcaaatcattataatctacaaaaggtattatgagcttaaatgtccttaaatggatactaaaagcatggtgagcatagcaaaaccaatctttaatgaagacattgtacctgctttcagtattattgcattgaaggcaccttatgcatatgagcatttatcttgtttcaagccactcatctagggactttcatctttggtatctcatttgatgtttatactatatgtgaattttacactaagaaaactgaggctcagagatgtcacctgaatggcagagattttttccatattaccacccgctctttgaagtgtaacagagtgagggaaaacattgtaaaaacataaagtcagagccatcagaatagtttcaagttgttttgtgattaatctttccagtgctttttaaacttttaggttaacatctcaaacttttgataactcagtaaagtctgtacatcttctccccaagtacatacagaagcatacacatattaattttgcatacaaatgcaggtgtttgtggattcactaaagctctctttacagaatagttaaagaacatctatttgtgctcccttggacaatatgtgtgtcctttattagcccttacatttccagtacttgagatgaggttttccttctgtttttctccttactttaagacctgaaatgagagcccttcaccaacactgacatgaagacagctgatgactaggaagcaagtgctagtgaaaatagtgactcaaagaaccttgattcacaaaaaaggcatggaaagggagctccgaacgttacacattccaaatgacttatttaaggttttccaatcaaagccatttttacaaaaaagaaactgttctcagacttaagagtattgtactaccacatatgtgggaaaacattgccagcagttgattggtatagtttactttggaatatattcagttctcttaggatggacttattaactgtctcaatattaatatttctttatggtaatgccatcttcagtaatatatttgcttttgccaagttaaggaaagaatgataatttatgttcatccctcctaggttctaaaacaagtgccatcctgaaagagctgcatatcattttagattcataaaaatgcattcagattctcagctgatacttaaagggactggtactagcaagcacggttcctgatgtatttaaagagcgttcaaagaggtgtgacaagaacaacattagtctggaaaaaaaaacagagatggaaagatagaaaactcaaaaggacaacttaagctgttaccttctttacatttcccaaatacctttttttgtaccaaaataagattataactatataagtgtctaaaataagtaaaatgttatgaaaactttataatgtgctccatatcaggtaagtttatattttatagattttataattaaaattttttttctggtaaaatatacgtaacatttactattttagctatttttaactgtataattaacaatgttgggcaactatcaccactatcagttttcagaactgtctcattatcacaaacagaaactctatacacattaaacaataaccgttcatttcctcagcccctggtaaacactattctactctctgtgcctatgaatttgcatattctaggtacctcataagtggaatcacttatggaatgttctggaaccctttcatacatatttgtccttttgtctctagcttctttcacttagtataaatgttttcaaagttcatccatatttcagcatgtatcaaaatttcattcccttttaaggctgaatactatttcattgtatgtatataacacatatggtaattttgaattgcaaaacactttcagtacattgtctattacattaaacatggctagcatataacaccaccatattatcttccatagatgtcaagtaatatacactatgaaggtgccataatttatttggtcaaaacccattgaaaaacatttacttaattccaaattgttttgtgacttcaagttatgtggtaataaacagagtatattaatccatatgtctttatatgtcagtacttttacttttgatcaaagaatgcttggagtggaattattgggtcagagattatgcccagatatttatagtttgagtactctagatactgtagtttatagactataaaaatcctaacattctgtaacagatagtattactgaatgttctggaaccctttcatactatcttaaaaatgaatacagatactataaggaaatcaactgaacatgatccgagcaaagaaatattctctcttttttcatttccagttcatggaggaaaaatgctatacacaagtattgagagagaaagtctctcaatcatgcatttttttatcatagatgacaaagtgcatcatagatgtcagttaagtcttgtaataacaatgtggaatagtagaaacatctctagctagtttttagggtttttgtttgtttgtttgcaccagcaataggttatttgcatcaaacctaatctaaaatttggtctgtttgttcagatttatgtacctacattatggtaaatcttttatttttttttcttagtttctctttaatgtattatttttagtttattctgaaatagaataataaagcccagtgataacagtgtcttattgaagctaaactacaaaatatttggcgtatgtgaagtataaacagaattggcaagacttttaaccatcctcctcagcagaagacagtctctattgcatcggccaggagaggagaaacagaaggcttgctggagattgcattagtttttacttaaacattaaaatgctaaaaggacaaagatgaagcaacatgtcttataatatatgtttgagtatctacttaaaactaaagggttgctagaacatttatttagttggacagacacactccacagtgtagctgaccctagacatgtcacaactgcattttaaagtatgctttttcttcagttgattggggtggggggaattattaataaacatttctcctatggtttacctctatctttatggttgtttgattaaaccctctttgaaaagcagacgtaaaacaaatcagcattcttatctttgtctgaataagcaacaccatggccataccttcttaatgcactgctgtggttatgagaccaaagggtagaagcagcagttttttggtcattgcaatagtcacagcaacacaacctgctacattcctcacttatatactgcagaatctgaccaaataaacacagaaaagtcagtaatacctttaatgcaattcttgcacaactctccatgatctttcatacacagcttctctgataattgaaatgtagaggaaaataacctgaatgttaagaccccttttccatttccaaaatgtaattttgctgggacttgcagaaataacattgaatctgaaattagtgggcatccaatggagtcactagaaataatctgtcaaaatcactcaaatacaaatttagatttaaagaccaggaaattctaaagagtaactatggtaatatattaacaatttaggaaaggaacattatacatatatatttatataaatatttatacatatttatatttatacatatatatttatatatatataaatatatataaacatttatatttatatataaatatataaacatttatatttataaatatatataaacatttatatataaatatatataaacgtttatataaacgtttatatatataaatatatataaacatttatatttatatataaatataaataaacatttatatttatatataaatatatgtataaacatttatatttatatataaacatttatatttatatataaatatatgtataaacatttatatttatatataaacatttatatttatatatatataaacatttatatttatatataaatatatatgtttttatatatatgggtttctacttataaggtataatcactggagaataatggatttttagaaatgattcattctgaaaagactattttaccacttttttaaactagtgccatcaaaaataaattgtgacaagtcactgtcatccaagttagtctctcacgtggctctcaaggaagtgagtagttcttggggaaatggctttcttcaaatttgtgctttcctgcagtgagtcaagctgagataaaatggggctgatgttcttaactatttgttacatgcccatatttattagaattacctaataatcagtaaaaaagagttttatgataactaaaaatgtacctattgagactctccattgataaaagttggctaagatacagctggtgatcctgtagaaatctaaattacatttttttcatcttctccatattagagaataactcaggatttcaaagcaaagcatgaaaaagtagcatttgatatattttatcaatgttaagatttctggggagcttatcagcatcatatactaagcattcaataaacgtaaattgttatttcataagtaaaatatcaacagcataaaaatttctgtaactcaaatggccagtatggtacatggctttaatacaggagattacaaaacattagttgaacaacaaaatgaactaataccatttatttctgaaagctaccccccaatacaaaatgattggtattctacacaagctcattgtgattgctttagtatatgtggtaggagtaaattatggatagaactaccctcttccctggttcttttaaaaccatactttcttccctctggggtattataagttggaaattagaggtgaatcatattttagtctggaatttatctagtaagcagttcaagacacttaaccatgcaccatctgtttacccagggcaggaaaacatgacattccccttttcaactatagcagatggggacttttagaaaactcagaatgcaagatagagattataatgatggagtattagtcagcacttcttttgtctgcatctctttttcaatctcattgattgtaaagaacacaatcagagataaagtacagttactgtcaattgaaaatgttttcaacctgcatataggtgtgagatagtgggcctgtcacatcttcacgagatatgttggaatgactatttcaccacaaaattcaaacgtgacactaaaattatctgacactaaacagtccattaaataagaggatgaatgttggcatcttgctcatctatttagaaaagaaaaatcactaacagttttaggcaatacttaaatgtttaaattttttctaataaaatggaaaatgaaataaaatggcattacggtgttatgaaagcaaagcaattaggttaatctcaaaatgtctgactgtaaagttgtaacaattttattcttagagctctcaggcagcttttaatcattttcaagttcaatcaaaaagctctaaccattatcatgaatatattctgatcactgggctttcctcctcccttttgctatttatttttaatttatttatttggggacattttggctaccacttatgtctagatcatgtttttcaggaaatgaatgtgggctttgaatcatacctttaccatttactagctgtgtgatttatacgttactcaacctctgtgagttgtttcctgatatttaaaacaggaaaatcaccgagttgtggtgaagatgaaagaagataacataaaggagaactcagtgaagtgtctgaaatatacatggtaaaggttaatgttttccatttttatcatttttatttccactgacaatttacacagccagacctcattactacatcttttcccaaatgttcatgaattattttttctacccctccccatgtaagttaaacttagccttgaaatgaccctgaatctcactggaaaatgtcttaatgcagacactgccagtgtcaggagaggttgggtccactgtaatgcgaggttgttaggctctgatcagcagtggctgtgggaattaaacctagcttctatatttaactcttcaagtagttgattggatcacctggcaaaagtcaattggctagcaatccttcaccttattttctttgaattgtaccacatgtctaatcactcgtttcactggctcattatcagaaatgatattacgggcattaaataagggtgcttatttcagaagcaaagtgccatataaaataggaatgtcaaaagtctttgaagatcctatttggctaactcaaatagttgttgtttccaatatgcaactattggagaagtttcatattattaagttgtccaaaaacaaaaattaaactaactccattgtaggtcatacttttgttggtctgtgatacatttctattttattgaagcccgaagaatttacagagaccgtgcaagcattattattcagggacttgtttattattaggtgctactgattagatgtgatgaatagcaaaactgttaaacaaaataaaaaaaaaaaatagagcctcacttactgtggaatctttactaggagaaacaccagcctataaaagttgcatttttaatgacatatttacattagtatgatgacaatttttgttgggcttgaaaagcacacaattttacattttatttttcttatatggatttctgttattgatatgggccatttgggttttaaaaaacaagtacaaaaactgtgtaggaccttatatttaatatgtaaatcacatttatttacaggggagaattttgtggtgagcaagaactgcagccaaatttgtgataatttattgcagttggtagagtctcttcatgtattcctgggaacagaataacttcactctttcacgtaaaaagtataaatcatcagtgtaagtttgtcttaaatttccaagccaatattgttaatccctatttaaatactgaactgattggctgtttaccaaaggcttgaggggtaaatttggggcatagtctgaattaagatgagatgttggaaacaatgaaaatacctgctttaaacatgtatgtacatacaagtatacacatatattacacatattttatgtatattataaactataattatgtatatgtgtatctatgtatgtattcattaatattttcttcctatttcaaatatttgattccttgaaagttggatttcatttaaaataaagagacaagtgcttggaaaagcatgtgaaaaatctttgtttccagagccaagtttaacaaggaaaacttattttttcactggcagtttgtttttcaaagttatgagaatatgtttaagattttaaagtgatttatttaataaatgagtatgaatatgaatttacctatttcagattgctttatatgtcatattaatttttaagtatatatttatctgtttaagcttttctgaactagatcttaccaggttataactactgtccaattatataagaacaacaatatagttgcctttcagcttgaaaaatgcacctgtttcattttgttatttttttaacccataagttatttggccttccatcagcttttctgtcttgaggaatacattgtcctatgcataataaattattttgtacatctatgtttcatgccataattttttagtgtctcacaaagttctaacttggaaggtactcttttaaatcaagtttttcagaatatagacttgttctttgtgaattgtcagatctgttttttaggtatttctcccattttggagaatgagtagagaaaactgtaccatgggacatttcagttctttttctatacttactgctaataacatgccttctcttagtaaagctagaaagctgagaactgcagttaaatagccccaaggtaggacataggcgaaaaatactaaaatttgttcaagtacagtaagagaaccaaatttggtctggcatttaatttagtcttcctcactaccctaacccaagtagtatactagtaactagacttttaaaaaacagccatttgttgattaatggtgcctatttttgtttctgcttcattttaactttgtttcataacactattatacagaggcttattttaacaaatgccattagttggatcattgagtttttcttccgctttataactgattagctctacagttcaaaaatgcttaaaggccagacctgtcaattagaagatataagcacaatagaagtgatgtttctaaaattaactctggaatacatctctcttaatgttaaatacatataatctgggactgggtgcagtggttcatgccagtaatctcagtgattcaggaggctgaggcaggagggtcattaaggccacaagttcaagaccagcctggccaacatagtgagaccctgtctctaaaaaaaaaaaaaaaaaaaattacaagtccaggcatggtggctcatgcctgtaatctcagcactttgggtggccaaggtggggggatcacctgaggccaagagttagagaacagctggtactgtagcgagacctcgtctataaaaaaaaaaaattccttctggatcatttctagaacacaaatatttgtgacatttctttagtgttttcatttttattaagtgttatatactcatatttcatataaactttgtattaattttaatactagtttagaaattttaatttagtataaatacatcaactaatgttgaaattgctaaaactttagggtcaaaattaatttaaaggttactggagttactgttctggtttctagtaattggtgtctccaataaatgcatcagaaagacaaaaatagccatggttcagagtgtctgccctattaataacataccatgatatagcttacagatatggatattaacaaaatgatttattttagaacatcatttatagcctataaaatgatttgccaactgacaggcaacctttgacaataaaatatacctgctacttcctttttttgcaaattcattgtaccacatcagtgttatctcaatagtgtgatcaacagatgactagtaatgctcattctctgtaattcacattttaccaattactaacaaaatatggagtgggcaacaattctatagtatttaatcagattttcctttaaactgaagtatgatctatattcctataatgcttttatatctaccacttcacttaagtaaaagaaagttttctagagtttctatgtcagttttcaagtggatcagtcttttttaaacatttttacttaaaaattaaaaatactaatttgtgcatgcttaaatataaatattgaaatagtctgaaatatatgaaatgatcaaacaaacaaaagtatgggaatatcctttaagacatacaaactttgaatatatttagattatttaagctaaactttattcatttacataacaggtcacaggtgttgcctttactattaaataagattcttagagtagaaaataacatataattttttttgtaaaatgttaagtgcaaagaccagagcattaaacaataaatgatgcatacatggaggaaaatattaaaaggaaatttaaaatgtaaaagtcaattatcaatggttaaatcaagaagcagagagtcagtgagatcacgttatttccaaatttattcaatgtgtatatattacttgtagaactgcgtaaaaagaaattcatgtttggatgttctttaccatctaaacattgctgagagtgtggttgaaatgttcactttttagtagatttctggaaaatctaggctggccttgaaaatattaaatatagtagaagaaggtaagttttccctcatcctaaaattatgataataaattatatttttaaattatcacataattttcaaagcatttttatagtcattgtcttattggacaataccaactctctaaagttggcagaactagaattgtccttattttgcagacaatgaattcaaagttcatgaaatgtagtaatttgctctcttaatcagtatacacaattactaagtgttagagcaagaattcaagcctgttttgtgccatggccaatctagtgctgccctctatcctataggaactggtatgtttaagagttaagcataaacatggaaatatgcctggtctgcttctagttataaattcacttacaaacctcactggatcctgaactaggaaaatctgtaagggttatttactttcatcaacccaaagatgaacatgttaaacaggttcttagatttaattaaacttttttttttccaccatatctttgtgtctatcagcagctcctcttgagtataccatggcttcatttaaagagttgcattgcttaaaaaataaacattgacattgctgatcatttacctgtgttaaatatgccagtctagtttgcattgacataatgctgacatgagattgtatcatttgattatacacacacacatttactagttctaatttaagtagtaagttttggtccttactagaacatgatttatataattggcaacctaatggtaagatgcagtaatataatctatcatgttaaaagataactgaaattcacagaattctctcctataactgcattaggaagttttaatggatttctactaagcttctcttaaggataaaattttttgaaaacaggtcacttgtaagatctgccttagtttgttaatgcttctgaaatatcaccactataacctgctttttaaaatagcctgacacctactaagtaccctttcgccgcctacaagaaagcatttatatttttaattttagtgaagagttcctgatttaagaattagtcatttgctgtcatttgaatttcaagtatgttgtaagtacttgaggttctttctgtatgaattttcagcggagtttttacatttttcatcattaatttcatctttcacttgggatcagccaaatcaaaaagtttatgttctaccctttcttagttctcttcattgcaaacattcagaaccttctcaaaaataatatcatggcttgagactgtttattgacaaccgataatgccagaaattagtgattatggttttcagtttaaaaagcaaaatgagaaactgaagaaatggcgtttttcctccatttagctgatcagctattcacatcagtgatcattcgcttttgaggctaaggatacaaatgttaatgttttgtatattcatagaagtgaaaaataatataacagttattgtgcttagtctgtgctaagcactattctaaaaccaaatgaatttctcctaacagcagccctaaaaggtaggcattattattacctttttgacagatgggcaaattgaggcacagaacaattgagtaaagtacctgtagtcacacagctaataaagcacacagataggatttaaacaccaggtggtctgttttgagactccacactccacccctatagttaatataagggtttggatccctactctttgttgtatggccatttaattgctttgtggaaagaaagggaaggaggagagagagggaagaaggcaggagagatggcaaattcctgctagctggttgacatggtgtgctataatttataatgaagttcaatttaaggacttgtaaagatttcaatagaatagtcttaaatgttcactaatgaagtatgtggtaatatcagatggagatagcaagtgaatttcaatttagtaataaccataattgtaattcaatagcagtctcatatttggaacaaataaaattcaagtaactttttaacttttaagttcaggggtacatgtgcaggtttgttatataggtaaacttgtgtcatgggggtttgttgtacaaattatttcatcacccaggtattaagcctagtacctattagttatttttccaatttgagtaattttcacagcaataattctaccttttcttaaaattattaggtattttttcaccccaacactcaaagcttatttaatattaataaaattttaccttttataaaagtccataaattttagtaaggttgtaaattaggctgaaattacaaaacaaacaaacaaacaaatttagagcttttagccaaaggaaagcaccctcatcccactccagctcacccctgctcatttctatcataactgcttccctaagaaagaagaaatttttctaggcggagcttgcagtgagctgagattgtgccactgcactccagcctgggtgacagagcaagactccatctcaaaaaaaaaaaaaaaaggaagaaatttttctgattggtcagatttaattgaacattcactgagccatattttactattgcatcgggtcactgtgtatttaaagatacaaagcaggctggacgcagtggctcacacctatgtaatcccagcactttgggaggctaaggcaggcagatcacttaagaccaggagatcaagaccagcctggccaacgtggtggtatcccttctctactaaaaatattaaatacaaaaaattagccaggcatgatagggtgtgcctgtaatcccagctacttgggaggctgaggcatgagaaccacttgaacccgacaggtagaggttgcagtgagctgagatggcaccactgcactcctgggtgacagagcaacagagcgactctgtctcagaaaaaataaaaataaaaaaaatacaaagcaatggtgcccacattcttatttgtccagcgcctggtcttgtgagagcaagtgcagtgagtatccttgaagcctagaccttcaaggtcctctcctctctttcattccgtgcaccagggtgggcttcatctaggagaacaatggactcatttctgtcttttgcctgttggtccttgcagatgagtcaggtttcatttggagcccagaaaatcttacatgccctcttctcaacatcttcctttacacatgtctcagtaaatattaacatgctctaaatatgcccttgccataactctgaactcaggattaccagaaagtaattccaaagctgagacattttccatatcttaatcagcagataatttgtacttacattaacactgacttgattattcacatgttcgtttgcagtttgaatctatttctgtcttcaagtacttaaaatagatatagattttaatcaagatactttaggacttttattacatatttattatgtaccttatttcaggcatttattgtactaggtgctggcaatagaatgttaaacagaatggtatacaatctacattctaattttcaaataagattgttatgaaagtgtacttaaaattcaaacaggaaaagagggctgggcacagtggctcacatctataatcccagcactttagaagactgagatggaggagtgcttgaagccagtagttcgagaccagccagggcaacatagcaagaccccatctctacaaaaagcactttaaaaaaatttgccaggtgttgtgatgcatgccatagccctaactactctggaggctgaggtaggggtgtcactggagcctaggaggtccagcctgggctgcagggcaagaccctgtatctaaaccaacaaacaaacaatacaaagcaaaacaaacaaacaaaaagacacaagaaaagggtacagaaattgcatgcaaaaaaactcagtttaatatgcatgtttggcatgttagagatagaaaatatctaacacagaagctttacaagattaaaggttgattgtcacttcagctgaacttttacttaaaacaagcaagtgtttattcaaaccaagccacaaactcaaatagtaattatccaactttatagtttctcacttaagatagaatgcttttacttatgacttgtagtaatattaatatttcaagaaactaaccatcagtgttttcaaaattaggttattccagtgataaaaatttcaagagtttcccatcagttttatttcacgtctccaaaattagattaaaatgttacagttttaagtaaaaaactagtatattgactattgactcgggttcaaagttctatcagaaggtaggtcagagaaatccccagcgcaagaacacacccaaattttaattctgaaattctttcttggcggattagatgttggtatctcaacatctgcaatgccaaaggacgttgtcaagttattatcagcattcagttcagcactaggttttgagaatttagaagttttttcactactttttctcctcctactccatgacagattgcttccaacgctaaaggtatcttgactcattcatgcaccatacattcaagaaatacatacatttgagttactgatcacatatactattccaggtatggtactggtcactaaggcatcaaagatgactaagacacagacttggctctcaaaggggtccccagtgtagtgagactctgcttcttactcttcaagtagtatcaattatatgcaaccagaaataacagggagttaagtagcatttgtatcatattaaatgtagattgggccatgtaatttctcaaaaatcagattcaatcaaggaaagcatagactattctttgggatttgcccttgctgagtatcattatctattcttgagacgtaataatagaagttagtgagcagttcatcaaatacagccctatggaagccaaaatgaatattttctttagtcattgactttctagacattgctaaggcatttaaagtttccctgccaagaaatcaccagtaaacagcagtgatggtagatgcaggctatttactgccatgagttgaaaaaattagtgagctaccttttgattgcttgtcaagcattttgacatgttaggacagaaagcactgtttaaatgtaaagagcagttcatgtagaattgctgtaggtcatcctaatgaggaagtgatctatcaagtgaaagactggagaatgggagaactgccatgatgtaagattgatttctgctaaagagaccttaaatttggctgtgtttgaatttgtggttccttccaatagtttgtaaattacccacagtaagtacccaatataaaaagctattcaaatttactttccagcatactcacattggggattttttttccttcttttttctgtttctctcccagatcaaaagaggagcagtgagtctcaaggtttagggatggggtccacttggagtgactgactcagtaagcctgagtgcaaccttgggccttccagttttaacaagttcctagaaaatgcttttgctgctggtttgtggttcacatttgaccaaatcactgctgaaacaaaactgctgggggaggaggaagaaagaactatgaatcactaagccagcccctgaacttgctcaccaaactgtccagtctgctgtgactataatcactgctgctcaggaacctatcgaaagtacattcagccctccgaatctggggttctgcatccatggattcaaccagcagactgaaaatattcaagacaaaaaaataaaagataactattacaaataaaataatagagtataacaactatttacatcgcatttactttgaattaggaattacaagtaatttagagaggatttagagtacccgagaggtatgcatccctggattttggtatctgcgggttttgatacaggggtgacctggaaccaatcgccccgtgcacgctgccaggtgatgactgtaaatggtcctctgaatcagtgactcgctgagggaatcaggaagaacaatcttacctttctgctcaagctcaggctcacagtttaatcttttaacctccctctgcatcagtctaagtttcaaataataatggtaatttatttcctctgttattaaaaaacaagaccaaaaaaaccacaaacaaaaccctatcaagactggtggggtatgacctgtatatttttagcttctgaaatttgtcctattactatttaaaattaaaagaatacatttttctatttataaatatatttaagactgccaaatgatagctgttccttacccaacattagttataaagaaaaaaagcaattccaaacaaaaatgatattgcaacaaaaacatgatatatgtattttgtgaaagaagtacagctgcctcagagacaatgagaggctatgaaaataaaggaaaaccatctgagctctggttagagactctggaagtagtgagcacaaatttctttgaaagaaaaagaagaggagtctgatgtaggtagacaatccaattctagttactgtctttatttgtgatagtccatagtctaaaaaggtgcaaatactattaactagcctgaggacaaggtggcaactgcatttcattctgaaatggaaaaatccaaggaaggtagaagaaacaattgcatgagaattattactcaattatttttcctcaaaaagctgtgtatcttcttttttgaactttgggaaagcatatataagagtttctttgaccccgaatagtccatgtatttacccagaaatatttgtgtatcttgctactgcagcaggattacaaaatagattacaactctactgtagaaagaaaatatgtttttatataatctgtaacttatctgggtagctagaaaacatacacacacacacacacacacacacacacacacacacacacacacacacactacattttaatcctggcatctcagtcaactcccatatctgagtggttctttcaaataatgcttctgagtctacaactttacctttccttctctaagaagtgtcagggcatatggctggaggaacttagtatatagacctagatagagctcagggttttggggaccagttatgaaggggctgagggatctataggccacttcctttgataaacctctgtaccagctcttttcttcccaaaatttccccaagtaacaaggtttagtttagttttttttttttttaagcttcttactcataagcttctttcatggcaaaccctgatatttttttcctaggtagaaaattatttggatttatccatctaattctctgatacagtaaaagatagctataaacttttagcaaaatttatctctatgaagattttagactttgaagcttaactgactaaatttttccaatacttgctctctattgtctgaagggtagacatttccttgcctttaagaggtggaaagccacaagggaacaagtccttaaagagatagtctaaaaagccctttctaatctacaccacctccagcaccaccaaaagtcttcaattttatccacatatttgtttctatgcgataaccgatatatttttgagttactttatttcccaaccccctctccgtcccaccccccaccgccaacaactagagtgcaaattccatgagatcagggtcttggctttttattattttttcattgcaggacctacctacaataattactggcacataggagccactcactaaatacttctagaatgaaagaaaataaaaatgtgatgcatccttacagtagattatccactgcaaattttggttgctagcaagcatgcatcttttgtgctactgcctcaaatgggccttctgctgcagacatacttatctattgacagttcttttgaaccaccattgctcttcatgttttcttgctttaaatcatgctgttgccgctgcctagaaggttcacttgtgaaccttcttgtctttcacactcctaaatttcctcaaaacataaatcaggtgtcctggtctccaaaagtatttcatgataaactttttctttctctaagtccctgtgctgacatataaccctcataccctatgctggccctaaacttgttctttctctacgtccctgtgctgacatataacccccataccctatgctggctcttaactcactctttatactattctctctgatggaaactcatggactttgttaagggaggcattgaaagcaggaactgtttgctatttctggcatcaaaagcaaaatgcctggtgcatgacaactattcataaacattgaataaatgaacaacaacccaccttatttctctctcatggtactactctttattgttttaaacttctatagttatcctggggaaatatgagagtaatgagttttcttgaaagtcaggtgcagggacatttatggcaatacttgtcttgaagatcaactacatcaaagtttcaagactaactagaataattctcaaggagaaggaaagaggcattcaagcttattttggagtagtaaataacagtgattctggtgtccaaactgtcacaaagacaaccactgccatattaagcttctaatactaagaaaagtgtcaggtatacggtagtagatcctgatgaaactcttcagaaactgtttctgcactttacctcatctggcagctcttggtgtgcgctgaggtaatatattaaatttgtggtgtaattagtttagaaattattcccctagggaacaaagatggtcaagagacaaagcttgatctaaagttgacagcctgggagacaggccgaatttggaggtgttaccgtagcatatgtggcttagtattgaataggtcaaaatattaatgacccatcctacacacaacccagggaaaaatgactgggcattgtgagagagtgtgggtgtcttggcagaaaggtattacatctgtttcttccacatctatgagtgaattatgcatgctatgacaaggaggcttttttaaatatgagaaatttgaggcaaaaatgatagaccaaaaaagtgcagagaaacaaggtgagtaatgaaaggcagaagtggtatattggcaggcctggaaatcagctgtgagtaatttgagttaattaaatgtggcataaaacatttggaggaaaaggttgatgagatccaattaatgggcaaaagaaataattttctgaacagtaacatttgggctatatcaaagataaaagtggtatgtgataagagattgagaaaatgaacatgataattcttttgtcacatgaggaaatctgaggtgaggctgagaaccctgtctcgatgtaaggaagaaatcatcttcaggaaatggcagttgcataaaacaaaaagggagactcaggggtataagcaagtggattaaaaacttgtctgatttattcataaatgatctgactccatttacttctgtttctcagatttcttgggaattgataagtatattttctccatagtacttcttgagatgtagaacatctaacatcaatactgattattgagttttgttgtttttctctaactcagagatttttattttaaagcagcagtaagcaatctataattcacagcagtaaactataatctacaagccaaacccattcttagctaagaatgctttttacatttttaaaaggtaaaaaaaggaaaaaaaatgaagaatatgtgattatgtagtccacaaggacaaaaatatttattacctgcagtgcttaaatttaaagggtaaaattaattaaagaaatcctcacattagaattacatgtaatataattatatgtaataaacctaattatattacatataatgcatgatcctctacgaatttaatttgaatgtgaagatttctctaattgcatatatataaacatacacctacagttttatgtgagagaacaattctgtcttacacattatatgatttcacacctttgaggatagattgctagataaaagagataggaaaaaatatttagcagtttcatagttcattggggtcaagaagaaagaggagtgtggcaagttcattttctttttacaattacaacatcagagaagaaatgaagtaaaaaaaaaaaaaagtgaatcagaagcctgattgtaggagatgcatggagagaatgaataaggcaataaaagggtgtaacttgcttccctacgagttctaatgctaggaggaaaacgaaaaataaaaatataggtctcgagggtgccagctccactgcccccctgctacccctgcccctagcaagtattagggagggtaagaactctatctgctaagcttttgctgtcttctcaaaagagatattgtatagatagtccctcaaatagacataaatatatatccacatctattttggatggtagtatttagcttcttatgattgtgtgtataaagcacttcaagcatgctgctcctagtcaaatccctgcagggccaaacaaattggggcagttcaaagccaagagagatgggagaggctgtgacatactgggaatagattgtgctcttcctaaaaggattaaaattatattaaattaacagcaaagaatataaagcagtcagaagtcaccagttgcaactcctgctctttttcctgtgaaccgttcccctttttcaggtagagggacagagggggtggggcagggacttctttcagttgttaccttctggttttccttttttcgcaaattttttttttttagacattctgtatgtgttcataaaagtcacacatatgtatactctaattacaatgattccatctacaaaaatctgtattacatataattattacattttataattattacatttgagaaaaattagttttcttcccaaaggaggcctatataactttaatctattaaaataaaattaattttgaatagcacattaaccagatgttttgctaagctatttctggataattccaaactaaattggcaaattttatttatttttaattgacaaaattatatatatacaaggtacatttacaaaattttaaaacagttgttaccttcttgaaactatttattctaattttattctaattcaattcagcccaacctcaacatctctgcatttcccctatgaatccatctactatcatcgtctactctccaaattcttcctgataaataatattcttatattttttaagcagttaaatttataccacttactatttatcagtggcatttaactctcacaagtattatccacattttacaaataaaagttgcacagttggcaagtggcaatctagaattcagacccaaaggcttcaacccaatgggtcatgctcttaatcatgaagctaaacccacctcaaagaagtatgagggaaatgaaaggcagatactggatcccatatatacaacagctgtcaggtggaaatatctgacagaaatgtatttccactgaactcttttatttctctaaccattgaattaagcaatagcacatccttattaaacatgatctctctttaaacttttgattatttcataaatttacatatatatagtaatgtgaacttttgttaaaacattgcaaaatatcagttgaattgtatttcaaataaatatatcactttcctcaatgttgacttaatgtgcactactgttcatatttttctggatagtccacaattattcaaatggtaattaaagtgtcaaaaccatgtttcaacacttgtttttatgtccatgctcctaacaaaacagccctctttgttcttcacattttctggcttcttcagctcaactgaaatttggatttctcttttttttttttttttttagattccctctaccatctccaacagaaggttagctttctctttcaagagtataagaggcaggggctgggtgtggtggttcagacctgtaatcccaacactttgggagaccaaggtgggtggattacttgagcccaggagttcaagaccagcctggacaccatagtaagaccctatctctacaaaaaatatattttaaaaaatcagctgggcatggtggtgtgcatctgtagtcccgtctactcaagatgattgcttgagcctgaaagatagaagatgcagtgagccatgatggcaccactgcacttcagcctaggctacagagcaagaccctgtctcaaaaaatacagtaagaagagccatgccactccttgtatttatgccactttgtttttgcttctactaccatactgcactgccctagtttgaacttaatgttaggaagtactatggccctctctctgttcaggccacttcctattcaccccagaaccagtgtccatttgtagtcaactacagttcaccaagctttctattatttctttagctccagcacctatattcatctatctcataacttcatatgtcatccacatctcaaaattcaaacttctaaactccactgcaacaataagagatcaaatgagcttatgtgaggtgatcagaaattaagatattgtaaacgtcagaaatgtaaaaggccaaccactatctgttctgcaaattaatatattgttaatactaaaatttgtagtcccagcatatgtttgctttttttccagaatttgctgtatctctatcatatgctaggcactgattatttggtttcatttttcttcctattaaatagtgacaattttttttaatttgttttccagacagaatgacagcttgacaaaaagatgttgtggtgtgtaccaaataccaagatgcccctcctacctgtactctcttttgtattcccagtcataccaccatagtttagattctattttttatttcaacttttacaaaagtgtcttatctccttcctgtctcgtatccatctgaagatgaagagtgttgggctcttccttcaggggaaggctgtcaccacctgctgaattatgcccaagatttcagcagcgagaacttcctccttcagaaatgaagagaaccaacacaggaagtagcatgaagatgtgccatagaattaaagcaaggtgatgcttaatgaatctttcagtgccctctcagaaatgtacacgcaaatatacgtgtgcccaagattttcagtgtaatttcaaagggattctcagaactctacatgccttgaacactgaggtcagaaccctggttccagatattttaagatttgcttttaaataatgcaacccagagagctgtgtgcttggatcaaattgttcagattccttgtagcattgcttctaagtgtcccaccctatgcctttgacttgcattaatgggcaaattgtaagtttcttttctgtcttttgacagaggtcatcatccatcatatccttcgtatgtggtctgtataaatgcacacaatgtcttacatattatttcaccaggctaacagatacctggagtacaaactaaagtttcagggactccaggctagcaatcttctaaaaggaataaactagcttttataaaacagaccttatttttctcatactctgttttttctagttattctcttattttcccatcaattctttaatgtttcaactatatcatatgtactgaagtgaaataatgcaacatcctttgttcacacctaaacccaggcattaacgtggaggcctagaggctggtatggtggtgccagtgataatcaaaacgagaattcctaaatggatgcagttttcctccgtcacctacctggagattgttttccaatgctaaaatcaggccagtttcaattttgctttaattaagagaattggtgttttctttcattgttactttgttttctctaaaattacgatgtcgtgttgctgcccattgaatatatccagagtatactccgtatcctggcacttcaggcatttctactgttccaacctatggctgcagctccgttatttccaatttccctaatcataggcctgtgctgctgtcgaactccacaagtctcctttcaagcactgggaagtttctgatctttgtggcacttttcatgctattaactatgccaggaatttgatgttctcacatgcaatgcatattaaaacccatttactataatatacttatatagctaataaatcagacaaaaattattaaatgacacttaaggattgctatgctgttatacaatgtagatgtatactaccttctacctcgtggcaaacaagtgccttcatgtttttgctccaacttacttcaacagcctcatgtcttctaacacttaactttaaattctgtgttctcacagtacttgaaatttcaatgtgctttgctctatattttctaggccattgcatgtggtactctctttgcctgaagttctctttttcctccatacttcacctgcccaccaccctttctccctgtaatgggccacaatctactttgggaaaggctggtttctgtccttctcatgggttcacctaacatcctattctgaatcatattccagcacactatattttgaaattccctgtttgttgtcttattgcactgtttccagtgcctacactgcacctagcacatggaaaacacttgagtgaatgttgctgacattgaaatataggtattactggttttgaagagctatttgataaaagtaattgaaagccataaaaatacttttcatctattaatccaggaatcaaaaacttaaatgctttcagaggtcaggcaggtcatgtaaatgtccagtgtagtacagaagataacaacagagagtacagactaatgtacgtaccttatctaaacacattcagattcacatttttataattactgtccaagccaaacaaattataaccccgtcttcaaataatttcttagaaggaaaaaaagatatatttattaaaatgttacctgcagatttatttgtaataaggaaaaagtaaatacacattaaatagccagtaatagaggcctgattaaatatggattatatccattatatgtcatatattctttattattaaagaatctcccaaacggtaatatatggaaaatgctttcactattggaaataataaagaaaaaagctaaattacatgctttctataattgcaactaagtaaacatatgcttccttattaaaatgaaaagaaaggattatgcaaaatgaaaatacctataatagggtgctcaaaatagaaatgatttttttaaaaattcaacatttagtaatgcttttgtttttccaaccccagtctttggagaaaatgttgggactatcttttggaatcttagaatttgacacctagcaagcaaaatcatgttactttgggtaagagctgaagaatatcagttgtgggctgagatagaaataccattgtcatggcaaccaccaaaaatttcatagaaaaggcatagcttggattttttttaatggagatgactaacaagattgcttttgaaatagttctgatatagtgtgggataatatacagtaactccgataaacagttttgctggaaaattgagataaagtggcataaccttaagatcagaacttagaatccctagtgtaagcttagcatattttgtatactaattagcttttactgacataatactaatatgataccagtctgtcttccctgaatacaaaaattacatatttagtaacattataattctataatgataataattctcatcaataaaagagcttgggttttcttgtcaagggagatttaaagtatttttctgattctttatgaagactcaattatgtgttttcactgttcctctatgatactatatataacctactggaaacagaagcttgtggaaatactgatagcatcaatagaaatcatcgtgactccttccttggaaagggcatgtttcatcagtaccgtttgcctcatttattaagctgaattgtcatcttaagtgacagatattttcaatgtccaaacttcctgcaaagatttatgtattttatcccattctgtttgaatttagatcaagaatgctcattagattattttgtgagcccaggtttgctagagtttacaaaatctgacctagctcactagccacagagaggctatcttcatacaatgaaggtttcctgaagagtgaatgaaatccatggctttgtcgaatacatcaactaatacattgaaactgctaattgtgtgattgtcctggggacatgactagtttatttggaaactacttgtaaaatctgctttgccttgcaaaattgcttcccctgagaaattgcttcttcaatggcatatccagtggagacctttcggtatcttgcacaactagtcagcctagatataggaccatatagttaagaaggaagagacggtcagtaattacaattttaaattataattacaaaattgtaattattttaagggtgaaattctaattggcattttttgtttcatgtaaacttctgtagagctgcatttatcataaatagccacatatccaaagtatcacatttctcatgtcacatacaaacttttgactctagcattcaatgtaacgttaaaaaaaatcaaatnnnnnnnnnnnnnnnnnnnnnnnnnnnnnnnnnnnnnnnnnnnnnnnnnnnnnnnnnnnnnnnnnnnnnnnnnnnncacctgattgtttttcattcagctctcgaaccagttaaatagatgccataaatatgttgattcttgtaacccgtttagtctatttattgttttctgaagccaccagtaaaactagtctttttcaccagctactgaagacagaggtcatgttataaatcaaatggaattattaacttctgtttccatttttaagcatttgaccacaaaattaaaccttgtatttctacataaaaatccaagcattataatgtgaatgagatctgtccactcattcattcaacacccacttactaaaatgctatttcaaagactattctaataagttaaaaactgtttgaggatcttactgtctagttagtcatacagttaatcatcacaaatactgaaggtttgaatcagaaaagaaaaaagagaaaaaacaaaaacagttttgtttttttttgtttgtttgtttttttgtgattggagtctcgctctgtcgccaggctggagtgcaatggcaacatctcggctcaatgcaacctctgcctcccaggttcaagcaactctcctgcctcagcctcccaagtagctgggattataggcgccaccacacccggctaatttttgtttttttattagagacggggtttcaccatattagccaagatggtcttgatctcttgacctcgtgatccacccacctcagcctcccaaagtgctgggattacaggcgtgagccaccgcacctggccttaccagtatttttaaaatgttgcacacaaatagccataaatagcacaggggtaggactttttccattgaaaaatatatgacttctctataattaatttatatatcttaaccacttatgttacaaatgaggaaaatataaatctaccaaaatcattctgtaaaaccattcctgctttgagtcatatgaatacttgttgctaatttgaggctttctaaatttaaagacataagatgagtagttaatgactttgaaatttaattaggaaagtggtgactgagagaggactagacagtatgttgtttgcactaatttgatttatataacccttttctagtcaaccttttaaaaatcagccagagagtagaaattctccaccttcaaaaattaggaggtttactaatttttgaatctgggtgaagtttcccagattaatccaaatgcaactaaaatgtgatgaaagatgaagctcatcttagttttcttaatctacatgacctactttgtccagttacttaaattcagaattttcatgttcacagtttgaaccaggagaagtacctctctaggttcacttttctctgaaattctaagactaaataaaatattaataaaatgtctcaataattatctcacaaatatattaagataaatagtatgaaataagttttaaaaaatattagaataacagtattattagaaaatatatcttaaaagggattaaactacacagatataaggtttgatgtattttcttaaaagatgagaacttactaccagaaacatgtagtatattaatagcctcattatggaggtgagattctctctttagcagaacacaattagggaatatgtgagtgatgttttattttttatacattgccttattatgcatttccagtcatgatctcctagtgtaattgcatttaaattgtgttcttaaccatatgttaattaaataaactcaatgtaaagacccaatctaactttccttagtaatgtggagttaataaaaactgcagctcattggaatctagagtattacaggatctttgcatacctagctcttaaactgatttgttttggattccggaaaacttagcaccttggttaagtggcttgtgaagaaattttgatacatacatccacctcacgtagatctaatagctatgtgtttggaaagtattttgtggaaacaaagaattaaacagcaaggaaatttggttttccttaagaacactgaatcgtatagagataggataatttctggagacaaataggcctgtcaataaaggtcaaatatatgcaactccctccttttgctgaaaatctgttattccatgttgacttagatattaagagaatactatactttccaataattatattgttataatgcaggggatatagttcccaccagtgactctacatctacaatatatgatgaaataaaagatataattataaaatatcatactatcatactcaattcattgagataataaagtacattctaaaccttatttaatggacaaatacatgcactatcaggtggttacatgaatctccattatatttgaaaaaggtatatgtgttgacattaaaaccacatttctacggtgtcttaaattataactacacaaaattaacacactaactctgtcacttatttacaccaataaaagtctgtttccaaacaagaaagctgcactgggtatatgtatatgggtgtttatgtgatttagatgactggcatatttttaaaaactgtccaaaggagtttgaagtcataattttaatgtagcaggaaaagataaagtcattctcccatatttccttaatgttcagatgctatgtgttgtatgacatgatgtatataatgtaagttactaaaactttttttggaagagaaaaagctagagtagcagatatgcacactaaaaggcaaaaatctggttttacaagttttataataaaaaaggtggcaagatgaacgtttttttaacttagaactaaatttaagcttaacttttacagcaatctttagaaaattttgctatatggtctttcttgaagattatttgtaattttgtataattgatttagaaattcccatcaaattttaaaattcagagttctagataaaaccatcaattatctgaaatcctttctcagtcaagactgcccatgaagccaagtgccttatttgatcctataagcttcactgaaaatcagcagagtctttattaatttataaatgatgggcatgattaactggtctcaagtttgctcacaattctgaacccttgaaatcactgaaataccaaaaaaaaaaaaaaaaagtaagaataaagctattaggaaaagcgattacttgagcctactcagagtctcagtgaaacaaaggtccattttgtgcataagtgtaaagaaatatatttttgaaaaaattgtatttacaattagaaaatgaactctgaggtttcatttattgctagtcaaagagtttagagccattgtaaatagtttcctctagaccgtaatacaatgagtttattttagtcagcaattacaatgacaaaatgctaggtatcattgagtagaacattaggcaaagatccgtttcttcctcttgtataaaatctgaatgcattctattaaagaacagaattaaacaggcaagcaaagatgtattcaagactatttcaataggggagaaagactgaactcaattctgctgaaataaaagggaggcaagtttttaaatgatgctgtgagctagtgaaaaatactggaggatattagggtagagtttgtcaatgtgattagacatttgtgtttgctaatgggtgcttagccaagttagggtcctatccttcgtgcagtttgggaaataggaacattattatctttcttgattattacatttcaaaaagatggttcccaggtctatcagaaagacattcttgggttgtaaaatatttacagctcaaagagtcagagaaagaatttacaattccaagttttctaaagtaagtgatcttgaaaaagggtggttagaggcctagggtcccagaaggaagaaacctgccggcagttcatcaagctaagtgggaactttaaggctgtcttgatcaatccaaacctggaacacagattcagatctgattgccaatgcaagaaaaaagcttgaaaagacagacactcccctgatcacccatcctcccttatctgagttaaatatttcatttatttatgtttttttaattttttcataggtttttgggagaacatgtggtatttggttacatgagtatattctttagtggtgatttgtgagattttggtgcacccattacccaagcagtatacgctgaacccaatttgtagccttttatccttcacccccttcccaccctttctccctcaagaccccaaagttcattgtatcattcttatgcctttgcatcctcatagcttagctcccacttatgcgtgagaacatacgatgtttggtttatgtgttactatggaggcacaggattgccaatgtcacagattttatctggatgaattgcaagtttttgtctgtttattactcttgacaagagactatgaagtttatgagggcaagaatcttgtgtgtttgtaatctcaggatttacagtaatgcccctcacctcatagtaattcaattaatacttgactgaattttaaagatttcagagaataagataagaaataaggatatgggaataagagtgtggatattacaaaagaagagtctttagtttggtaatatgaatgctataaaggaatatgatcagagacatgttcctggaggtatgaactgttctagtaaatcctagacaactaaaagtgggccatacccagtgaagataggaaaaggagcttatgtctaatgtatggtatatggtagacaccatgttagcatatctaaatagtccttcgtctggaagaaaagtattacaggctccacttcataagtgcagaaactgacagagtagccatatagctacactcaccctcacctctgttgcccagttataaagccattagactttgttgctgtaaacttaaactgtaatcgtttaatttttagagaatagaagaaacagaacttttaactttacatattagatgacacccccaagaaaggatcatccacaaaataaaaatagaatctatgcagtattagatatatatttaaatgctagagacagggaaggataaaaatggctaatgttttggggtaccttccaaaacatctgaagggagtgtcaacacaaggagaatctgtttcttggcagaaccttcagcaattaaattctggtttggatggtcattgagatggaagttagtggggctcttccccggtatttaaaacattctctgtgattctttgctaatgaaatatctctgtttccttggttttattatcactggaaagacgtttaagggaacaatctttctgtgtttttcagatgtgcattgagaatgctgtttaactcctattatgtgctggagaggtattgatagttcctgtatatgtctctgtatgtcaggacaagaaatattaaagctgcttggtgccattcctatctggttaaaaaaaattataaaggaagatattcctgaattgaagggagatgtctggaacaagagcaagcaaagtggagagaatttaattaacaatttagttcaatctgaaagtcccataaaattcaaatacccatgttgggctgatatgatacttattttcaaaacaatatggcttgaaactttttctaaagaatttgtggtgagaaaaaaaactaatggtaatctactgaataaaagaaatatctatttttctaacaattctttgaaatccttgacttgtcatttgaccgattttaccattttcttaaaaaaaaaaaaaaaaggaagttgcatactggaaggaaggaagacttagtgcttttctggtgcactgttggcattcttccaattcttctggaaaacatcattctatcatttatgctcccgtgagtcaaaatgaaaaagtctgtatagcctcttagacagaagtatcaggatattcttaaaggggccttatccaaacaggcatatttaaaatagttattagtttatcattaagccctaacaagactgcaaagttgcttagcaacagaatcaggcacccttaacaggaacatgcatgggaacaatggtgaaacataattgagccttaaaaaggcaaattctttgaattaaatcgtgaaaagacaatgtgtcatgggaagaatgagtattttaacctaagacttgttctctaagcattattttatagctagacctaagtgtctttccatagaataaataatgatacttttagtctttatataatttaaggcacttaaaaaagattgtttatccaagttagctcaacaatgcataatatctctattttgacccattaattatcttcaacattgtagagatacataaagaaaggaaggctcttacaaaaataaacactacaaaatatttgatgactgcaagggtttaattttgatgttatgtataatttaaactatcagaaactcaaaaactgtacttttattttttaaatttgaatatacatttacatatacacacataacgtatctaattcccatttgcaggaaaaaaaaaaaaaaaagcctgaaaagcactgtctcttttagagttcttttgactagtttgacattggctgactttatactccagtacccgtaaaagcactgtcttgcttcatttagtaataatggaaacaaatctggtgcatgtgggctgtcttgatataatgcataaacacctaaaaagttcagtcagggaataaactcagggtcccgtctgtggaggcagagaatcccggcttggatcctagtcctatttctggctttatcaaatcacttacccactctagacctcatactcctcatctataaaataagacttctaagatcccttcacatctaataattctatgtccatcaactcttaagtggtgtcattctttttttctcatagaagaattgtttgttttattgaattggttatttgactgctgtctcttatgtaaatactagaagtagtaggcctatttaccaacactgttagaatattaggcagaaaaaattccctactggcttctttttggctttcctttatgtctgattatatgttgcactgccaatttttggtccctgaaagctgaaaacgtgcagatgcagacagatgtaatatgccgcagctttttgtatcaagccactctattttaaaacaactggatttttttttttttttgcagtctttggaagagggttagatgaccaaatctattttccttttcttcagagttttataacaccacaaaaggtcatccttaaacagtcagataagattaacaacaaaatcttggaaaacagccagtgcatcaacaaaacaaacccagtggactgtttataaatgttaagtttaaacaggcagcagaacacgggatggggaggagaggagagatacttcatagacatagcaaagaaataatttccagagatgacccatgacactgcagtgttgggaaccaatatcaacaaacaaacttgacacccagcaatatgtagagtgcatttataaagatgttagaaggagcaagtcgtagatcacaagtcacagaagcagaatcatgggccattcccatactgggttcttcatgccatttttaatgaaaagataaattggtggaaatattttaattgcaaagaagtgaaaaagtgatttttaatgccaccagttgacgccaggccagggttttcactatgcaacctagcatgtagccctaaagtcctgacagctaaatagtagggaagacactgttctcttccttgcaaataccacttcctttactaaggattctaaaggaagagaaagcttttaacagagaacacctgagaggaaagccaccaatatttaaatccaggaacttaatattgacctaaggagcaagtaggcttaggtaaagggcaagctaagaaattgttgaaggccttgcacatttagttaaaatttttaaaattctgaatagaaatagagaattccctgcaaattgtattttatccatgattcagatgtggcctgttagaagtttaccaggatgaaaagtaagctgctgaggattgcagatgatactaatacagacataataacaagcagagactgatatttgtaacaaaggatttcaccagctttctaagaaaggctttcatggttgacacaagaattagattgtagttatacctgatatgaattttagattatgcaatacataaagatgcatttaggagacattctcaataaattgcacatcatatattgcagtagtaaatgttacattcttttcaatgaataactttacagtattttgtggtttaaagagactagtttaaaaataaaagattgttttaaatttgagaaatgagcaagttaaaataagatgaaccagatttctacaatccactttctgatgctcaaagtggagagggtacaaaatggtgcatgactgagtctatggcaatctgcgttttctgcactgtgtgaatcatattatacattctgtaatatgaaggggtacaaggcacttacaggttgcatttttcaaacttttacaaaggaatagtagtcaccttcagagacttctcttctaactaattagaccttagacaaacatatatttgcataagtttcatcaagctgcactttctgaatttctttctcccttgagtctatttattactcaattcactctgttatctaataccccttacagtaactgtatgccctgaaattctcttccctcctccacatcatcaaaacttgcttttggatcattcagactgaggtaaaaaaaaaatgactaagatcttaaagtacagatatttgaatttcaatagaaaagaaaggctaaaggattgaggttctcaggcaaagagacaagagtctgctaggcatcagaactttttggcttctcccagttacaagactcatcttataagccatatagttggagagaagtagtcattcaaaaggctcaaaatataggaaaacaaaaataaaaatcacttcttagttcataaatacaatgtaggtctattgaagagaacattaaaattgatccctgttttctgatctcaaactggccaacagtgagaaggagttggataaagcagccttggtgttggtgaatgcaagaagaattgagtgtataattacaaaaggaaagtgagtgtcaatgtgtgtgtgtgagagagtgtttgtatagaaaccactctagaaaaagacatttaaaactgctaaagttattaatgcactgaaaagaaactattaacttcaaaatcattctattgctatattaagtcatatttgagggacaaatcaatagcaatgactttcttgaaatgtctcccaacactatgattttgttttatggcactggtgggtaaaggggtttggtctgaaaggacacaaacaggtaatactatcagttaagaatgttggcagtagttgagcaaaaaaataaaatatgatagaaagcacagtttgtttcctttgtcctttccttttatgtttagcagttatgtaaattaaaagaaattgatcttactacctattctttttattcagttaccaaaagaacatttgctttgaatgaatatggatgcatttttcttttaacagaatcaggcagccaaacatgactcactgttatttacatgagtcagtatctacttgcccatgtaatcttgtttcactaactttacagtcagatcattcttgttacgatcagggaaaatgcaagcaagaataaatgtgatgccaattaatacaactacgaattagtatttagtagtagttattgatcattttatatgggaagtaaaaaaatcaattatctaacattccattgtttactattatttttaacaaaaatgggattttgtttttttttacacaatgttctgttctttgttaagaagtgaggaaaaaagcacttactgatcctaagcaagtcagctcctcgatttgcctgatgacgatgaatatgaatacaggctttctctccagtacagttgctcttcatcaaaaacaggctggctctaacatatttcacaaacacagaaaagtgtgccaagacacagtcagcaattctttttaatttttgagatttaaaatattactgaactttgtttgagttttacatttctcatggataattttactgtgaaatttatgatgctataaaactatgtttatgaagatactatagtaggtttcacatatctccatatcttatattggtaacatttaaatttgaatactacatctttatcctttcataaactagaagataattgttctgatgactagcagaagaagctggcaggaacgatagatttgccactctttgctttctgttatttgtgagtctaattactctagttggtcaattaatggcaacacatgacaaaatcttcctactaattgactctcactattttgttactgctgaagcttcctctaattttgtatgtgcatatgttaccctacttgtcatttttttcctcctaaccttccttatcagaaagcccatctcaccaacttcacagtcagataattcttgttatgatcaggaaaaaagcaaacaagaatgaatgtgacgccaattaatataattactaattagaagccacattttgagggcattaaaacagaagaagagtagaaatgataataacttggttttagggaagctgttaacatataaatagaacccaaaatggcaccactggtagttttccagggacttaatatttctgacacacactcaatttgtgcccatggataagacatactatattataggagaatcaaagagttacatatttggaaaaatcaggttaccaaaaagaataatgacattgtttaaacaataatgcattaaactttccttgtttattatgctagaagttgtatgagattatctgagtaaaagcatttcaattacttcagcattgtgggacatgaagtgtaaaagaactcagaacatgggaaaaaaaggaaaaagagaaaggaaatggctgaaagattaattacttggctgtcagctgctaggggagtttatttatgttctcttaatattcataaggctcttgtcaaaatggtattattaaatacccattttatagaaaagggactgaggctgttcaactgcagtttatttgatgggtatttatgcctgtgatggggacagctatgtcaggaacttcaattccagttaaagtgaaacctggcagagacatagttttgatccaaattttgacagtagtacaatgttgcttgtccttctccgggatggtagtctgtgtttcccctgtaacattttgtctgatttgtttgtaccaactatttggttttgtaaatttatgtgacactttgttttaagctaattataaatgtaaattagactctaagatgtcttttttccactaactggttttgtagtagcaaaaatctgaaattacatgcaaaatgctgtttacagttgttttagtaaggggatgcagagcagtcagagtgagttgtcagattctcaaaacaaaatcaaattatctaatattttacattaaatcaggtaatgaataccgcttctggatccaaacattggtttaattatttataatctttgcagtgtccctaaaatatctattatctccaattaacactaaggaaactgaggcatagagaggtccaagtaagtggcagggatggaattcaaacccaggtcagtttcaggcttgaactccactaattctatacctttcactgcctctctcactgtaggtaattgtattagtctgttttcatgctgctgataaagatatacccgagtctgggaagaaaaagaggcttaattggacttacaattctacatggctggggaggcctcagaatcatggtgggaggcaaaaagcactcctttcatggcagcggcaagagacgatgaggaagaagcaaaagcggaaactcctgataaactcatcagatctcgtgagaggtactcactatcacgagaacagcacggcaagaccacccccttcccccccgcccgaccacgattcaattacctccacctgggtccctcctgtgacatgtgggaattctgggagatacaatttaagttgagatttggtggggacacagccaaaccatattaataatcaacaaatgttcacgtatttcctttacatcaggtggagtaaaagaacaggtgtgtgaaagaaacagaatcaatcattaagcgatacttaaaccagtgcagattagttttaatgtaaatgttataataataatgctagtcagcagttactggatattcatattatgttagaaactgtgcatttaatacattatgggtttgtttgtttgtttgtttgttttgagacggagccttgctctgttgcccaggctacagtgcaatggcgccatctcggctcactgcaacctccgcctcctgggttccagcgattctcctgcctcagcctcccgagtagctggaataacaggcatgcgccacaacgcctggctaatgtttgtatttttagtagagacagggtttcaccatgttggccagggtggtctcaaactcctgacctcaggtgatccacccgcctcggcctcccaaagtgctaggattacaggcataagccaccgtgcccagccctttatgggtatttttaaagttaaatctcacatatatactaccgactctaggaagtagctaaggtgatcaaaacatcaacatgatcagcaattaagtggaaaggggttcctgggggatggttttgaccaagacattaaggagagaagggatgggcagtggtgggaagactgagaagctatttatagcagggagatagcactaagcatgcattgcttgcttaagaactgtggaccctgataacctaaaaagtgtggttttgatgaaaactgaagagttatacctttatgcagtttaaaaataatagactgatatctatccatcccttcatgtttgaacataactggtttggagatgtgttgaaatgactgatctcaagttctctttcaaatctgaactaaatgtctgtgtgatggagatagaggctatggagctgctttcccgagctcattgatacagccccctcactttcgccagtgttttacattctggcaaaccagcatagttctttttatctgtagttattatacatctagttgagaaaacccagtttgatctatttataccaaagtacaaatgaaatctgaattcatctgattagttcttcctgtaaaattgtgttcatttctatcacatatgttgtaacataaagatttttggtgatatcctagtcccaaagtgataacctagatcatctgactctacattctccataggaataaatcatacgaatctctctgaagtaatgttataattaattcctaaaggtaatttataattatatatatgctactttcatgcatatttgatatcattttgactttcactattcatttatcatgtttgcaagccttttgttaaaaatagctggtacacaaatcatttcctgattgccacatctggaaccctgattatatttgcatttcacagtcgttagcctttaaaactagagcagaatctgggaatttgcagacaaaacagtgcttccttctggcagttgcataaaaagacatttttaaatctgcatttctgtttaaagaaaactgatttattttcattctaaatttatataacactttctttaaactaatcataaaatgtaaattaggttaactctaagctttttccccaccagaacaaatgacagtaacattttgtacaaaaagaaaacgtttttctattcacaccttgaatcattgctctccctgtctttgaaagttaattctgattaagatgtactggtagctcattgaaatctttgacaaagccagcttagctattctcttgagtaatgatttaccttacattaaaatatcttaaacatatgaacattaataactaaagtgatgaatattactaatattgggactcaattcatcaaggagaatactttggggaagcagatggactgtgaagggacagggataatttttaactatggccttgatatttagaccaatggccgaggaaaaccatgaagaacatgagaatgggcttcattcatgtcaaggaagcagagtatttgctgatggcttaacatttactgggcatgtcctaacaggatagcctgaaaagatacataacattttatctgagtcatttaatttaaccacatccctctgtgttagtgttatctctattggtagatagaaaccaggctcaggaagattaagaatgttacctaattctagtaagctgcaaaacctaaactgatttaattccagagcaaagatctttctaccttatcagcatgggtctttacctctttgagaatatatgagctctatgagccttcttccagaaaaatccataaataaacaacatgagacgtggtatatcagtacaaatctcactaaatgattagtgtgtttggacttgcatctgctggtagatcttttgcgaatttgccttcctctgagatagggggctttaagtattttttctgaagacactcccaaattatacatataagaaactattttcctttcaggctaaagataaattaaaatgtatttaactacatataggtgccactgttggtctaacactctacatataccaggatacaagctaagatgggttcaaaaactgtccattatactgtaatttgtttctgatatcgtgacacagatataatttaatcaattataagacaagaaaaaagacagaaatgctccttcttcctcctcaacatcatgtaattagcctaccccactgctctaggctaggccaagtttttttgtttttttttttctcctagtacaggaagcatattttagtgactctctgtcacaatcttctccacttcaagtacatctcacataaatctagcctgtcccacaaagtttgtgccaggcagtcttagggtcagttgtacccacgtatgtatgattttgaacttctcaagtagggccattgtagtcagtagagcacagtggttggtactgatgtcaaactttctgagtccaaatactgcttccatctctgactagctatgtaaccttagataaatcacttaatgttttgaaaagcatctgttttctcaggaaaagaggataataaatacacctacctcacagggttaatgtgtaaattcatgtaacatgggataatgcacgttaagcattgcacagtacctgcctcttgttagtaatagctgctctattattaattatcctctttgtatccccattctcagctcccttctaacatataatagttcttcagcaaatatttactggcttgaattagttctaaaacttaggcaatgcaccaacagcagagtaatcacccttaaccatcacttctcccactgaaagggagaatagacagaagccaactatctaccctttttctacataaaacctcttatcgagcctccagttaataaaataatagttctgaaaccccaaaaaatattagcaattgttgaaatcatgctagtttgaaaatagttgagttttcctaacaaaatatgtctcaggatcccagggtcaccaagcttatattaatatagtctagttgggactaatggtaatcatcagtgaactagtcattttttagcttcttgggctcttaaaaaatttgttatcattaagcccacacttcatagagtcacagctattttatttttataggagactcaacagtcaaagtaatctctttaaaaccacaaagcatatgatacatttgtcctgcttaaaacttctaatggttatctagtgcaaagacactaaaacataaaccacttaataagacttataggcctcaagtgctctggcccccttcagtatctcttccagaccttcatgggttccaggcatgtttgcctttttcaagtcctgggatgcagcaagcttgtagctatcacgtggctttgcatttactgatccttctgcttagatcagtttccctctaatcatttcagtgtcatttcagatgccaactctactaccttggccagagagaccagcctgctctgtgtctgtctatcccattaaccagtttcacttgtcaatttgtttacttatgtactctaccaccctcccccaccccactcccaacaactagggcatttgcttaagagcaaggactttgtgttcattcaccaccaaatcttccaaggctttcaacagagactggtatctggtagatgctcaggaaatgagtgttgaattaatgaatgaatatgtgaaggaatgaaaaaaaaatgagagacactatgaaaaaaatatttctcttttgaaagaataatgtaacaaggaaaaaatcttcattcaattaaaatcaatcatacatcgttactaacatcacttagtaattcacatgcaatacaaaatttttctctactttctggttctatccatgtaattaattaaattttgctgactctaaggccaatctgtgagacattatttaacttccttactctaaaatttcagcattaacttggcaagaggcatcatcaattagtggtcatctgatcttgcataaattataattaacctttcaatgcctcagttttctcatttgtagtgtgggaattatacaagatgtataagtttataagaataatcacattaataaagctcttagaatagtgtcttgcatctgccaaacaatatagaagtcttgactactgttactagtattattattatgagaattaaatgtggagaataatccttcatacagttgtatattccactgaatgtaaatggaactaacaaaatatttagaaatcagattaaaggtggggtggtaaaatataccaaggtagaagattatgagggtataaaagcataacagtatttttgtcttttgttttactttatttttaaaagaaggaaagagtctagaaataaaaagacaaaaactctccattggctgtggtgaaatggagatcaccggtgtccttcataagtgaaatttcagagcagtggacaaaggtgttggagtgagggaagccagaagaaagtaaactattgagtaaataggacatgaggtgtggaaaaaaaatctataaagataacaattttgagaaggacagatgtgaatgagacaaagaagatattggatgaccaaggaaggtttcatgttgcatatatactttttactattttaaataggagttagtggtctagaatatgtttgaatttttatggaataatctataaggagtaggtcggctgtggaagactcagtgctgtgaagttcttgatcagatgagagaaaatggaataaccactacatacagtgtgaatggcctttcacattaactctaacaaaaagggaatacgaagatcactgaagatgctaatggataaatggatttgacagtgggccatttactggcttctattttcttaatgagatataaagcaacacatcagctgagagaaggaagtaaagaagaaagatgggaatttgaggaaagtggggaagccttatttaaaaaaaaagaaaaaagaaaaaaaagaatggcccttaagtagaatgagaaagaatttactggttagtcagagcagtattcccagtcttggaagcccatttgtggttggtgtttattaatttattggaatacagatgtgccctgtcacgtgatttttctccagctacctaggaataagttatgaagaggcagaaaagagtgagagaagacaattaagagaaaatacaattagtattttaaatatatatgtgatgttcaactttaatagttatcaaaaaatttaaagaaatggaacatgagggtccagttgattaatttatcaaaatcagtaatcacatatcacaatatcttattttggtaatgtacttcatctaatttggttcaacaacttgaaaagtaatttggcaatgtctagtaagataaaagtggtcatagctttttactcattaattttaattctggaaatttactaaaataatttatatttagaaaatcattatataaaggtgttcattgtcctgtcatgtgtaataacaaaaaaaatggaaacacatttaatttcaacaataagaaaatgattgagtaaagcaaattatatccaattagtagaaaattacagtcattaaaattataattatgagactatctagcaaaatagaataatgcttactgaagagagctgatttcaaatttgtcagccttgtgacaactatgtaaacatgactatttattaaaaatcaaacaaaaataaaaatttaaaagctctgcaacagtaatgggaatttttacttttgttttaaaatatttttagtatggttcttttttataattttgttctttaagaagaatgttaaaggagatttttttggcccctttttaaagactctctgattattacgtcttacattttcaaataaataattattttaccagaaaagatcagacttatttgactgattatacttccacattatttggcagaaaaataagaaatgtcacttataattgtttttagaaaaaatttcaagattttttttcttttttgctgtatttttcctggaatagagattaagcaaactgcctaaaattctagtcattatttttcattattttcatttttattcattatcctgcccttcacaggaacagtaatgaatctgcaggttgcatctgccaatttcttgtctcttatccacatgatgaagccatgctgatatgaacacatccactattttaaaaactcttcagttattgaattataatttggtcttctgttataaggattttatataagtgtaaaatttggactcaacttctggaagccttttgtcttcttagtctaaacctgaaagatccttaatattcacccatatgacaaataattatttgcatagttagaagctcctaaattatttattaaggatacctggcagtgctcttgctatttctcagtagccctttattgaagtttctctctccctctttctcttgtacctacatacacaaccctaaagtaattagggtttttttttatgaggattgccagtataatgtttatagtttcttttacaggaccagatacaaagcaggcactcacggcattgttagtaatgttatcacttttctgttattatttaggtcttcattttcctgactgtgagtttccataaggaaatacaatttccactacatagggtaacacctgttatctggagagattttaattgacctcattactcaaaagaaaaccccaaaaccaacagatcagttgcctgccttttgtgtttgccttacaccagtgttcgataaagatttaattatttaataagttctacttttcaagaaagtagaacaaattgatatggtaaaagagatgagaaaactgtccatggaaaaaaatgatcaactcacttatgtgctgaaagcccaccttaggagaactgctgttttgagaaacacaaaggaaacgtgtaaaaatgtattgagtaagttatagtaattatttttaagagctaagcacaaaatttcctgttgatttacatatttggtaccaacaaaaatcatatggaattagtcatattaagatacaaagttgagctacaaattcatagtctaatttatgaaacatgtctttgttggctgttaaaaagtaagatggtgagtgatctctgagtagcagaaggcaaagagaaaaatagccttttttacattatattatacttctgggtaaaatgtttcataaatctagctacaaagctatatgttctgtagcttttaggtacctgctgtttcaaagatttcccctgtggagattagattttgccaaggaagggatctgtaaaagtaatacaaatgccagtatcattggcaaccacgagtgccagcaaagtgagcctccaattcaaattgatgagcatactatcctgtagtatcttttccttgtgagttttctgttttggaaaaggtgggtagaaaatgtattttaaaaaggctttataggcagaaataacaatacatcattctgaaaacataaaatactttagctaaagttattacagcatcttacattaatatttcagcgtacattagacattgcctacaaccaatgtttatgataatcactgccctctgaagtggaatcatgcccgtggcaaacaataatcttaaagaagattaaacaccgaaaagacatttagcatttaaagacagtttgctttgatttattcagtgagttcttccaaaaacatgttaccaggaattattgcttattgaattggaattaccaaccattttagaattatttagtttttttcttcaacatcaatatcagtaaggtaaagcaaactcaaatatttattggggactgcagaaacacaaccataaaacaagaaaacacttgactttttaaatagactttatattttaaaacagttttaattcagaaaatttgaaagtatattatagagatttctcatacatactatacccatttttctctattattaacaacttatattagtatgttacatttgtttcaattagtgaacaaatattaatatattatcattaactgaagttcatactttgatcatggttcctatatttttaccttatcatgtcacatttgtgttccaagattccatcaggatactgtattacatttagttgtcatgttttcttaggatccccttagttgtgacaatttctcatactttccttatttttgaagaccttgacaattttggataatactggacaggtattttgtacgatgccccactgctaaaatgtgtcttatgcttttctcaagattgggagtgtgcttttgaggaagaccacagagataaagggccattttgtcaagatgacttatcactgctgatgtcaaccttgatcacctggctgagatagtcgtcatcatcaggtttcttcactctttctttctctttctgtattatactctggaaggaaatcactacgctcagccaacaataagaagcagagagttatactccgccttctttggtttgaatagctacagaagctatttggaagttttctgcactggagacttatctatcccccagccatttattaatttaatcccttgtttacgccagtaagaatctgtggacattaattttatacttgggattatataccactttattttgttgctcaaattgttccatcttaaccattatgaactctttcaattgttcccaggctcaataattgtgggtttttaaaaatcacttccttaatttctcacactaccagatggtctacttccatcttttatatttcttgccctggttctagaattggtcctttctccaggaagctctagttcctttactggggagtggtattagcaccaagatctgggtgctatatttgctcattgttactggggtttcattgtttctaggttgtcttagctgactgagtgaagagatatgtgtatgtatactaacaatgtgtatacacatatctataattttttatgtatgttgctatgcatatgtacatcaagctaaggatgagtttatattaatgtctccaaccctaatctactacctcatgaatcagtctagccttccttatctacaaatttcaccttcaacagaacacttgacttctgcaagtgtgaaaatcaaatcgtaataaccttgtgaacccttaggaagccatttgtctagcagaataattcctaaagggcatggtgtatatagtcaaacttcaatttatagccagcagcactttttaacattaatagaccaccgcaattctggttctgataagatggagtggctgcatttctcccaggtattttcactttccactaaaactatgaaatgaatacaataaataagcataggaggcaccaaatagtgaaaactggaaggcagacttacttcgggacttaagaaatgacctggcaatgagttccctgttttctttttgcctcccacatagctcagacagggcaccacaggagcctccattccataaccaccaacagacacagacaaaaaaagctccaagaaaactctgtgcttcttagccaaagtatgagaaaagagatttctaacaacagaaaacctttctggcagtatgtacacctctccagtaaaaccctaatgaaaccataggtcatggttacagacatgatccatgacttttgtttcagagggaccaggtaaggagttgatcgtgcataccaccctactcttgcccttcacaagcaggcagcactgtggttcccccaccagagttgttgcagtgtggttcaatggagagctgagcctccaccccacccgtcaggaaggagacttaaggagatcatgccagacagagctaattacaaatggactccctgcacacagccatggggtccagtggggagctaagcccccgcctctacttgccatcagcaacaggatgttgcaagttgggtataggaggcactgtactttccttcaaaacctggggtcaggggagaccagtgaggaactaagcctctacacacacctaacaccaataggatagaattaaggtagtgtaaagaaagagagttgacacttcatttccctctgccttggttcagggggtctgttagagtgctgagcctccattcccatttgaaggcaacaacatggtatgagtggtcccattctccttgggaaggtgtcagcaaggccaaaggcggagctaaacttctacctcatctgtctgcagtaaggccatgtgagtcagcgtccctctgttgccagtatggtgtcagcaaggcccagtggaacctgtacattcccacccttgtagctttcttgctacaccccaatataggggagcttccttctaaaaataataagttaaaataagatccagagtcatatactactcataatgttcacaatacaattgaaaactaccaattataccaagaaccaggtaatcacaaaataaatgaaaaaaaattatagtcagcacacactaaaactgagataaatcagttgttgaaattatgtgacagggattttaaataagatatcacataaatgtttcaaaaagcaattatgtatttcttaaaataaatgaaaaaatagaaagtataagcaacaaaatagatgttataaaataaaaaccaagtgaaaatgatagagctgacaaatacaacaaccaaaataaaaacctttgttgggcaggctcaagagtagagtggagatgacaaagcataggatcagtgacctcaagaacagataaatagaatttaccaaatagataaatagaatttatcaaacttgaaaaacagagaggaaaacataggcttagtgaagaagtgggtaggaactcaggaacctgtggaacgaaaaataaaaagctaacatccatatcatcaaactcccagaatgaaaacagccagccagtgagatggaaaaattatctgaagaaataatgacagagcagttccccaaaatggcaaaagacataaacgtacagatttaagaacctaagcaaaactcaaatagggtagacacaaagatattcatgccgaggcacatcataattgaacttctgaaacataaagagaaaggaaaaaagtctgaaaagcagatagagagaaacaatgcattacttacagagaaacaccaattcaaatgacagcagatttcggatctgaaactatggatgtcagaagtattggcataacattcttcgagtactgaaagcaaacaactgccatgcacgaacttcatatccagtttcttctttggcttatattaatgaactattaactaaactttctgtgtctaggattgcaactacccttctccaacaatcaagccccagtatttccaaagtgacctttctaaaacaaacaaatatctgatcatgttatgcaaataaacctttctatcttcttttcctctaacttgaacttttctgttaaaaatcattcaatggctttccatcttccttacaattaaattccacactctttcatacatacacaaaccattctttatctggctgctaccatgctctctgttgtcttctttttttacacccctctaagcactctttataccagttgtatatggcatttctttctgttctgttccttaaccattctttttctttctactgtgaatttatctcctctttgactcaaaaatttacctctccttcacattacacatccatctccagtattgccttctataggaagacctgctaatatttctcacttattattggtccacagaatgaattaagactgctctctcttccattacactatgtaataatttgtactatctggatgccccaataaagtaaattcttgatgctaagataatgattttaataaaggttacactgaagtctagcttaatccttggtatacattaggtgttcagtgagtgttaaatgagtgatgaatgagtggtcaacttgaaatcttaatttttccttttttttttttttaactaggactgtatccaagatacaaagttttccaggagattagacacttaggacctttgatttgatttaatagaggacattgttatcaatgcattagtacttaattacctcaaaagaaaactgtcaacccaggaactaaagtttatccatttggacttacaagataacctttaataccccattgccactgtatccgatgctgtcagaggcccacctacatctccccctacactcagcatttcagtgcatactgatagaattgtgctatcacctgcaaatacctctttagggcacgccagaagtgtgcaggagataacatatctggctgaaactttcaatccctgacagaggggatttgggatataaatacttcgactttctcacccactggtggggataaccctgaggaatgttcttcagggttccacaggactcctctaagggacttgtaacagttccccccaagagtaacctgttcagtgctgtgcctctcttggctttctttcatgcctctattctcaattccagctctactcctgagtttccttgctcactttccaggaacagtttgaattcaaattcttctctcaggctctgcttctgagggaaatcagtctaagacaatcccaaatcacttctagtctcctaataggccaatgtgcctttcagggtcatcactggtacagatgctgagggctggctcattgtctgtcgctcctagattctaatgttttcaatcagatagaaaagagtatgacattaaagttagaaaaaaggtatatgagaatggccaataagtggagggaaagagagatcatgtcatttgttttccataaatgatgaatgatagtatagaatttgtgaacaggtggtctataacaggtatgagtataatttgagaagactactccttagtcacccagaagtctgctattattgtttcagaatcacagtgttggaacctttttgcataatttgcttcactttaacctaatatccatctttctaaatctgtccatctttctaaatctctaagtagtagtcaacagatttattctctccctccatctcatcacaagaaaagccaaacacaaacacacacacacacacaaacattttgtgtgtgacaacgcttgaacagacattaaaagtctctgtaaatatccttcaacaaattccaatgtttatgaagaactaaatttagtcaaattaattttttgaagatctaagtgaagatagaagagaaatctagatgaagactgaagaaccaaagtgaatattaaagaaaagacagaaaacttgccttttttgcccgctaaatcactgactagtagtcaacagatttctttccccaccaccccatcacaaaaaaagctgcacgcacacacacacacacacacacacacacacacaattaattaacaaaggctaaccaggcctcttttgaagactgcttgacttgaaatcccaaaattcaacctatactctcatcacgtgtttgtgttgtgagaattcatactcataaccacgaaagttcctgaagttatgatactgttcaaatgacggatgcttgaacatttgcttaaaatttttaaaaatgaaacttatatgtacagataatttccctttctcttgctatctgcatttcagtttcctgactttctgagaagccctggtttccccaaagaagtgatttctgatagaaatctgaaggtcatctccaagaaaaaagagatctagtatagtcaatgaattaaagacaagaaggtttccaatcaggtaggaacactaattctcaaacatttaattaccttaaaataagtatgctgagaactggttatggtgtgactgtctgaaacaataagtatctaacctaccctacaaggaacctgttcacaatccccttggaggttgtgatgtttatcagacaaaaccttggagggaaactcatacaataacagcatgatgcttttttctatttttagcttgttgttactaagtacacttagtgagctccatgcatgtggtttaatcccaggaggttaggcctgtggagcagcagattaaccctttcagtattttcttttaaaacaaatcattttcgtgggttgtctccgtgaccctctgtgaaggtcatgaaaattatgggtcatgatggcatttagttctttaagaggaacagtcctaatgaatgatgtaaggaagttgttttggttcctatggggcacttctcatcttggtcttgggacaatcaaagtgagcacgtatagggagttgaaagggaggtgaatggagcatgtgaaaggggagctctgttttcatttatctatgcacatcagcatcccactgagaattttcttttcatttgcaatttaagtccaaaacttggggcaaaaggacatcccattttatggaaagaaaagaaaaaaacagcagtaacatcataataagtggctcatcttctcatttgcagttatattaatatatacttattaatatatacatttagcacagcacttgatccctagtcagtactcaaaatgaagacacatactgaataatggatgaatgaagagaaaaagtttgtccttggattgctttgtgtgttggcttctgtagtctcagaacccagtactataactaacacataaaatatgggccataaatctttttgaattaatgaataagtccccatgattctaaggacaattataagaccaacacaaaacacatatttgccaaggtctgtgacagaagtatctgtgacatgaaagcctgaatctgagtctgctgatatagctgacaatttttctagttctgagactgctttttaataatttacatcttatcctttacatttaggcatagtaccttcattagatgtactattcaatgattagtgcttggggagaaaatccatcagataaatttcttaactatattacttgcaaacttttcttttcttcagatttataactgataacagtaattgtacatatttatggggtatagtgtgatgtttaatgcatatatacattgtataatgatcaaatcagggtaattggtatatccatcattttaagcatttattatttctttgtggggataacattcaaaatcttctcttctagctatgttgaaatatacaatacattgctttttgctatagtcaccttactgtaaaacatatttgttaaagcatttttataatgacacagttaagggcaatttcagaatcactagctgctaaaattgttatttatacttttccatgggtagtacagctgcagcagctatttctctatattctgctgttgctatctgctgcatttccaagagagaacaaaatccatttcattaaagaaggaaatgtaaaatttagcataatccagttaccacaaaaccaaaacactcacacacactctcccaggtgtgaaagtgaactagtgatctaaaatagcacactgaaactggtttcaaaataagaggacatttactcatatttgattattttattattttatcaattatgatattcagatatacttctaataacaattctgaattgctagatggagcattcactatgcacaatttttgtctttgtatgtacttatcaataagctacaagattgtctcccacaccttattcttttcctgcattctcttgggaacaggagatgtagctatcattttttttaaaatttctacacagccaaaagactagtatcacttaaataaagacagaaaattgccccaaagtagggagcttcattaggtagcataaagttctcatgtgagaaaggaagaatttcttttcttagctgaaagttctctaagtacaaaattttcataaataaatgtatctgtggttttggattagatctccttctccacaattaatgtctaagggttatcttcggtaaccgggaaatttttattttaaaaacattattatatagtatctgatacatgcaaagtaatgcatgcaaatctgttatatgtaagttatgaaacataataaaaataaactcttgcaaacacaccaccaaaactaagaactggaatcaacgctgcagaatctttctttgtgcttttctctggttctttttttgtcataaaaagtgtaactctgctcttggtttcatattaacattcatttaatttttatgtattttttattaagtatgggttgttttgtggcttataaaattggcatcatactttctgtaactgtgtttgcttttttttcactcaacattattatgtttctaagatatctattttgtttcagctagtgtttattcattgttatcactgtataatacaatgttgtacaaatgtaaaaaatgtgtatattatcctgttgatgttatttgagttgttttggatctattcttaacaatgttttatgagcatgtattttaatgcctcctattatacacgtgcaagatttatcttaacatgtgtaaccacgattagaactgctgggtcatggggaatttgaatattcagctttaaaagataatgccaaaatctttttcaaagttacgcaagtcaactttgaaactcaaagtaactcagtcaagttgcagtcctatgattctacagcctcaccagttatatcagccaatctagttagtataaaacctcaattggtctttgtgctagtttgctagggctgccataacaaaatatcacagagtctatggcttcagtaacagattttatttttacacagttctggaggttagaagtccagaaaggtgttggcaggtttagtttctcctgaggcctctctcctttacttgaagactactgccctcctgctatgtcatcgcatggctttttcgctgtttgcacgcatccctggagtctttttcttcttataaggaatccagtcatattggattagagcctcatgtttaagaccttatttaacctaaatgacttctttaaagggcctatctccaaatgcagtcacactgaggactcaggcttcaacatatgaatttctgggaaacataattcagtctctaatagttttagtttgcatttccctaattaccaataggttgaaaatcttttcatctgtttaatagtcactatatttcctattctggaaaattctgaagaatatcttatgttcattttctatttatcttttcatacttatttctcattgttatttaagttcaatcaagttaaataggtttttggagcttgagcttgtatctaccatcttgctaatattacctgttaataagagtcgattttcttaacaaagaagaataaatgtaaaaagtttttaaatgttgtagatcaactctgttccatagaagtttctgtgataatgggaatgctctcagtgctgtctaacgttgtatccattagccacgtgtttttttgaaaaaatagatgtaaataaaataaaataaaattaaattaaaatttcagcacctgggtcaaactagcctgcatttaaagggttcaaaatccacatgtggctaatgagtgaactgtgcagctttaggtggttaggcaatggacctctacagtcccaggattttgtctttgacagtggcatagtgagatattttatgtaacagttattctggcattaaaaagaaaagttaactaccattagacccaacaatcacattactggttttatatacctagaggaatataaatcattctattataaagacacatgcatacaaatgttctttgcagcaccattcacaatagcaaagacatggaatcaacctaaatgcccatcaatgatagactggataaagaaaatgtggtacatatacaccatggaatagtatgtagccataaaaaagaatgagataatgtcttttgtaggaacatggatggagttggaggccatcatcctttgcaaactaattcaaaaggagaaaatcaaataccatatgttctcacttttttttaattatactttaagttctagggtacatgtgcacaacgtgcaggtttgttatatatgtatacatgtgccatgttggtgtgctgcacccattaactcgtcatttacattaggtatatctcctaatgctatcactcccctaaccatatgttctcacttacaagtgggagctaaatgatgagaattcctgaacacaaagaagggaacaacagacactggggccttttgagggtagagcgtgggaggagggggaggagcagaaaagataactgttggatactaggcttagtacctgggtggcaaaataatctatgaaacaaatccctttgatatgagtttacctatataacaacctgcacatgtaccactgaacctaaaataaaagtttgaaaaaaaaagaaaaaaagttagttaacctggtcatttcttacttttcaaagtaacctaacataactttcatgacatacctaaatttactaagttgtattcatatacgactacaatttatatactaaactacttcttgacataaatgttcactttgtagtaaggttcattctcccaaaacggcacttaccaaagtatcaagaggtatccttattcctgatatgctgtaatagaatgaagaccttatctggtctttagtgtaattggatgttaatctgtaccagtcttcatattcaaaaattcatattcagaattatctgctagtcccatgatggctgtctttgtttcattaagctaatataaacatgtataaataaagttttgattgttttctctcctaaaatctcctatctgtccatgtggaaatgtatctcttactttttccccctcttataagctgttcttacaatttaatcctcatgagtcttatttctcctagttctaattacttagaattttattttaaaatgtaagatatcactggtaagcccctttttagtcattttatagatgacttatagatggttggaagatattcaagacagtgtgttaaagtaataaataatactcagtaatcagaaaacctgagtcttagtcttcacccataaaaatgaaccatgtgaattcaagtaagtcatttcatatgtaaactttattctgattctaaaattgttatgatcgtttatgaaattctgtttcacttatgacaagtctcaagcctatttttaaaatctatttaaaaattatgaagactcaaatattttcccctgaaattgatattaaactgtaatcattcatcttcacttacggcatgctgtagctgcagttgatagacaaaatattatgtctcaacattgtgtacttgtatcttaaatgaacacttttgtttcaaatcatgttctacctaaattcttgatgcctttttcacatttccagttcctatgctgttacaatcaatcacttgtagtagaaaaaaatcattatttttttctgtttgctaaaagctctcgttagaatatcaagttttaagttattaatacaacaaactttggaaaataagctctcataatttccaacattgatgctttgtttgactggcttttagaacaccatactctcctagttttcttcctttctcacttcacatttctttctggtctcctttgtgatgcctccatttcttagtgtttattgctagagtgccctaaaactcattcttggccctctacggttttctgtctgtgcacatgagttttattctagtcccattgcttcaataggcagatgactatgactcccatattcatacctctagccttcaccactctcccaggcttgagattcataattcccatttcccactaaatatctctactttatatatcatagacatttcagaattagcaaatacaatgaaatagtttacttttttctatcactttcactccagttgtttccatctccatttgctcaagccaaaagcttgggattcatccctaaactttcactttccaacaatttctacatgtagtccataagaaactctttccacctctaactttaaaatctgtcctggatccctctacctctcaccgtcttcaccctacagcaagccatcattgcttgcctcacctagtgcaacaggcagtctcttacaggatcttcctccttcccctcttgccacggtccttctagtttataacaagtacaatagccagaataatcttccaaagaaatttaaaccaggtaacattcctgtccaaaaccctggctcccatcacttttaaaataaaaattaaactgccttctttgacctacatggccttagtcaatgttccttctgccttactgtccaaactcatttaccactttccccctcacacactcgcctctagaatgtttttccctaaaagacttttccagcattaggacctttgcacttgttattttctgaacctggaagacctgtaagattcctcaaaataagatctcagaagatagttgcattttcattttgtggaggcatttggtgagagacattttgcgaaagatagatacattttactttggagggtatttacacgtttagcaatgagcaagtttattaaataacaaatgcaaaagtgatagagcaaaggtgtgtattttaaacagagaaatctgaggaattgtagacatgtgagttacaccatggcttcaatatttaatgcataagaatcacctgagttgagttccagacaaccatttccacccataaagattctgaacaggaaatcaagatggcctggggacatcccttttgacaaggtcttcaggtgattctgctgcatatggtttacagacaaccctttgagaaataccaagctggtatatttgttcagataaacatgggctggtgcagagcaccagtggtatgcaattgaggaccagcagattacatgaatcctgagtggcaaaagaggaagacaatccaataaagaccactacagatactatcccaagcactcttggcatggagacttgaaaatccattcatagaaatgaactgttaatcattgaattgtgctatataattttttaagttgcgaagtattaaaatatttagataaatattataaattttgtcacatattgctataaaatgatgcatacatatgtcataggtataaagatacagagcatatagatacagatatgtaaagaatatgtaatctaggcttaattatttagctgatactgcatattgtctttataacttcctaaagaaccacttctaatattctctaggaaaaaatattgtttctctccattctttaccactttcctttcctcatcctcttccttgtcctttcccttcttaaacaatttagtacaaaagccattcgatgaggcctagtaagcctttgtcaccatgggcagggtgggtatacagggtattgcagaggttgggcatttgctattaaagcccaagaagtagaaggagggtgtctgcaccgaggagcatagtgtgagctgttgaaagttattggaaggagaaggacatctacatggggaagtggccacagcaaccactcaatacagatagttatagtctgtgctaggtggggagaatgttataatggggtagaaaagtggtagcaacaataatttgttaaaatacagggagattgatctaataagtgcgaatattaaagatgaaggtaatcagtgtttgtcactgtctgaggaggaagttgaagtatgatataggcaaaagctagaatgaactctggtgctggatgaaaatgggggaatgaaagtgctggttttcaatatatttagcaaatatagaattaaacatagatgtaaggtatatatgtgtgtgactatataactgtagatgaacgtgttttcacatgtatgtatgtatgtatgtctacatacacataaatcccgtagctcagtctattgcaaaggcctgggacagctattccccaataacagtgagcaaacctagtgtccagatcttggtgtctagatacaattctcctagtgaaggaaccagagctttctggagaaatggctgattcagatcagagaaagcataagatgaccctagaacatattgttccaagaagcaagaaacatatcaaagaatgacagagagatgtcaaaggacatattggccaaattgaaaggatttcccctgggcaaatctcgaacaatctgagcttcaaaataaataataatagaaactcgttgtagttaatttaataaaatggtcaatgagtttatatcaatataaataaattgaatacattatgtttggtgagaaataggatatttacataagcacaaagtatcttgccacaaaatgtattaatgttaaaaaagaaataaataactttacagtggagaagactgggtggcaccttttaatcaaatgagtaaaattagtatcccaataagggtacaaattaaaagtttgcccaaattgtctgttgataggatgtggtgagaatagagcttcactgtgattttcctgccaaaaaacacatcttctgaatctaatcatgagacaaacacaaacagctaaatcctacaaaataactagtctgtatctttaaaggttttaaggctatgaatttcaagggaaatccaagaaaatgtaccagataaaagaaactaagacaggacaactcaatgaaatgtgattttaggctaatccttttgttattaagggcattattgggataattgacaaaacttgaagaagtctgaggattagacagtactatagtaatgtatcagtgctaattgtcagattttcttgttaatatttggatatgtttgtaggaagcgtttggggttgacagggcattgtgttgacagcttactctcaaatggcttgagaaataagccatttttactgtcttttttactgtcatttcaacgtttttgtaagtgtgagatcatatttttaaaattatgaacaaaagacaagtcatccctgagtcagataatccttcttcaggcagctagtacagttaaaagctgtttacaatggtagtgggcttctagcctagtggtgctaatctctcttgctaataccatgtaatcccagcaatatttcgtgtttttttttttttttgaggctttgggattttttttctaatgatgtttgtattagtccattctcacgctgctataaggacatacccaggactgggtaatttatgaaggaaagaggtttaactgagtcacagttccacattgctggagaggcctcaggaaacttaaaatcatggtggaaggcacctcttcacagggtggcaggagagagaatgagtgcaagcaggggaaatgccagacacttttcaaaccatcagatcttgtgagcactcactatcacgagaacagcatggggggaaccaacaccacgattcagttacctccctctgggtccctcccacaacacgtgaggattatggaattacaattcaagatgtgatttgggtgggaacacaaagccaaactgtatcaatgtttttgttttcttttgatgttcttactgtacaaatgtctataaaattagtaaagttctctgtattacaataaaatcaacaagattcatgagaatgaaaatacgttcttcaagaactttatatatttctacctgcactcaaattggaataaatgggcatgaaattcataagaaaaaacagatcataaggaactttcacactcgcaaactcaaaacagttgaacatgtttaccctgtaagagggcgatgataaagcagcagggtgacaattatatatccaaacagaaatgcaaccttttaaatcatccatgtcaggccatgtaacaactgggcaattcagcaaacaagttcaaaaaaattcctgttttcaacaatttctcaactccacacttagaaaaatgaaaaacttctctttaactctcagaaacctgggcacttatttagttaaagcaaagctgttgtctactggcctatacctggttataaatagcagcaagacatgagaagacccagggacactgaatgagctttctaaatataggtttttcttacttcaaaggccttttagaagaataccatactttgtgaaaacttgccctttatgaagggcacacagacactaaagtcagcaatttttagaccttgaaaagttttgaaatatgtctttagtttgagaacccacattttggaggcatgaaaactgaagtgcagagaaattaatatttttcccaacatcagatggcaagcaaatattgtaaaaattatggcactgaaacccctgtcttctagtcaattgaatgcagcttgtaacagattgcagtaactgcttgttttcattgccctcaaaaccacgttccttctatgcctcatccctcttgcttttgtgagaggcataatagcattacctgcaagtattagctgtaagaaatatttttcaattttacttttttgtaagtctcgaaatgctgtttctgtgttaaaaattggtgagagcattttcctttcttctttaaatgactctgcttgcatttgcagtcttttacagttgaattactgtataacagtaagtctaaaaacacattttagtagaggagattatagttggagacagcaaggtggggactggagttgtcataccttagagggaggtgggaaagagacaatgttggcttgacctaatctattataaccttccttaacccatttatgcctagtgttccattatcggaacggtaagtttgtgggagtcatttatatcccactgctcaaagtcatcaccaaaatctgatttttcaaaaaagaaatttgcaacctctggcatcaatgggctaattgaagtcccagaatgatttctgttgtttgcattgccacaggcgagggagtatagaaagcaacaagattttcatgttttcccatttcatattaatttcctaaggatttctataagacttttaaaaatatatgtaaaacagcttatttttagttttcccctactcatttgcattttaacatgttgataagtaacatttaaactcagtagttatgattaaccctgttctacaattctaaaagtactgggaagtgtgtgtgtgtgtgtatgtgtgtgtgtgtttgtgctgcctttgcaaccaatcaaatatagctctcagttgaaaaacaattattatcatatagacaataattagatttgatagtggggccagccattggtaagtttaaaagtcaccctaggtgatttatatatgcagttgggttgaacacctctattcagatgaagcacttagatggaagtatagccaagcatggctataatttcacatctgaaacctgttttatcctgagtcatttgcatagtgcttattatatgtgtttatagagtctttggttgtgttataagatattaaaagttggtgtgaattaaagaagtgacatgcaatgatgaaagcctagaagataagcaccagatcttctaattataactcaaatgagtttggttgatacaaaatattatgggaattagacacaaacattactaatgcataatgctggaataaaaatcttagagttatgtaaatatgaaagacattctatctaatttgtaccacaaggtaataggttcaagcatttttatttgtatgtatttactttgtaccctgaattgtgcagaaaacacttttctaaaatttagagtgcaaactagaaaatataaatctcgagtagttaatattgtagtcaaaggaaagattttgagatcttttaacgtctcagttcacagagacctcttcctcagatggattggtttttatttgttaagattaatgtttaccattttaaatagtttcttgaatattcctggtaatggaatagagtcataataataatttctagttctgctaagagagtcaatagtagagctgcttgatattgatagtaattttgataatatacaacatgtcatgattttccagataacaacttgtctcttggccaaaataaatacacatattgtttatcttgttaccttataaaaaatttttttattttgttagtatagcgatttgaccactttttaaattaatattttaaaatagttcagtggataatctcattttgaaatgtctattgattgatatatccattatatattttatatatatgggtatatttctcattagccaaattgatactttcttatttacacttacatttaaatcacatttctgctctacagcattttcttttctctagagcctattctactgacttaaactagcctgaaagatttgaaaattctatttaaaacaagtgtatggaaaatctttgaaataacttataacagtgtcagagaagaagagtattacacattgtactgaagagcattccattaataaaaagattaacaaaaaattctaacaacgttcagacatgtaatagcaatgaaaaacattaattataatactgaacaattacattttcggtagttaaaggggataaaaaatgctatataggaaattagcatctgcagagaagatattataaattggcagtgattatgtgtagatttaaaatatgttgaaacatgatcatagcaactgtttttctttttggttgaaaagaggcatattaaagtgtttaagcactttttcgattggagtagatatttagacactgtacagaaaatacttgcttgcagaatagcagatattaacatgtgtatgaaatgtgtgtttttaattaatgcattttcattcactcagaaaagaaaagatcgccgagtttagcttaaatgtagcattgtggcatattaaaatggcattcttagactttccacgttgctgttccttttgccttcactaaacagtgctggcctctcatttatccaagttagaaatctagatgcaattctaaaattgtcaacctagaatcctctaccttcatgcttcccactcaataaatcactaatatctgactctcctatttcaccaggcagtcttctccactgcacccctgctcccttattctcagggcctaccatctctgcctcaacctgccaatcaaagtcacttctatttcattatgagcagggccatttttaaggtttctcccatcctgggcaattgcacttttggaagctccacactacattttatcaaatatattaaaatgtatccaaatcacatatttaatataatttattacataactaagtaggagatgcatttcatgagttgtaatattagtgctgataatgttaataaaacatgcttttaatctcacttttgcattttcaaaaatattttggaagcttttttttaggtgtcaatattttcataggtctttctcaaactcatagtctctacagagtgtgcttttactatcacaaggcaaaacagccctaacagtgaggcaactgaatatgaggaacatcacctggataattaaaccagatttgtgggagatggaataggaagtgtttgtagaacaaatacagaaatcaaggaaaagatggtggtgtcaattaatactctgcataggagatcataatattcaaaacccagatactgttgagatatcaatagactatcaccctatagagtaatacctcaaaacataatgtaaactacttacatatttaaaaagaaatattgatggcaaaccattaacagaaagtgaaggaagtttataccccactgcaaacattggaaaatggtaactgtaaatggttaaatcacctattagtttcatgacttaagatttctaaacctttactatttcatcttttaaagtgagataatgagaatactgttttgagagagttgttaagaaatttaaattatataatccatatacacagatgtgatatctggcacatatgtaatatttgtttttgttattgttattattcataaggcactattaaaccgtagctgttttgttattcttatggtcattattatatcttggaacagaccagaaaatattactgagcttgattggatcctttttttgattttaaagatgaaaaagttaatatgagttattttgataactgtgtcagtgttctaatatcctttgaaaatctaagtatttatttaacataggagggcaagtcatagattaatgagaggttatagattttaaaagtatctttcttccttggactcttacagagccagtaaaggaaaagataaaacaaataatttggcaagtattatataacaaagaacaccaccagccccaggcccttaatgcttttgtgattttgatgtgaataaaccctggtcccctctctgacgtcagtactgctgctgactgggtaagacattggtcaagtcgattaacctttcgctgctttagtttcttcttttgtaatgtgcaggtaatattacttgtcacttgccaaccagcagtacttctgcagctaattgactttctcagcaggggtattgcaaagattagtggataaatgatttataaaccctttgaaatattaaatatatgatataaaaagccctagcaaaaggacagaagaaattattccatgctttaatttgctactttcgtcatatatatttgataaaaaacttaaaagaggaagccatcaacgaagtgaaaataggttagattactcgggattctagatgctttctattgctgttattttaaaaaatcttttgttataattgtgaatataagaaaagaaagtgtgctagagatcataactgtgtttatcttcttaagtttataaaaaatatttcattagacaggaaaatgaactgggtaagaataaggacacatactctcagcctagttttactatgaacaactgtatgacctcgatcaagttacttaaacaaggaggatcttgagtaagataatcaagaacaatctacataatacattttgtggatttaggaacaaaatacaaaactctgtgccatacattgtagtggattcgaaaatcaaagacccagaaatataatataaagaggtcaacatgaaaataataaattctcacataagacagaattaaatcaacacaataacaaagttatttattctacctggagatggagaaagagtgtgactggaaagataagaactggttgagaagaccaataggagaataccaagagctttggtactttaaatactttgggaggctgaggcgggtggatcacctgaggtcgggagtttgaggccagcctgaccaacatggagaaacctcgtctctactaaaaatacaaaattagctaggcatggtggcgcatgcctgtaatcccagctactcaggaggctgaggcaggagcatcacttcgacccaggaggcggaggttgcggtgagccaagatcatgccacggcactccagcctgggtaacaagagcaaaattgcatctcaaaaaaaatataaacaacaacaacaacaaagtgcagtgtaaaacgctaaatacaatttgatatggatgactattgtgaaaagactattgcaagagtgaataattatttggtgaataattatttggtgaataatctgtagtgattatttagtgtacagattatttggtgtacagattatttggtgaataatctgtagtgatagttcctgagaaaacagtcctcctaagttaatagatacatgtgtaaaattacaaggggaattaaaaataaagcagtgtagaggaagcagggaaaattagtatctacctcttttcctatatgggagtaaatgaaagaaaaagcgatgaatgtcttaaagaacatgcagggttgattgttccattgcaccccagcctgggcaacaaagtgagaccctgtctcaaaaagaaaggaaaaaaaaaaagaaaagaaagatttaaaaaatgcagagttaaaagataaaagattttataacagggaagatgtaagcaatttgcaaagtgttaaagaagtagctgaagtaaaattgtaactccagaagcaagaggcagaattgaaggaatgataatgaggaagaagatagaatcaagagcaccagtcaggtattaataatggtgggcaaaaggactcttgaataaagagatggatgaccttaaatgtgataataaagaaagaggattgaagatgaatgatgaccttggtctccacaaagttattaggtaagatttgctatggagagtaagaaagcaagatacaaataaaatttaaagagcatacaaaaaaaagaaagaaagaaattgtttttattagggatagtataggggtaaaccaggaatgagtataagaatttatgagtagctttgaggtcactcgttgcccaattataaaagtattttctaaagaaagatagtacttctaacattttaaacatttacaggtaaagagttctcattttaaagtttttacgtgttaaacattgtagggggaaaaagtatttgagtctgatctaaagaaagttcgagaggagaaattaagtaatgatgccattcggggtggggaagaaggctgacatttgcaggaatgatgcaaaagcaaggtgggggtgggcagggaactgctggaacttttgcactaagcaagtcagtggcactgaactctcctagtgatctatgtattctgcacccctacacactcacaattagtatttttttagttccaggtttacctaagaatgtacttgatgaagcagtaaaaaaaaaaattcattttcttgaatctcgacctttgagtacacatgtttttaatattcatgtgatgaaatgggacatctcatgaagcacttctgttgtgtatcaaacatgtggttatcacaagtaaagcaccttgtgcaactgtgggttgagagctgagccagacattattttcatggatcaccatttttacttgaacgaacaagtgacaggcaaactagttgttcaaacttggacatttggcagaaattttcttgaaaatgaacaaagtgagcttgtcacttctaggaaagcaaaatctaacagtgtcttttgccaatgaaaaaatctgaactttcaaacaaaaattataatttcagaaaacctattatctgcccctgtgaacttgtcagtttcccaattcttaaagactcttcagatgacatagttggtgttgccaacaagtgtgatattgtataattaaatgtgctaccgtttgggaaatttacataacccagtgtaccaatattttccagatgaccaatgtctgatagttaaaaaaaaaaaaagaaaaagaaaaaaattgcgtggacaaaagaccatttcaaactgcaagaaagacaatgggaactttctaaaggcagagtatggaaagcatattcatatgacttcagattccacattgaaaaaaagccataattatctgaaaaggctattaaaattctcctcacttttccagctaaaaaaaataatatctctgttaagccagattctcttatgtacttcaactaaaacaacatgttaagagatactgaatgcagaagcaaatatgagaaaccagatgtcttttattaagccagacatttgcaaaattaagccagagagttgcaaatgtaaatcaatgccatacttgtcactatttttttttttgctttggagaatatattttattttcattaaaatatttatataaagtgtaatgggtttattcatagtatttgaggtgaattaatacttatttaatttttttcagtttttctaatttcccatatgttaaatattggtagatttatccctggagaatgaaagctaagtggggttcttcataatttttgagcatgtaatagatatctgagaccaaaacaattcagaaatactaatgtagaccaaacactaaacacacagtaaactactcaaggtctttaaacatacttcccatgatttcacaaagtcaaagttgagaagttatataattgcattttgtaatagtggaaaaaggggaattttctttctttctttcttacttaaaaggaatcatagtattcagattaaagagaagtcttcagcgcatgctgatgacattctctccattctttcctccaagtctgtgagtctcatttcatgtgtcccatttacaggagtaaaattagcatgttacccagtcaccatttggctcatgactcaatgtcactataaaaatcattttagcaacatcataggcccaacttctagaatccatcgatgtggaacacttcagtttgtttaacgtaggagacgtaagtacatgcttttcatagcctcttgaaatctgtctaaatctgtaaattctactatagtaataccttatgcttcattctctcaaataatttgtgtgtatggaattttaaaaagaaggcacaaaaaggaaaagatcagcacagatcatgagtctcagttttgaaatccattatataaagaatttgtagagcagcaatattgcttctgttgctaaagagtaagagagtgaggctgtattaagaaaagagagagcaagattatttctaattcatagattttgattgaatttttagatgtcaggttttagagatttatgctttaaaatttaatacaactttaaatagttcagtatttaaataataaaatgtccatttccctcttttccctatcccataaggctgaatattagtataattggatcttttgtataactggatacaaaaaagtaacaccatattaccttgtctgtattcaatactatcatttggtcatgtctagaaaattccagttatagcaacatagacaggaaactctagtaaagaatcaaagtctacttttaataagttttccagattttgtcctgattatttttataaagtcagaatatgtgctagttgctggtctactaaacttccgtctgctgctgacatttatttgactctttttgaattttgtaattttggggggtgaatatctgtcaaacataatttttatggctgttctccagaatttcaaagcaaaagtacaagtcgtctatacaggtatgcttgatgtaaaatatatttatctctcagagtcatattactaaattagaagacctgtgtctaaatgcttgactgaaaaaaaaatagccactaggcaggtaaaaatatctatttttgagcacttaaggggaattcactaaaagcactataatcatagagaaaatctggagtatacaatatatattttgtttaaaaatgtaattgtatgtgttccttcattcacatatttgttgtgtgctatttgttagctattgctcttttattggaaaatagatctattgtctagggaaagaaaatataataagcaatgaaatattacttttatagtaatagctatttctattataataattatattggctactctaactggatatccagtgcttagtttctatgttactttaaaggttcagaattggatgcacatggaactaaaaatatatttcaactttacaggaataatctcttctcacaattgtctctattgtctttcattcaattgaaatgaaagctatatatgaagattttaaaagtaagcacaatatacttttatgtctttcataacctcatttcttccttcatgtgttcattacttgggagtgcactaaatgaaaattcaaagtaagttgttgcttaccctcatataagtagaattgccaccaggatcttttaaaattcccacatagataagtcataacacaagacactttcttttatatataccttctcatggaaaatgttaccacatttctctgcctcatttttggtatttcaaatcttttaaaaactattttcagcaaggagaattagatataaacccctacaaggatatgtattatcatggcagttagaaatgataatggcaaaaaaacagggacctttactgcaaagtacaatgccctttacacaaaacccaaagacatatacccatagtttaagtcatggtaatatgtatgatttagtggttacttaaaatctctgagacttattttctccatctgaaaaatgaggatttgttttcctactttacatcattgttatcagatgagaaataatagcactcgtgcttttttcaagcctgtttgtttgtttgacacggagtcttgctctgtcacccaggctgaaatgcagtgacccaatcttggctcactgcaacctccgccacccgggttcaagcgattctcctgcctcagcctcctgtgtagctgagattacaggcgtgcaccactacgcccagctaatttttgtatttttagtagagacaaggtttcaccatgttggtcagggtggtttcgaactcctgacctcttgatcagcctgcctcggcctcccaaagtgctaggattacaggcatgagccaccatgcctggcctaagcctatgtttttaaaagccatagaaagagactaagagtgaaaatcattgtgaaaagagcttgaatatctcttgtgactccacctctccttaaatatttataagatgtatttgctagattgatgtgcatgttcagttctaaacctttgaagtaatgcagaaaccaaatactgtgttggttaatggtaatgcatataatgaaaatatcttcacaattaataacactgaattattccaagttccaaaaactttattcaaactctgacttactcatagacaggctgcctggtaaagtaaaaagcatgggcaggaactttgcagacttaagttccaagtacttaattcattaactatgcgattatgggcagattaatttattaactatgtgaatatgggcagatcacttgaattatctggtactcaggtccttcatctataaaaacttctagactgaagtagatgaatttttaggatttagtaatttagtacaatcaggaagcaggaaagttttctgtggccactgataaaaggtgattaatatatttcttcctcattggtcagttctatttaacatattcttatttaacaatggctatgtgcaaacaactctgctagaaattgtatgtgattaaaatattaacaaaatgcagtaatctattgagaaggagaagtaactatagctctagttagaattaagtgccctgtagggtacaaatcaaacctttagatcgctacctgaagagatagggaaattaggtaaaagagaagatggtgtttgactgagttttgagggctaaatctactttaacaagaaagtttgttggggaaaaactgttacgggtggagtaacagacttgaaccagcacagcagcagagaaactctggaaaaatattgctcattattctaaaacataccatgtatgagagcaagtggttgaagttaaaaaaaaaaaaaaagtgagtcctttccagatcatggaaggctttaaaagaaatgctaaaaaattcagaatgtgttctataggctgtgcagcaggcttgaaaggcctttgagaaaggcaaaatggtaacacttactgcagcattttggataggttgggacgtggagaaactcagggaatagaaaaactcagcatttggttgatatgcatgttcctatgtttttcctgtgttttacagggactaaatatgactggcatcaaataaaaatcagtatgacctggcaagtgattagacatggatatcaagggagagaaatggggggaaatatattctccaacatgtgtcatgttaatgagcagtgggtaatggcattagaggtggaaggaaataaaatcaatagcatgtcttaaaaaggcaggtcaattcatccgaaaaagaaagaatggtgattacacatagaaatgttgtttgaaaaaggaagaatttttagagaatttgtaacagatgtcccgtatcttctcagaggaagatgcagagtcatctcttaaggtaggtggtgtctggtgtgtagactggaaagggtttggaatccttcccaaagagaacagcataaggaagagtcaactagaggtgaacagaagaatttctgagcaactccatccaagtgtatactaataatagagccagaaatttctagttgagccaattggcacaattttgtgactttttctggtaacacttagccacccagtactgagatcagagaaaatatactgtagtgttttcccagcagtgaagtgtaggtacgaaagtaaagataacagtagatcaaagggacttcttgatgctaataaaaaaactacataaagtagtgggtaactgattcacgtaggactggacctagaggaaactaaaaagtgattcaaggaattaaagacagcatcagtataaagaattggttcattgagtataagaggaaaagaaaaagaaaaggtggctgtgacgaggggagagaatttccagattcagaattttacaaatgaggtggttttggtttatttttgtttgtttcaccttccaacttttattttaggttcaaggggtacatatgcaggtttgttacatgaataaattgcatatttcgagggtttgtacagattattttattacccaggtaataagcatagtaccctatagttttttgatcctcaccctcctcccaccttccatcctcaaataggccctggtgtctattcttcccttctttgtgtccatttgtactcagtttttagctaccacttataagtgagaacgtgcagtgtttggttttctgttcctgcattaatttacttaggataatggccttcagctccatccacgttgctgcaacagacatgatcttgtccactgttgatgggcatttaggtggattctgtgtctttgttattgtgaaaagtgctgtgatgaacatacgtgtgcatgtgtctttatggtagaatgatttatattcctttgggtgtatacccagtaatgtgattgctgggtctaatggtagttgttagttcactgagaaatctttaaaatgctttccacagcggctgaactagtttatattcccatcagtagtgtaaaagtgttcccttttctctgcaacttcaccagcatctgttgatttttgacttattaataatagccactctgactggtgtgaggtggtatctcgtagttttgatttgcatttttctaatgattagtgatgttggccagtttttcgtatgcttgttggccacatgtgtgtcttcttttgagaagtgtctgttcatatccattgcccaatttttaaggagctgtttgcttttggctttttttttattgtatttatttatttttttaagacaaagtttcactctcgccgcccaggctggagtgcaatgggcgtgatctcacctcactgtgatctccgcctcccgggttcaagtgattctcctgtttcagcctcttgagtagctgggattacaggcacccaacaccaggcctagctaatttttgtatttttagtagagacggatttcaccatgttggtcaggctggtctcagactcctgaccccaggtgatccacccaccttggcctcccagagtgctgggattacaggcgtgagccaccgcttgttgatttaagctccttttcagttctggatattagaattttgtcagatgcataatttgagactattttctgccattctgtggtttgtttgtttactctgttcatagtttcttttgctgtgcagaagctctttagtttaattatgtcccatttgtcaatttttgcttttgtggcaattctttttggagtctttgacataaattatttgcaagggcctatgtccagaaaaatattccctatgttttcctctagagtttttacagtttcaggttttacatttaagtctttaatcaattgaaattgacttagtccttgagttgatttttgtacatggtaaaaggaaaaggtccagtcttcaatctacatgtggctagccagttatcccagcaccatttattgaagagagagtcctttagccattgcttgtttttgtcaattttgttgaagatcagatagctttaagtgtggctttatttctgggttctttaacctgattcattggtctctgtatctgtttttataccagtatcatgctgttttaggttcccatagccttgtagtatagcttaagtttgggtagcgtgatgcttctggcttttttctttttgcttagggttgctttggccatttggactcttttttggttctttacgaatttcagaaaattttttttctaattctgtggaaaatatcgttggtagtttgataggaatagcattgaatctgtgaatttgggcagtatggccattttaatgatagaaatgaaagggttttgagtaatcagtttttgtaccttttgacattttatttccaagatttaatcaagagtgtttgttactcctctcaagtaatgacttatcaaggggaacgtggggagctgtttttctggactggaagcgctatttgatcactgaaaatatttagaattgctggtgcatggtgcatagtggtaataaaaagcaaactgaattttggcccatttcattaacagactgtacagacaatgctctcacttagtgcttacccctaggatgaaccactttttacttagcaccccccacctgatctcaagttctctctggagttgaagaatgactaaaatggtattagagaaagaaaattttataatgtaaactaaatgtcaacaaactatggcatgcaggccaaatctggcccattctctatttttgttagtaaagtttgtttattacatttgttttacgtattggctatggctgcttttgtactgtaaggacaaagttgagtagttgggatagagatcatatgaccctcagagcctaaatatgtactatcaggcttgataatcctacctaaatgcccatcaacagtggacgagatcatgtctgttgcagcaacatggatggagctgaaggccattatcctaagtaaattaatgcaggaacagaaaaccaaacactgcacgttctcacgtataagtggtagctaaaaactgagtacaaatggacacaaatataatacataatactgtatattatgtaaaaatacataataatatgtattattaattattaataataattaatattattacatttaatattaatatattaatattaaatgaatattaaatattacatttaaatatgtaaaaatgtacatatttaaatatgtacattaaaggttcccagacctttgatctaaatacttaggaccagaaaaggcattacttgttttgtgaacttgtaaacaggacaattgtttcacattcatatactaagtcggtagttaaatgtttagcattgactaccattatattcacctattaattttcctttcttttgtagtccctgctatgtggatatttggtagcaatgactgatgtggaaactacatatgcagattttattgcttcaggaagaacaggtagaagaaatgcaatacatgatatcctggtttcctctgcaagtggcaacagcaatgaattagccttgaaattagcaggtcttgatatcaacaagacaggtaagtcatctggcacacatttctctatgagcatggaatgatttgcggcattttactaagagggattaaggcacgaaaagccatctttgaaagtaatctaatgtaaagagttttaaacaatctaaggcaagatgaaagtctgagactaatctcttaatcactcctgctctattttcaatgatgtctgtttagaaggcttcccactcaaatgcagagtccttaatctgattttattaatgcaatcaataaaacacatggtgtgtttttttaaatcctaatttctataaaagctgaaattgcttatgtacagtatttaacaaagttggagctcctacctttgacaatattggccacctctaacatttactaggtagatatttaacaagattcacaggtaattctgatagacttcaattctaagaacaattttagtaaaaaagagtctccagggctaattttattaagaatggaagtaaaatgatctgttacattagtaactcttaggtaaaagggtctttggtttcctattccagatagaatgggtttgtgaaaaatttgtctccttactgggccttgaattcttacccaaggagtctatcttcattaatgaaagagaaaaacaagtttgatggattaaaaaacttgacagttttacttctgagtattagaataagtcccctgatagttcctccacccatagcttttgcagatatcaaagctgaatgtgtttccctgagaagacttgtgtaaaaataacccttaaaagtaaaaagaattcatgattagggaaaccctgatattatgtgcatggaaagcacttatcacagtttctgactcttaattattcaatatgtcttcgctgttagaatttttaaggtaaaacctttagattattagaaaactgagtcagagtatatgtatatatagattaatgaaatggctcagcaacattactttaaaatatataaggatggtattttattcaatggctaaagctcagtatttcccagactggtcttttcaaattcagattaataataaaactttaacatcaccactttggaatatgtagacctgtataaatcttaggtttcattgttgtgctgttattgctaccagtagttacttcccagaacagctctgagaaagactgtatggggaattattccaatttcataacatgagatggataaatatatttttgctgcagtcttgcataagatttatattttatttttcatacaaatatgctactttaaatagtctgcattaattttagctgctcttaatattaggacatttttattcatagtacaatttaatttcttctttttctatttttcctgaagttgagaattgttagccctaagactgttttattttcctgaaaacatattaaattattataaattattgaaataataaattaaaatgtaatattaataaatataaataaaataatttcatatgcattattttacaattaaataatttaaaataatttaaattatctttatacttccaaatgtcttcttttctaaatatttttgcatgttaattgcaattcactaggctcttgcaacattttctgtttttcttaaaattataaagtccaaaaccaggaacagtatacaaagcaataactttgtttattctaagtacaaaaaactaataactgtataatatgaagatctaaaatagaaaaaatggcaattatataatgacaaattcaacgtcactaagaattgtgaggaattttttttgtaattcgtaaatgtttcagcttcattttagtttatactcaacaatattgttgcttcatgtttacctttatttgttaacaggcatctatttagcaacagtctctatgttttcagcataatgctaagccctgagaagtgtccccagacatctagagggtcccaagccccatgggagtcaagttcctcatcttgtatttatacaatcactttcatcctgaaatattctactgtcttacatatgccctaatttgacttcatttctttgattaccaaaagcttctcctgtttaccaagttcttgttgcatgcttaatttacacatctcagaaccaggccatctgcacatcatgcgagcctctcacaataaaatagtgcatgaaaattatatataatgtctggtcatacccttggtactgctttagaagaaaatatttttatgtagaagaattggttttaatttccctaaagatttaatgttgttggagtatggtgaggtgctttgtgtgtacttgctaagagtagaggagaaactgccttataacattatggtccaaagaataggccatccaacttacctgcttttatttgaattatgataacaaaccctcagcaaatattgatttgtttatattattgcaacacctgaaaacattttgtttgccaagccatactggctgcctgataacaaaatatcgcatgcagatatttgaatctgagtctagaattgccaacagcttgcacttatataaagtgacctaatatggagtgaaagcattgaaatgtttgccataccactggctaagattgctactgagggtgcagttatgagggtggttttattggaattgtgcacatgttctctaagggcagaccagaggccattgtaactatttgacaagggactggccagctgacatagtgtcctttcattttcaactattgcttttactttgaactaatagaacctctgagaaattagctgggttatcatcaagtgctataaaaaggagaaaatgcagttttaaaatatttcttcaaataagacaatcaggcataaaaaggtaaacatgctcccacttctgatttctacttaaagacatttctgatttctgcaacctgtgaaactatacctaagtgacatgacctggccttgagatttctgagctatttatccaaagcttggctgatcactaactactctgaaaatttgaatattattttgtttttgagccgtgctgtcccaagttcacagaattaatcagtccttgaaaacttaagctgttttcttagtggtgaactgactaccaagaaaatatacttgttccttcaaggtttcaggcctatttagtatttctgaagttaccaatatgacatattgacagttggtaaataaaagcaatcatttttattttgcctttattctgttttcgtttttcttttgcagaaggtgaagaagatgcacaacgaagttctacagaacaaagtggggaagcccagggagaagcagcaaaatctgaaagctaacaccccactttgaccctcgaccacacctgaaaatgtctcaaatctccaggagtatctggaatgcatttgtttccatgagtgaaaagaggaaaaagaaaatggctgtgctgcattgcaggaacctgctcattatcatgttaaaaatgagggcagaggctgtggctgcaggcagacttttccctacctctgtcattagcaatggttgaaatcatgtggcttgtgtttgggcgtcatttttgtatggatcctttcacttgatcatatgacgaaatgcttatagagagtagctccgacctagatgatgattcttcctgtagcatctggcccctcacaatgtcagaggatttaattgtgtctaattgcgaagggttgattgaaccccagagtttaaatatctctggctcaagtgttcacccagtaaaagaaagatccagaaagcactgtttttagcattacgtatctgtgtgttactgctgtgttatttacactgttttgtattgtacaatatatatgctcagcactgcccccttctctgattgcttatgaaaaacaaaatgatgtacattactgtgaatttttataccactcatttttaaaagggctgtcttttcattttagttttccatactgtggtggtgtacacaggatagaacacccttttttaaaacacagtctttccccttgctcattgtatgttgatgagttgattaagtctaacagattcatcaagactccattgctttattatagagacatttgaaaatatccattaatgtgaatatcacctgaattcagtctgtttggtgtctgcacagactggaattcaatctgtcaaatttgttttattctcaagtggagaacttctcccacataatatatatatatatatatattttaatttatgagaattttggacaattggaaaggtagaaaagaaaagccaagatcatactaaggactggaaatattttgttctatggaatcaaatttctcacaatgctgtatgatactatttaaatttggaggacaacttatcttcactaagctgaatcaggtggagaaagtaatctccttgcaatcatgtggacaccaatcacaaaagtaaagccctggtgttgtgttttcatgtcttttttcagccctctcagatccaaatgttattatgcactttttaatgtttgtaaacttttactaataattagtgtgaattgcattctgatacaataatgattatcattagaagctaacaaaattctcattaatactgtgtttgatggcctctgctgtgttttaacatcgtgcttcttatatggaaagtttttgtgagctgtgtaatccctctggtcagtattatgaaatcatttgtcagtggtaataaataaggaaccagtaatatgccaatggttcatgaattactggacaaatagcagacaatgggagtccctttacaataacgagcccacttagctgtccttgagggcttagataccttgccacgtgaagtaggtagagcagcatttcaataggtaatttgtgtggttgtgccagaaactcagcccttctatgtaattacatacaggataaaaggtaagtctgctcacttctccttctacagggcatttcaactgactggaataagggcatggttgcatttagtactcaatcagatattactagaaaaaaaattaataatgtgagcctttccgagagcagaacgaggaaagattaaattttagaatgcttccttctgtctaatccatcaggggccaaaatgcccagtaaaattcaaacacatcacctattaatagacttacaagtgagaaaagaggttcctagggttattttaggcaatccctggtaaactgtttaaaccatcaaacccctacagtcagttttcagtatcctcatttaatattttaataggtttcttgtgaatttaaacttctcttctttcttaaggttgtgaaattccaaactgattttatgtgattttgaaaagtttagaaccagtgctgagtctatgtggagggtttatattcctatgtgatatactgttattaatgcatgtggtgccatgcttgtctttaaatatataaatagtgctaaattgcaaagtcatatggagctttggatttagtttgacttcttactactgctttgtctgctatattcaaacccaaaggcattcccaagctagggagataaaaattaattttctaaaatgtccacatcctatacattttgcttattcatggcatctttcaaattttattttagtttcctttatttgccaagaatacatatggatttgaatttttaaggagagaaggaaagggtaggaaaccagggccttgggtttagtaacaggcattggatgtctattaaccaactattcttacgctaatggctttgcagctcctattctcccatttgatcctcaaacaattctattagagtggtatttttatccaatttcacagattaaaatataagcactcaataaaatataacctttagaagcttaaaaagctagtaagtgatgaactgaggatttgaacccatgtttgtcaccaaggagctttccagggcacatgtcataaaattagagccaactgcagagctgtaagggaacttttagagatgaacttcttcagcctccatattttacagaaggaaactgaatcccagaaggagaaattgccgttctcaaggctccctggatgggtaataacacagatatgagtaggtcacataaagtatatcttttttaaaaaaaagaaattcaattatgtcttatttggggggtatatttcccagaagatatttttctggcatgtggtctgtaaacacagcatgattcatattttttatgtttcatgctactcattttgtttaattaccaacaaacatggggactttggctttttgacttatttgcaacaagcatgaaattgttaaatttaccttttatcaattgtaatcatcctatgccaacatattatcataaattcatagaaatatttttaaaaataaataacagacattgaaatccaattcttagataatactcccagaacagccaatggtaaatgccctatacttgagtcttacttagatgctgtggtaatgcaccattttagaagatgaatgatactgctatttctcttcagggaaacaataatggataaagaaatgtaactgccgggcagcaaagcttctaagtgaaacctgtagtagcagtagtagtagggagaaaatgtgtagtcatcaagtgaaaataggaaaggatctatgatttatgatgtcttaatagaccctaaattgttctttaattacaagagtggcagtctctgaagtcatttgtgagcttgtatgacttttgtatttagc

SEQ ID NO: 13020 - DNA, 7665 bp, Human
atgtgttaagatggcattgaggccgagcgcggtggcttaggcctgtaatcccagtactttgggaggccaaggcaggcggatcacctttggtcaggagtttgagacaagcctggccaacatggtgaaacctcgtttctactaaaaataccaaaaacaattagctgagcatggtggcgcgcgtctgtaatcccagcttctggggaggccgaggcaggagaattgcttcaacccgggaggcggaggttgcagtgagccgagatcgcgccactgcactccagcctgggcgacagagtgagacaccatctcaaaaaaaaaatagcattgagatcaataaggaagtctagaaaccaggaagctttttgcaaagagaaaacgccttttgttattctcaccgatggatattaagctttccctcacagacaggactacaagcttcagagtggatctgagatgaatgcgaattgctgtgtacctttgtaagggacagaagaccggattttcaaatttaaaacaaccattctgtttctggaatcagaaatcagtttcgagatttacaactgtattttttaaaaaatctgtcttcttagtggactcgggggggacttcacgtggcacccagtacacgccacgccaagccaccgaagccagaggtgtgtgtctggggccagagacgtgcattccctcagcaaggccggcctcagacgcaaacgccagcaccgccaccctgtcgcccgctgagaggatctggccgccggggggagggggcgggggggggggcagcgggggaacaacaaaaaaatcccagcataatgattattcccagggaccgttgggtttttttttccccaaggcggccgaaaaaacaagtgctccccttccccggaaatgagatgcacaggggtattcattccattccgcggctgggaagcccctgcggaaacgagtctggctgcatgtgcggcctcggtcccagaaatcaaaaagagcgtcccctgagcccacagcttgctcctccatgtgaccggcccctgggctggtggccactgtggacgcgcccggcgccccctctcccggctccctgcgggttccgcggagccgccggcgcgcagcccggccaggtgcacccggcacggccccactaacagcgcgcgcctccagccgccgggcactggcggccacgcgggcgagatttacggtggcgctaggcggcggcttccgaggccggccggcgcccaggctccgattacaggttcacactgggggcccggccggcggccgcccagcccccgccggcgcgccctcgcgcggcccggctccccgcctgcccattcttctccattcatgcggacgcccagcgccgccgccgccgccgccagcgcggccgccgccgtcgccgtcgccggccgcccggattggctggcggccgcggcgccggcactttcccacggcccgcggcgcgtgcggctcaccggaggcgctgcaggctcggccctggcgcgcggccaggccaatcggggcgcgcggggcggggaggagccgcggcccccggcgggcttgtgtctgggcccggcctcccgtgcttccccgccgcccgcgcctcctccttcccttgagtgcaggctggacagagcccccgcggagccgacgcaccccccccggtcagggacgggctcggagggcgggggcgcggtccgctagagccctcggcctcgctcccgcccctccccggagcggctgccaatcatcggcgcgagaaaccggattggccggggggcggctgttgccctggagttgccgccccgcctctccgccccctcgcccgccttccccactcccccgccctccccagggccctgggaaggggctcagcgtgggaaaggatggttgagttttaaccagaggcaaagcgtgagcgggatcagtgtgtgcggaacgcaagcagccgagagcggagaggcgccgctgtagttaactcctccctgcccgccgcgccgaccctccccaggaacccccagggagccagcatgaagcgagctcaccccgagtacagctcctcggacagcgagctggacgagaccatcgaggtggagaaggagagtgcggacgagaatgggtgagctggcggcggcggagcggagccgagccagagcgggaggcgagcgcaggcctgccgcggtgacagcgggctaggacccttggcgcgccggtgccctgcgctgacctccgcgcgtcgcaggctggcggcagcctgcggccagggaacccctaggtgccttccagcccaagtggcaaaaaaagtctgagtgcggggagggtgtgggggcgacctctcagatcacctctcctcgtttaacggcgatttcagtttttgtttgttctttttctcttttcagaaacttgagttcggctctaggttccatgtccccaactacatcttcccagattttggccagaaaaagacggagaggagtgagtctctttacactctccttttatttttgttattgattaacggaaataaccacctttttttttgtctttgaaatttacagtcgtaatggtaatgccttcctttgttttgcttgccttctgcagataattgagaagcgccgacgagaccggatcaataacagtttgtctgagctgagaaggctggtacccagtgcttttgagaagcaggtaatggagcaagtaggtaaagctctcagcatagctatctgcaccttctgaatcttcccctcattaatctcatccgccttggaaaatagctgtgttgcttgtgcctagatgaattcgtacacagataccagcgtattttgtgaagacaactgattttgctttagtccatgctttacgatttacaaagcatgtatctttgtatatatgtttgcatattttaaattgttccccaaaggaacttgtgccaaatcaatcttttgccattctcatctttagggatctgctaagctagaaaaagccgagatcctgcagatgaccgtggatcacctgaaaatgctgcatacggcaggagggaaaggtacatctcctagacctagttggggctctgaatggttggcaaagagtgagcagcggctgaaggccaggattggtgcagtagctgcctgatttttctttgggggtggggagagaacggtgtgtggtgtgtgcagttccctgtcagtacattttcgaatgcacatagaatcttctccagtgaattcaccaccccagctctctgcggattgagctagtgcatcttttggaaaaatacctattatttgtgaggtcttcaaaagttgtgacagccctgattcagatcaggtagctttcacatttgtccattgctattttgagaaaaagcatttaaaaacaatatgtggtcttatttttggtatacgggattttaaaaaaaaggtgctgccacatgcctcttgaggaaagaaatgtattctggttaagtaaaggaaacctaacgggagaccaaggtctgtgtgtatgtctctccagcaggaaaatgctttactgaggtccaagtgcctaaaagctccgcgatgataacttacatctgtgtgtctaatgaatttcactgctctgtggtttctctgcccttgatgtatttttttgttgttgttgagggaaaacattaaaggaatgaacatagtttcatctgctggtagggtataattccaatttctgctctgcagcttctaattgggctttgaacttgcattagcaaacacattctgcttatgttgattaatgcaaagatttttgttgattccaaagactttcggaagaacccctgactgttgtgttttaagggatgcaggtatctgccaggaagggctgtctctgggacttaagaaatgagggaaacgggcaaagccctgagatttttcttttgttcttttgcttaggttactttgacgcgcacgcccttgctatggactatcggagtttgggatttcgggaatgcctggcagaagttgcgcgttatctgagcatcattgaaggactagatgcctctgacccgcttcgagttcgactggtttcgcatctcaacaactacgcttcccagcgggaagccgcgagcggcgcccacgcgggcctcggacacattccctgggggaccgtcttcggacatcacccgcacatcgcgcacccgctgttgctgccccagaacggccacgggaacgcgggcaccacggcctcacccacggaaccgcaccaccagggcaggctgggctcggcacatccggaggcgcctgctttgcgagcgccccctagcggcagcctcggaccggtgctccctgtggtcacctccgcctccaaactgtcgccgcctctgctctcctcagtggcctccctgtcggccttccccttctctttcggctccttccacttactgtctcccaatgcactgagcccttcagcacccacgcaggctgcaaaccttggcaagccctatagaccttgggggacggagatcggagctttttaaagaactgatgtagaatgagggaggggaaagtttaaaatcccagctgggctggactgttgccaacatcaccttaaagtcgtcagtaaaagtaaaaaggaaaaaggtacactttcagataattttttttttaaagactaaaggtttgttggtttacttttatcttttttaatgtttttttcatcatgtcatgtattagcagtttttaaaaactagttgttaaattttgttcaagacattaaattgaaatagtgagtataagccaacactttgtgataggtttgtactgtgcctaatttactttgtaaaccagaatgattccgtttttgcctcaaaatttggggaatcttaacatttagtatttttggtctgtttttctccttgtatagttatggtctgtttttagaattaattttccaaaccactatgcttaatgttaacatgattctgtttgttaatattttgacagattaaggtgttgtataaataatattcttttggggggaggggaactatattgaattttatatttctgagcaaagcgttgacaaatcagatgatcagctttatccaagaaagaagactagtaaattgtctgcctcctatagcagaaaggtgaatgtacaaactgttggtggccctgaatccatctgaccagctgctggtatctgccaggactggcagttctgatttagttaggagagagccgctgataggttaggtctcatttggagtgttggtggaaaggaaactgaaggtaattgaatagaatacgcctgcatttaccagccccagcaacacaaagaatttttaatcacacggatctcaaattcacaaatgttaacatggataagtgatcatggtgtgcgagtggtcaattgagtagtacagtggaacctgttaaatgcataacctaattttcctgggactgccatattttcttttaactggaaatttttatgtgagttttccttttggtgcatggaactgtggttgccaaggtatttaaaagggctttcctgcctccttctctttgatttatttaatttgatttgggctataaaatatcatttttcaggtttattcttttagcaggtgtagttaaacgacctccactgaactgggtttgacctctgttgtactgatgtgttgtgactaaataaaaaagaaagaacaaagtattctgtggtgtatgtcttacataccttggcctttccccctcttggctaagaaaagataaactttccttggttttcattttgcctgattggtttgtatgtttaccagtttcattattcttggacttctaaactgtgtgaattcgtgccgttgaataaggtgacttcattacaatgcagagagctttgccctgcctcctacaaggggacatagcccttttgctcttatgtcagatgatctggccctaaactggccatctgtggattaggaaagctgaaatcagactgagacttacaggggttgaaaggagcttggatgaaatattttaaaaccgtgttgactatttgacaaatatttactgagagtacctactatgtgctcatttctatgctgagagaatggaaatttatttcttttattaattttttttaaatggcaaaacaagaagacccaaatgtaggggctcgggactctgtggcctgatgagcagtggcaggctgtaattctgcacctgcacagctccagaagtcttcactggtcttatttccaaggaatttaactctttagttgcactggactcctgagctgtgtagtgaggaagctgacatatgctttaggttagaacaaaacactgccagcatggagggcgtattctgggccccaggggagaggagtgtcttcccattgccttaaaaatagccctgtgccaattaaggagtgctcctaaggagtttgtcttgatcctgagggcggtggggaggagacggagaaaacccatgctggcagatgataaaataaagccttcctttgctttgcccaaacacggagcccctcctcccatctggtgaaaaaacacagtcagaagacaaagagaagtttggagtttgaatttgagcttcaacttctgtgtccctgtgaagggatgggagactgcagcatttttgtgattgtgggtttccaatcccttcaaagctttctctgcatggcctcagacgtcgatccctcttgtgatgcacagctctgctctcagcattgcctgtgccacacagacactctttctgtcataaggctgtgatggaaagtgttatgctaatttctgccaagtgtcagtttaattttagcaaccgcgatttccaatgacattacagcattactgaacagcattgtacttcgactatctcttactgttacataggtttagatggctgctaatgtggtaagaagtgaagcctctcatttgctggctctgctgaaagagctgtggaactgtaaaacatgtagcatgttccacttgtctcatcagtgatcgctatatctggttagcgggaggcgtggcagttcatttccagattacatacttttccatggaaatattctggtttcttttcaagccctttcaaggtgaaaagtatctgaggatggtgcaggtggagtgtgagcttcctaggaagcaggatggagtatgactatgtaccaatagtgtatagaaaaattaattcaggaaaactcccatttctattctgttgatgcaattaggaaaaaaataacaccagggttatcagggccagcatatttttgtattatatgtacatttataatacatctaccagtgtataaacaaaattttttcagagaatgcataagtttaccttataaggaaaataaatcattggttataaagaatcttgaagggcttcaataattactcatttattttcatttaatgtattaccatgaatcaatatgatgaagtagatagatgggcagaattcttgtatttaaaaaagcctctaaaaatccaaggaataattgtttccaatttattcagtctagttaaatgaggatgtgatttttatccaggttttcattgccccactctgtgactcactaaaatcatgatattttaaatatagattacttaaatttgaaatccctcaggaaatgttttatctcctagttatacttttccccagcctttcccatctata

SEQ ID NO: 13021 - DNA, 41136 bp, Human
  misc_feature (1)...(41136): n = A,T,C or G
gtgagaaaattaatttccgttaagtcacccagtttatggtactttctcaaactaagacaccatagaagtgtaagttttaaaaatattaatacatttagtgttattaattcctgtccctgcacatataacacaatgttctgttataaagttaaaaacaaattagaatcttcctaattcagtatgttctaagaaatactacttgacaataatcaataaaataaatttgcaaaacttgtcaatgatgtgtcccatgtcaaatcaaataaagatagcctttcttggataggttgttggaaaatggttgtatcaactgaatttttcatgttttacttcagattttcaattttaagttttgtttatagatttgattaaaataaaggttattatgaataggttattaataaaggttataaagttctgtgcctatgatgtgttataaatggtgtgttcagctttactagttaatgctgttgtatttgatgtcgcttcagtgaccttttttgttagtttattgttacttaaaattaagcaaaatctttcttgcatgaaatcttcttgattaattattgccatatagaattttcattcacctaatcttttttttttttatttgagacagagtcttgctttgttgcccaggctgaagtgcagtggtggcatctcggctcactgcaacactgcaacgtctgcctcctgggtttaagagattctcctgcctcaggctctggagtagctgggactataggcgggcaccaccaccccccgctaatttttgtatttttagtagagacggggttttaccatgttggccaggttggtctcgaactcctgatctcaaatgatctgcctgcctcggcctcccaaagtgctgggattacaggcgtaagccaccgcgcctggtctcattcgcctaatctttattgtctactatattcaaagtgttgagtgtgacaacaagtcatttaaaatttagtctggattctcaagagtttgtaatataatgaggaaaaaatcccaacgactttcttttactcagatctccataatgtcatttgccatcaatagtttggaatatcactgaagtccaagggcctgtggctacccaatattccaaatacaatataatttggttcaaataagatattaagaactttggtcaagaactttggtcaaacacaggagatctggaatctaacggcatgtctttggcaattcacaacctctccctctacacgtttctccatgtagaaagtaaaggccttggaaaggattgatgaaaaccaaccctaaaactccacgatgcctttttctgtactccgaatctaaaagggtgagctatgaagtaaaactctgcacttggtccaagtcattgaaatatttgcaaacgatgctagagctcgaaaagagcaaagatagcagaaaccgtccagagaaagtaacctactgctgaagctctgcaaacttgagcagtcaaccaacttcaccgctcacaaacgtttggccgctaggcattgtgactttctgcccagataaaagtctttttttcttttgtctcctttttttcttcctccctgctttgccgcgtgagattaccactcctcgggtcagctcgcgaacgccagggaggcgagtgtgaaacacacgcgccaacacccctcctcctcctcgtgcgctcctccttcctacagaaaaatgtgtttctaggcaacggcgggcggcggcgtcacttcctgccatttaaactcaggtccccacccctcgcagccccttctcctcgtttccacccctcccccctcggtcgtgggcctcattcacgcttccccgggcttggggagggggcggaggcccggcgtgacaagcggcccagactcccgtgggcgccgcacacctgttgtttgcagcagccagcgacccgcactaccgctctcggcgggcggggaagcggccgcagcggagccgacccggcaggtggccgcgggcggggccggcgagcgaaagtgcgcgggggcccgaccaccgcggggccgggacgcgatggcggcggcagagcccgcgagctcgggccagcaggcgccggcagggcaggggcagggccagcggccgccgccgcagcctccgcaggcgcaagccccgcagccgcccccgccgccgcagctcgggggcgccgggggcggcagcagcaggcacgagaagagcctggggctgctcactaccaagttcgtgtcgctgctgcaggaggccaaggacggcgttctggatctcaaagcggtgagctccggaggcggggacgggggcggacttcggaacccgtggcccccggggaagcccagcccctcgccgcgtgggtctagcggcgtggtgtagacgcgccttgcggggacccgggaccgggcaatccgaggaccatgtggcctgcgcccgggtcgtggacgccgggatgggggagggacgagggaccaggatggcaccgagcggacgcgtaaccaatggggcccggcgccacgctgggctctcgacaaagagcccaggacctcgagcgcgcccgcgtggcttctgtctccgggcgcagggacctgagggtaaccgagtgtctgttgctctgcgtccacctgtggcagaggctcacggggtaacgggcgctttgcccggagacaccgtggatatcgattttgctgttaagaatggatggttttaataggcgattccagttggaaccatgttcctgtagtttaaataaaaaggaggaaaaacaaaacccagtctgccatctctaccagatgaaagaaaaaaaaaaaagagtacttctttccacgcccctccccgataaaatagtattaaatcttccttgtgcacttctttcatcaccctgatagttaggaggggtatttgatttgtgacttcatttggcatgtgtcatgggtttccaaaagtgagatctgctgtcacacgaaaaggggatattttacaactttcacccaaagaggtggaagtgctcagtaaactctctccctgcgtcgtcctttacagcgttcagatttttcaaacaggagcaggcatcaaaagctgttctgtcatacagaatgacttaaccgatctaggaaggatttggaagaattcaacagcgctcaggataatgagaatgtggtcactccgcgcgaagtttaagaactaaagttttagaaacaaacaaacaaaaaacactaactgcccaataatcactgcaaatcccctttgactccctaaatgtggccttacttggaggattggccccagctcccaggggagtgcctggaccaccttacctggcttgagagtgtcactgcatcctcaaggctctgcataaagcagtggcagctccctgaatgtaaggaccaagacttgcaggggccaactcttctgctagaggccctcctccagtgtagcccaaggggaagtagatcttttcagtgccctctcctttccctggatgtagttggtgttcaatcagtgattgttgaactgaattacctaaattgttcaacttcatacaactgaggcatgctgcacatattttgcattttggtaagtaatttctactattttctttttgatatgttattcctggaatttttttcccacctctggaaattccttgttctcttttttccaccacagccccttcttcctttctctccctgaaagtgatttatggcatgtgtagtatttaaattgtagtgaattaaaatggattctgtttaaagaatttcacaggaagtcatgaagttatcagagaaagccaggaatgttacaaagcacaggtggcaaactgctgttcaaaatctagaaattcagctgtagcctgtgactttggtgtaagaaaatcagggaagtttggggttttccaggtaaaactgaactctgacggctggactttgagggcttctccctcagcttgcctcaggatatggtggaactttgccctttcttgacttgaaattctttagcttcctcctgtttcatctgtggctatataattgccctacagaagtcacagaggcagtgagtaggatgtaaagtttggtatttcatgacaataattgctttattcattctggaactctcctaaaaattcaaaggtttctacaataacactgtctcattatattaatgacttcatactcctagaaaagagtttgaatgtctttagttttcatatatatgtatgaaaaacatatgttttatgtattttacgtatatttttcatttatttatatatacttatatatgtaaaaatcttttttttttcttttttgagacggagtcttgctctgtcgcccaggctggagtgcagtggcgcgatctgggctcactgcaagctccgcctcccgggttcacgccattctcctgtgtcagcctcccgagtagctcggactacaggcgcccgccagcgcacccagctaatttttttgtaattttagtagagacagggtttcactgtgttagctaggatggtctcgatctcctgaccttgtgatccacgcgcctcggcctcccaaagtgctgggattacaggcgtgagccaccgcgcccggccaaaaatcttacattgaaatctttccaatgatatttcttattatacaccatagtaaaagatcgttaaagccttttttttttgagactgagtcttgctctgtcacccaggctggagtgcagtggcagatctctgctcactgcaacctccacctcccgggttcaagcgattctcctgcctcagcctcccaagtagctgggattacaggtgcccgccaccatgcccgactcatttttgtatgtttagtagagaaggggtttcaccatgttggccaggctggtctcgaactcccaacctcaaatgatctgcttgcctcagcctcccagagtgctgggattacaggagtgagccaccatacccagcccattaagacatgtttgataatacatattaaagatggactcacactgacaattataaatttcctctaatttgaaattataaagacacattttctcttgtattcttactttggtgggggcatatttcagcataatttttttgaaacttttaagttatacacttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacaaaaaaattagccaggcgtcgtggaggcgcctgtaatcccagctacttggcaggctgaagcaggagaatcgcttgaactcaagaggcggaggttgcagtgagccgagatcgcaccactgcactccatcctgggcgacaagagcgaaactgtgtctcaaaaaaaaaaaacatggctcaacatagaaaatcaattttaataaagctgttgtagtataacttaacaattaggaagcaatagaaagacattgaaagtgatgtgaggaaagtttattcattatctctgcagcttcacctacaccatatagtctcatttacaatagtggaggtgggatagttattatttctttattccagtgagataagaaattatatcatggttatttcaagctacgtggtttgccagtttatgctgttaatagctaatatacatcaagagcttaccatatgcaaaacattttacatgtttttagctaatgttatcctcttaacaacagtgaacatttcggcagaacagccccatttcacagcgtaagaaactgctagttaagtaggccaagataggttagataacttgcctggtgttgtacagtagaaagtgagagctaagatttgaaattagaccatttattgttattctctatgttataccatctttcagtagtcttcaaaaataaatgtatgtaggtaggtttccatttgcataagggcatggaaaaatgcatgattattcttactcctctgcccaaggtggaaaagaaggaggtactgtgctcctgaaaatgaagctattggtgacatattctgtattattgcataaattaaactaggatttcacttgttcacagttaagaatttgaacaactgttaagatagtcatgactatgtatctgtatgttgttttgaaaattcctattaaatgtaagttataactaaagttctacattttatttgccattttggtgtcagtatgagcttttttaagcatgatgaagattgcttatctcttttattataattctttaacttaataaattacctgaattatacctgaattaatgtgataaagtatggtgcgtcttatctgacaggtccctgatgcatacccgtttatgagcctgatttagatacatcctgggataaataaataattgaagacactagtttggccgggcccggtggttcacgcctgtaatcccagcactttgggaggccgaggcgggcagatcacgaggtcgggagattgagaccatcctggctaacacggtgaaaccccgtttctactaaaaatacaaaaaaattagccgggtgtgatgactggtgcctgtagtcctagctactcaggaggctgaggcaggagaatggtgtgaacccgggaggcggagcttgcagtgagccacgatcacgccactgcactccagcctgggtgacagagcaagactccgtctcgaaaaacagcaacaacgacaacaaaagaccctagtttgtaataccaggcaaacattttaaggtagaattagcctaaggagagatatgtgggtaggacagcgagaactttagtgcatgcttacaaattctcaggacccttccactcctgggtgtatacccaaagaattgaaagcagggcctcaagaaggtatgtatacccctgtgttcataacagtggcattcataatagccaaaatgtggatgcaatcctaatgtccgtcaatagatgagtagcttaacaaaatgtggtatatatacaatggaatattcttcaggcttagaaagaagaaaatgctgacatatgctgcaacatgataaactttgaggacataatgctaggtgaaataagccagtcacaaaaagataaatactgtatgattccacttacgtgaggtacctggagtagtcaaattcacaggggcagaaagtagaagggtggttaccaggggttgagggaaaacagaatggaatttgttgcttaatggatgttataggctgaaatgtgtcccccaaaattcatatgttgaaggccttacctccatacatcagaatgtgattgtatttggggatagggcctttgaaagataattaagctaaaattaagctgtgacctgatctaatctgactggggtccttatgagaaaggggaaatttggatatacaaagagatgcctcagatgctgccacccagaggaaagaccatgtgaggacacagcaggaaggtgatcatctgtaagccaaggagcgaggcctctgaagaaaccaaatgggccaatgaaaaaaaagaaaatgtcaggcccatataactgatgaacgtcgatgcaaaaatcctcaataaaatactgcagaccaaatccagcagcacatcaaaaagcttatccaccatgatcaagttggcttcatgcctgggatgcaaggctggttcaacatacgcaaatcaataaatccatcacataaacagaatcaatgacaaaaacccatgattatctcaatagatgcaaaaaggccttcaacaaaattcaacagcccttcgtgctaaaaactctcaataaactaggtatcagtggaacatatctcaaaataataaggctatttatgacaaatccacagccagtatcatactgaatgggcaaaaactggaagcattcccttcgaaaaccagtataagacaagaatgccctctctcaccactcctattcagcacagagttggaagttctggccagggcagtcaggcaagagaaataaataaagggcattcaaacaggaaaagaggaagtcaaatggcctctgtttgcagatgacatgattgtatatttagaaaaccccatcgtcttagccccaaatctccttaagctgataagcaacttcagcaaagtctcaagatacaaaatcaatgtgcaaaaatcacaagcattcctatacaccagtaacagacaaagagccaaatcatgagtggactcccattcacaattgctactaagagaataaaatacctaggaatccaacttacaagggatgtgaaggacctcttcaaggagaactataaaccactgctcaaggaaataagagaggacacaaacaaatggaaaaacattctatgctcatggataggaagaatcaatatcatgaacatggccatactgcccaaagtaatttatagattcaatgctatccctatcaagctaccaatgactttcttcacagaattggaaaaaactacttcaaacttcatagggaaccaaaaaagagcctgcatagccaagacaatcttaagcaaaaataacaaagctggaggcatcatgctacctgacttcaaactaaactacaaggctacagtaaccaaaacagcatggtattggtaccaaaacagatatatagaccaatggaacagaacagaggcctcggaaataaacaccacacatctacaaccatctgatctttgacaaacctgacaccaagaagaaatggggaaaagattctctatttaataaatgatgttggaaaactggctagccatatgcagaaaactgaaactggagcccttccttacaccttatacaaaaatcaactcaagatggatgaaagacttaaacgtaagacctgaaaccataaaaatcctagaaaagaacctgggcaataccattcaggacaaaagcatgggcaaagacttcttgtctaaaacacgaaaagcaatggcaacaaaagtcaaaattgaccaatagaatctaattaaactaaagagcttctgcacagcaaaagaaactatcatcagaatgaacagccagcctatagaatgggagaagatctttgcaatctacccatctgacaaagagttcatatccaggatctgcaaagaacttagacgaatttacaataaaaaacaaccccatcaaaaagtgggcaaaggatatgaacagacacttctcaaaagaagacttttatgcagccaacaaacatatgaaaaaatgctcatcgtcactggtcattggaaaaatgcgaatcaaaaccacaatgagataccatctcacaccagttacaatggcgatcattaaaaagtcaggaaacaacagatgttggagaggatgtggagaattaggaatgcttttatactgttggtgggagtttaaattagttcaaccattgtggaagacagtgtggtgattcctcaaggatctagaactagaaataccatctgacccagcaatcctattactggctatatacccaaaggagtataaatcattctatgataaagacacatgcacacgtatgtttattgtggcactattcacaatagcaaagacttggaaccaacccaaatatccatcaatggtagactggataaagaaaatctggcacatatacaccatggaatactatgcagccgtaagaaaggatgagttcatgtcctttgcagggacatggatgaagctggaaaccatcattctcagcaaactatcacaataacagaaaaccaaacaccacatgttctcactcgtaagtgggagttgaacaagaacacatggacacagggaggggaacatcacacagtggggcctgttcagggttggggggctaggggagggatagcattaacagaaatacctaatgtgggtgacgagttgatggttgcagcaaaccaccatggcacatgtatacctatgtaacaaaactgcacgttctgcacatgtaccccagaacttaaggtgtgtgtatgtgtgtgtgtatatatatgtacggtatatatatatatggtatatatataaggtatatatatggtgtgtgtgtatatatatgatatatataaagtatatatggtatatataaggtatatatatggtatatatgtaaggtatatatggtgtatatatggtatatatgtaaggtatatatggtatatatatggtatatatggtatatataaggtgtatatatgatatatataaggtatatatatggtgtatataaggtgtatatatacggtatatataaggtgtatatatatgatatgtatatataaggtgtatatatatggtatatatatgtaaggtgtatatatatggtgtgtatatataaggtgtatatatatggtatatatatatgtaaggtatatatatggtgtgtatatatataaattcctccttagttttctctaacaatccaagcataaaaaaaaaatccctgttagaactgcttttgctgtattccatagattttgttatattgtttccattttcatttgttaagatatttttcagtttccctttgtattttttcattgactcattagatgtttaagagcatgttttttgtttttaaatttccatgtatttgtgaatattctgtagtttctcttgttaatgattttgtcagaaaagatacttgtaattatctcagtcttctagaatttgttatgatttgttttttggcctcatatataatctaacctggagaatgttctgtgtgcagttgagaagcgtgtgtattcttctactgttggatggatgttaggttcatttgatctagagtatagtttaaatttgatattttcttatttactgtctctacgttctgtccattactgaaagtgggctgttgaaatcccctactattgttgtattactgtttatctctcccttcagatttattaatgttttctttatatatttaggtgctgctatattgggttcacacatatttacaactgttatatctcatgttgctgaattgacccttttattattatatagtgacctttgtatctttttatagtttttgacttaaaatctatttaatctgatatatgtatagccacttctgctttcttttggtttctatttgcatggagtatcattttctgttctttcattttcagtctacgtccttacaggtgaagcaagcctcttataggcagcataagttgagtgtttttaaaaatccatttaactactttgcctttttattggagaacttaatccacttacgttcagggttatcattcataggtaagtagttaatactgtcattttgttgttttctagttgttttgtagatattttcttcctttctttctatcttcttttgtggctaaattatgttgttgtctagtggtatgttttgattccttgcctttttatgtatctgctataggtttttgctttgttgttaccatgaggcttacaaaaaaatatcttacaatgcggtattttaagctgataacaagtttgatcgcaaaaacaaacaaacaaaaagaaacctaacaagcctctatgcttttattccagtcccctcctcacattttgaatatttgatgtcacaagttttatctttttatatcgtctattgcttaaaaattattgcagctactatgatttttaatagttttgtcttttaacttttacacaaaatccagaatactttaattctgtgatgatgctgcataaattgcttatatctttagtcagtgtacttacttttaagtgagttttagactttcagattgttttgtgttactccttagcatcctttttttttttttttttggagattgaagacttccctttaccattttttgtaaaacacttctggtagtcatgaactcccttatcttctgtttttctggaacaggctttatctcttcttcatttctgaaggacagctttgtggggtttggtattcttggctggcagggtttctttcagcactttgagcactgaggcaggccagaagcttttggcagatgtggccagcacaggagtggtgcaatctgaagccaaagttcactgagatatccctggtattgtgagctgtccagagccctggactgctgacatcagcctggcattggtgcagcccagagattgagtttgccttgaaagcctgaagcctcgggttatgtgatcctgcttggcaccaggctggatctagagcttcagtctatgcgcactagcctggaacatggggttgtggtggtctcaccagtgttaggttttactttggcaatcctagcattggagctaaaggtatggtgtctctctccttgctgtgcttcctagggttgagggaaggatgacggggtaatataaaactgcccttcttaccctcttcaatgtgacttttcttattattgtgctgcaaccagatagtgtaatctcttatatggcttatttagctcttgtgaaggtatgttatagtatggatgcttgttcaaattggtgtttctgctggggaaaattgctgaagcgtcctactctgccatcttgctccatcccttcctaaataaatcattgttttaatttcaccagtaaagactgactgtcctcaattatgagtaagtttcctcttacatcttaatatttttgtgaaagtgaggatatactttctgatgttccttttccaacctaaaatacaattactgaagtatcagtagaaagcttgggaaaaggttaatatactctagagtaaaacttgcccagtatgcaaccactcacagagaaccactgtcaacaatttttagtatttcccatttcttgcaactttttatagctgagatcaaatgtttattgttcctacttattaatattattattattatttttgaggcagagtctctgtgacccaggctggaatgcagtggtgagatcttggcttactgcaacctctaccacccaggctcaagcgagtctcctgcctcagccacccaagtagctggaattataggtgtgaaccaccatgcctgggtaatttttgtatattggtaaagatggggtttcatcatgttggctaggctggttttaaagtcatggccccaagtgatccacccgcctcagtctctgaaagtgctgtgattgtaggcatgagccactgcacccaacctctttttccaaattgtaaacatgatttataatgtcttcataattttgatctgtcacattacccagaattaaccattcttattagtaggtatataagtttttatgtttttttcctatttcatacaatgaatatgtattcacaaatgtgtgccccgttgttctttattttagtagcttccagattataattatcagaaaaagtcagagaaatgggcagttccacgcttttcacactgtgaggggtgtttggaagcacctacctgagccttacgcttcagggagtagctgggagctgacctaggaactccgggactcaaaagccagatgtcatcaatatatatacaatttaagaatttaaggttatattatacctctacttagaacaacgttcagacacctacaagatcctgcctagtctggccctccttcctctgccacctcgtctatgcactccctcttagatgactccagtctcactgactgtctttcagcactctcacatgccctctcctcctgcctcagggctgctgcacaggtgtttcctgctgcctgaaatggacttctgcacgtgtgtgaaaacacacacacacacaccccaccaccaccactgcaccacacatacacaaacacacaactggccacttctccaaaccgtctggtcttagtttttttttttccttcttttagatgtttttgtaggcagaacagtggtccctcaaagatggtcatgtcctaattcccaggacctgtgaatatgttcagttacataggaaaggggaactaaggtcaaagttgctaatcagctgattttaagatggggagatttttcccttttttttttttttttttttttttgagatggagtctcgctctgtcacccaggttgaagtgcagtggtgtgatctcggctcactgcaacctccgtctcccgggttcaagcaattctcctgtttcagcctccctagtagctgggactaaagatgcccaccaccatgcccaggtaatttttgtatttttagtagagatggagtttcaccgtattggtcaggctggtctcgaactcctgacctcaagtgatctgcccgcctcagcctcctaaaatgctgggattacaggcatgagccaccgtgcccagccaagatgtggagatttttcctggaatatctggctgtgcctgttgtaatcaaaaagttcttcaaagtggaagaaggaagaagagagtgagaaccaaagaggtggaagcttgaaaatgacctttctgctgttggaagaaggggtcatgagccaagaagtgtgatagcctctagaagctggaaaggcaaagaaatcgattcttccttagagcatctagaaggagcacagccttatcaatattttgattttagctcagtgagatccattttggacttctgatctatagaactataagataataaatttgtgctactattcaaccattaaaaaaaaaggaaatcctgtcagtttttgacgccatagaagaacttggaggatattttgctaagcaaataagccaggcacagaaagacacatgatctcatatatagaatctaaaatagtcaaattcatagaatctaagaataggatggtggttaccaggagcttggggagatgttggtcaaaagatacaaaatttcagttagacaagaataaatttgagagatctaatgcacatcgtggtgactatagttaataacaatgtattgccttcttgaaaattgctaagaaaatagaatttgagtgttcttaccacacacaaaaaaaatgatcagtatgtgagataaagcatgttaactggcttgatttagccattccacaatgtatacatatatcaaaacaacattttgtaaacaatatatatgatttttaattaccaattttatttaaaaattttgttttgtcttaaacaactacatttctggtcatttgtgacagttagcaatggaaactaagggaatacagtgtatacagatgcttgtcctgactctccttaatctgaagtgactgaagtaggttcctgcttattctcagcagcctgggtttttgccttactatcctttatcacaatatggaattatttattcctttgtttgcccatgtttcgctgtaggccagggactgtcttctgtgttaccaatgctgacccagccagtccattataagctttcaacaaatagctattagttttgagttaagtgagaggacattcctagtcagcaagacagtgtatgtcagagccaagaggtagagaaacatgtgggtacatttgagaggctataaatcagatgactgttgtgtgaagagaatattggattgcaagcagatttacaggcttaaactaggttagaggcagggacaataagaaatggagagattctggtgacttcacattgtggaagtgacagaacctggtgctgagtctatgggaataggaaagtggaagtgacagaacctggtgcggagtctatgggaataggaaaaattatcaatgactgccatattgctggcttggtaaatggagtagatagtggtgattttcacttagaagttatcaaaagggagaaagaattgagaggaatggtaaattcagttctggacatgaataagatgcctgtgggacatcctagggtaggtctctggcagcctatcggaattataggtttggaacccaagataaagttgagggcttcctgtttgacttggatatggttgatttatgaagtttatgtaaggaaaatggtttttagcaaaaagaggaacaagaatggaactctgaaacactagtagttcagtagcagagggcagaagaaagggaaaataagacaagagaaaagtctgagggtatggtaacaccaagactagagaacgatgagggagtagccaaccagtgtcgagtgctacagaggatgcaacaggacttaatagtgtccactggttttagtaacagaggtaattaatgttccagaaaacattttgggcttttagacagtttatactaaagaattactggagcagagcataataatagtttttaagtcctttacttaatgttgtcaaattgcaaaaagatgaaattagttttcagtccagtagcagcatatgattgtgaccaaccatctcacagcatcagaagtagcatggtatctctgagtttatgtcctgactttacaatatttagtgcccttgggcaagttactcagccttggtttcctcttttccaaaaatgggacaataatattacctaccacaggtggttatgattaaagaagttatcaaaatgagtttttatttttaaagcacttaaacagtatctggcacatagtaaatgctacattgaagtgtttgttgggtaactgacagatacatagagagatggatacatacatgtatacatacatacataaaataaatgttgggtattctaattttttttatattttacaaatttgaaaagtaatgaatagtattttttttcagtcaactttatatatatactttacatatattaaaatgttcctggccaggtgcagtggctcatgcctgtactcccagcactttgggaggccaagcgggcagatcacttgaggtcaggagttcgagaccagcctggccaacatggtgaaaccccatctctactaaaaataaaaaaattagctgggcctggtggtgggtgcctgtaatccagctacttgggaggcttaggcaggagaattgcttggacccaggaggtgaaggttgcagtgagtggagatcatgccactgcactccagcctgggtgacagagaatccatctcaatcaatcgatcaatcaatcaataaaatgctcctattttaagcgaacagttaaattagttttgataaatacttgtacctgaatgaccatcacctcaaccagatgtggaacattctcatcaccccaaacagttcccttttgcctcctcccagtcagccctcaacttcatcctcaatcccaagcaatcattgctctgctttttttcctgtgaattagaatacccttttctagagtttcacgtcagtgaagtcgtaccgtaggtactctgtgcttagcttctttcacttggcatgtttttgagatgcattcatattattgcatgtaccaatggttcattccttccactccccgagtggtgttttgttttatggatgtaccacactttgcttatgaatacatttactctactaaatgtatagttttggttgttatgaataccgctatgaattcatgtataagccttcatatagacacatttttattgttttggtgtgtattcctttgattattattcctttattaactcattaaaagtttgaaaactttttcaagaatggtaactttttttgtttttgtgagttctatcttttgtccgtgttttattttgtggttttatgttttctatgttttaattattgagatagtctaatctttttatttcttctatatatgtaacatttataagttcccatgaaggaaatttttgacattttgctgtatatgcatgtatgtttgtgtatgtgtgtgcccagtaattttgggagttttaatcagttttgagaatgggctattcggcagttaatgaagacagctaacatgaaagttagggtaaactcaaatcatagttcatattcactataatttcttcagaattttttagattattttaaaatccatgtacattctagtagattctgtctagtacatttttcttgaatatgacaagtctaggttcctgacaccattcgttatcctttaagcaatgaaattttgtgtataacttagttttctgattaacttaggtttatctctttgttgtttttttgtttgtttctctttttttttttttttttttgagacagagtctcactctgtcacccaggctggagtgcagtggtgcgatctcagctcactgctacctctgccacccaggtttaagtgattctcctgcctcagcctcccaagtagctgggattacaagcgcctgccaccgcgcatggctaatttttgtagttttagtagagacagggtttcaccatcttggccaggctggtcttcaactcctgacctcatgatccaccctcctcggcctcccaaagtgctgggattacaggcatgagccaccatgcctggccctgttatttattattattattattattttaatttttaaaatttttgtagaatttaataccacacccggctatgccagacactcttctatttcaaatattatattcatttaatcctcacagcaacaatatcttcatagttatcttacagatgaggaatttgaggctaagtagcttgcccagggccacacagctaataagtggggtctacctcagagcccatgttcctaagctttatgctgtgttgctgacagggtgaggttaaaatatggaggccgggcacagtggcttacgtctgtaatcccagcaatttgggaggccgaggtgggtggatcatgaggtcaggagttcgagaccagcttgcccaacatagtgaaaccccctctctactaaaaatacaaaaattagccagatgtggtggcatgcacctgtagtcccagctactcaggaggctgaggcaggagaattgtttgcacccaggaggcggaggttgcagtgagccaagactgtgctactgcactccagcttgaacagcagagcaagactctgtctcaaaaaaaagaaaaagtaggtgcaaatctcagtaatagaatagcagattcacacttaatctttctcctgttttaggaagttaatacttaaaagaattattatttattttttctttttttcctttttgagacagggtctcactctgtcacccaggctagagtgcagtggtgcagtcatggcccactgcaacctcaacctcctgggttctagtgattcttcgactttagcctcccaaatagctgggactgcaggcacgtaccaacttgtctggctaatttttttaatttttttttgtagagatggggagctttctctgttacccagactggtctcaaactactgggctcaagcaatcctcatacctcagcctctcaaagtgctaggattacaggcatgagccactgcatcggccaagagaattttcaaagtatgcaattgaaaatgtaggcaagcagtctctagatcttaataatttataggtttctgaggttcagcattattgtcctagttaaataggcactttatcaaatatatttttttcatttgagtcatctttgatgatttctgttggtaagacaatagaaatgaatttccttttttaaaagtttatacaaagtttattaaaaatttttttttaaaaatttaaagcttatgcatttcaaaaatatcaaatacagtagcagttagtttggagtgacaagacgacccctgaagattttttaaggagagatttccttgtggtagagtagtgactgggaattgaaacatgcggctcctggagggagcgctttgcgtctttaaagtaagttatttattcttttatatttaatttccttattgatttggtagcccttacagacccattgaaaacacatagtggccacctccaggaactatttcctgtttgctcccaccttaagtaatctctcatttttctatctcttataacattttgtctactttaggtactatttcattttttaaacctcattctataaagtgttggtcacaatcccagagctttagacatgtatgcaattttttgttactgtttattatttttcaataataagtggaaattaagatctttctgttttttcaggccattttatacacttgatatgaaacttcctgtagaccattgttatttgaattgcttcttcaatgcagttatataacttggaaacttttggctgtgtaccaaatttatttaaagtcatttgaaatcatataagtccatttaaaaatgttttaccacaaatgtatttatgaatatgcagttaatgctaaattccaccttgatcattcattagctttgtggatctgtttccagtataacagggagaacactaaagctgccatgagcattaaattagataatgtctctgtaagattctattacacaattatcctgttactggcttataaaaggttcctcttaattgtggattgaaataaaacattctgcattaacatctaaagatataaattatctttaacagtgtttaaaattaagtaataattagtccaaacctcatcatgaaatagatcaacataaagtaccatgtggctcagttgaaagcaagttctttcagtttttattttaattctcattaaaatataggcaattttggagcatcagttgggggccttcccatcttcttttcaagtggaactgattggttttatatagtacttctgttgcacattttttattttgggattctggcctgcttcatcatagtgttcgtttctgaatcacagtagctaaactattgagtgcatatgtattgacttttgtgattttggaagacagcaaataaagtacctgctttgcaggtgaagaacctgaaagacaggatgtttcctattattgttttgatattagcctttttaatacaacatcatggtccatcagaagaacaagcctgagccaatgagccttagctaatcctaactcaaataaagctaccacataatgtttctccctatccagagttaacactgggtcttagtggactcatttgttcaaatgaagggacgtggcctcatgattattaaagccgtttttagcacttatggactacctatctcagctttcctggttcatttgtcttgagcacctcttagaagcattgcagactttaattttgttccacctatagacattgctttgttcacctttgtttatcatatttttagaacaggatttaatatttggaagggagatctaattctttcagaggaatatttttgtttgtttttttctgtaaactgagttaatgtgatacaattagatgcttcctttatggctgtataggtaaaatcctatgagagtaaatgtagccttttaaagtaaatgtgattaagaaatatatatacttattcaacagttacagtggcaagcatgggttgggaatggtgacttgctttgctctccacctaccccttgtctgtacccaggcaactgtccagggctggaggaaaatgcaaaataatgctgataggtctcactttaaattcatgatcaccaactacaaaggggccagtagtgctgtccagcgttccttccatgctacctattgtcttgcttttttatatgaatattttgtactttcttctctcctctcaaccattaatagctcctttcctttctccccgatcccagtgctgatgagagaataaaaatcaaccagaaggaaatgtctaacctttctccctacctggtctactaatgtacctatatctgtacccaggtactctgctggacttcagttattaatatgccctgttattatctaaggacagtcctcacttattgaattcacatcctgccttccctacttattgccacctctagcagtcatcccttctctcttctgcattgttaatgattcctctttctttaccagatcattcctatcagcatactcacatgttgaaatagctcccatctttaaaaggaaaaaaaaaaacttcctggagaccccacagttccctaaaaatattgccccatttcttcttacctctttgcagcagaactcttcaagagttgtctattctagctttctttccattctttcttgaaatttctccattaagactttcagccccacctctctgccaaaacagctctgatcaaagtcacccatgatctttccaaaggcaaatcactgatcagttctcactaacttgctctgacagcaatacttgatatggtcacactttcttacactctcttcccttggattccaagaccccacactttctgattttcttctgacttcagtggcaggttgctccctcatttcctggaccttaaacttccccagagttggttcttaaccttcccttatatgctcacctcctatgtcaaactagtggattccatcttgtggtataaactgtctattcgctgaagactactgaatttatatctctagcttggatctctcccctaagcacacactctcgtgtccagtggtcttgctttctccctgtggatgtcagaaggttcaaggccagtttctttatttccagtgctccaaactggttccttctgtagtataccttatttgtaattgctcttatcaaaaactgaagtcatttctgattcctctctagggacctgctgcttgccataccttcaaaatatatccagaatgttaacatttttcaccatcttcatagctacccctccatccaagccactaccatctcctgcatggattattgccatcgccatcttgttggtctcctttcctgtctttatctcctttttccattttccctctcattattctgccacactggcctgcctgcctctccttgaagaagctaagcacccctcacacttcagaaccttcgtgcttgctgcttcctctgcccagaatgctctaccaccaaacattcacaggggtctcctactccattcaaatgttcagatgtcaccttgtcagagagctctttccctgaaaatcctatttgatatagcaccttcctcttgcctgcattctctccaaacataattatttgtatattattaacttccctctcttctttgagggcagggactttgttctgtcacatctatatctttaagacccagaaccaagcctggaacattttggtgttaaatgaatggaggaaggtagtggtgatagtggtggtggtggtggtggtggagattcatggtattattctgttagatattaaagccccaaattagtttttaaagaattcacacacaactttttcaaacactatataaaacaaggtaaatctgtatacacacaaactttaaccaatcttaaacacagtcttacccacgatccgtttcaacctgtatttgatgatgaggctgactagccaacatttaagtaatcactatacagtagacattgcggtaagattatccagtttaattcccacaatactcctttcagtatatgttataccattttatgaaaaaggaaatgaggcttagtgagcttacgatgaggccagctgaagataggaagtggcagccctgggactggatctcagtgtgtttagcttcagaacttcttaagaatgatgggactggctgggtgccatggctcacacttgtaatctcagcactttgggaggtcgaggtgggtggatcatctggggtcaggagctcaagaccagcctggccaacatggtgaaacctcgtctctactaaaaatacaaaaattagccagtcgtggtggtacacacctgtagtcccagctacttgggaggctgaggcaggagaatcagttgaacccaggtggtggaggttgcagtgagccaagatcacaccactgcactccagcttcggcaagagagggagactctgtctcaaaaaaaaaaaagaatgatgggactttctaaaataaaaccctcctggagattcttttacatatgatctgtacatgttagtcatttatatgtttacatacttaaatagtaaagtatttgagaaataatgtttagttttagaaactaggggttaaatgttgtgattgttaagcagtaataaatataaatgataaacaagacacctttttaaaactttgagctaaaaattaaatctcatggcactttgcctaatgacctaagctagatcttgtggtctggttcatacaaacatgttctgataccaaaaccagagtgctgttgctatggctgtgaatgcttttctgtgtgagtacatagataccagtaacacagagccatggcttggagttctctgagttacttctctagagagaggaaagtgagaaatgaaacctcagcttcagatttgtaccgttaactttgcagtcgtgtattgctcttcataaaaacagcctcgaagtcaagagtaaaaattctgtgaaggtcgataaaacaagaagggaattgctaagtacaagggaagaaggtatcaatgaaacaaaccatggctagtcctgctgttaattttctggttctctagaagggacagtgccaagttagagttggggaacaaagagccccactctcctgcttttccttcttctgccacatcctgcttattctcctggtccactgaggcatgaatccccttcttgaggaagacctgaatgatgggacagcagtaacctgggggttttggtggcacatacaaaaaaatgtgtctgagagaactgacatttctcttaagatcccaaatgcctgtacagtgaatatagctgtcagtggcaccttctctggggggaaggcaggtccagattgcaaacactgtgctgagctaggttttcacagaatcaagaaagtagtgatgctctctgggagagctgttagcaattatgcgaagctgggagagctgttagcaattatgtgaagctaaatcctgttcatttagatattttagataatgtgctgaaaattgtcagtagagacacaaatatttgtaactaccatggatcttaaaatgtggctccacattcaaaataggctattgtctaatccactctgaaaacttctttgaggttctctttgttcttttgggaacacacatcaaaaatgtgaattggaactaatcagaggaattgtttgttgaattcataacatgatagcatatattgttttgttgatcttatctaatgtgaatgcagctaccaagtttttgtataatagttgctagtgcaatcttgagctattgattctgatttcttgctgattttatgctttgtgttaggatggcatgattcattcctctgttttcgttattaatttaaaaatgtagatatttatttcaaggtattataagtgtgcatatagttcagaatttccaagtgtcttaattaccaaaataaattgctgagatgtaattctttaaaattttaaaaaataagtaatgcatctttagatgagactgtttatgaacagagaaataagataggaggtgacatggataggcaattagtagctcctcctcaggattagtccataaggtgacacaaagtattcttattgtgttcttttatttttgcaggctttgtgtcatgaccttaatttctttttctgttccaacatctgctagcttttaaatggaataatttctttggtatttgcagtgtttgggagatgctttgaacatgctcagctattgtccccaagcaactgagtgggtcaaatttgagattggacttgttgtggatttaataatcaaccctttttggctttaaaatatgacttgccctttatttcactgttctcgttgtctttcctgaacaggctgctgatactttggctgtgaggcaaaaaaggagaatttatgatatcaccaatgtcttagagggaattgacttgattgaaaaaaagtcaaaaaacagtatccagtggaagtaagttacaaaccagcaccctcttctgaaaccttttttcttctcagtgctctgtaaaatttgaccttcccaatgtttctatctcccaaatcctctatttcagtcaggcccctcagctttccctgaacacacctttctgggcctctgtgtcactcctgtgttgggtgttcccttgctctcttggatattgggttttcgctcttaaaattcaaatcttactttctccctcaagctattactcatttggcacacattgcatactgtcttgtattaatctcttcctaactctttacctgtccttgagagcaagaactactttcataggaatttgtactttgtaaatagtaattaattgaaacgcatgttgtcattaattgtggcctggttatacgtttgaatgtaacaatttctgttcttctaatgtgtcccctttgaccatagtttttgtcttgttttgttttcgccaaaattccaccaaaacattaaaatgttgtaatttattttaccagcacctcagtcacatcctgagactgctaggtgtgactgctgagcacactcttttggtacccagtcaccaaccagtctggccttccagatgacaaaaaaacactgtagggaagattgagaatttttgtaatttggttgttcttgtcaataaattttctaagcaagaagtatggtgtttaaaatttttaaggattttagtgcttgattttaagagtgtaaagacttctgtcttgaatatattactaaataagtcagttttattacagtaaaaattaagtgatattaacctagatctgatactgaggatattaattctcatatgtttttaagaggtgtaggtgctggctgtaatactaaagaagtcatagatagattaagatatcttaaagctgaaattgaagatctagaactgaaggaaagagaacttgatcagcagaagttgtggctacagcaaagcatcaaaaatgtgatggacgattccattaataatagatatccttttaaataagttatgcatatacatatagctttggaatatgtatgtataaatcatttcagtctaaagatcattcactttgtttttagacagttaagttttataagtaaatatgacattttaattttattatattcttatatactaatattttctaaatgttacctttttaagttatatagtacagatccgttagcgttattcctgtgttgcactgagggggaaaaagagattagccaacttttggtctaccaattgatagaatgcagtatgctagccagtgtgcttaggaaatctgtgaatattagaagccattgttaagtacatttgtatttttaaataattatgttcagtgttctgaagtataaaattcagcagctctcaaagttttgaaaatttttcatttaaagatgagatatgatgtgtccacaatcaatccttgatactttctgcctaacatgaaccccaaaatagttcctactggagaacaggggtctaagtcgtgtgtgcctatcaacaatatatattgggggaaaaacattattatatataatacatataatatcatatataatatataaaatatatttatatataatatataaaaacattattatatatataaaaacacatatccatgtgtttcttacaaaccaccgtcttctctcaggtatctgtgattctcttagtttatgaacttacctgtactcttaaagaaactaaccacattttaccttgtagcacctcatgaaattttgactaatgtatacaatataatttacttttcacattttcatgtatttggtgaacaagtccatgatctcatttgttatttcctttgtatggatcagagccccttaacagtttgagaacaatgggagttttcaagctgtgttctgtggagctctgaaattcaaaagccattaatctattttatcttggacttcgctgccctgctttacgagatgctggccattcccattgccccaaccatggttatgtgtgatatatataaagttttctgtatattatggtattttgacatctccataaacctttctggctgaggagagactgcccatcctgggactagccacttcttagaaacagcatgggctcatgtcctttttagggtcatggatgacgctggaaaccatcattctcagcaaactatcgcaaggacaaaaaaaccaaacacctcatgttctcactcataggtgggaattgaacaatgagaacacatggacacaggaaggggaacatcacacaccagggactgttgtggggtggggggaggggggagggagagcattatgagatatacctaatgctaaatgacgagttattgggtgcagcacgccaacatggcacatgtatacatatgtaacaaacctgcacgttgtgcacatgtaccctaaaacttaaagtataataataataaaattaaaaaaaaagaaacagcatgggctcagccaggagcatccctttgatatataaactaaccagtcaaggtccagacctcctctctccagtccatacaccccaggtggcaatattcctctgccttaatcatcccagggtcaggtaccagacaactgggggactacctgcatagcttagagcccaccaaaattatccaaactaggccaaatgcagtggctcacgcctgtaatcccagcactttgggaagccaaggttggcggatcacctgaggtcaggagtttgagaccagcctggccaacagggtgaaaccctgtccgtactaaaagtacaaaaactagctgggcatggcaatgtgcatctgtaatcccagctaccagggaggccataggagaattgcttgaacccaggaggcagaagctgcagtgagccaagatcacactactgcacttcagcttgggcgatagagcaaactccgtctcaaaataaaacaaaacaaaattatccagactagctaatcgtagtgttctccccaccctgcttttttttttttcctgagatggagtcgctctgttgcccaggctggagtgcagtgatgcgatcttggctcactgcaacctccaccccccgggtttaagcaattcttctgcctcagcctccagagtagctgtgattacaggtgctcaccaccatgccctgctaagttttgtattttagtagagatgggtttcaccatctctagactagacttctttttttatctgtccatgtgtggcagcccctctgtgcatatggtcaggctggtcttgaactcctgacctcaagtgatccacctgcctcggcctcccaaagtgctgggtggcgtgagccaccatgcccagccaccctgcatttcttttcccaaggaaaccccaataaaagctctgggctaatgctttccccttgctcctgtcttctgcctcctgaccaccttgttgtcttaaccatgtggccctgagtagcctgccttgcctcccgtcactaggacctatgagtataatactttgtttttctgagcctttctttaatcctctgtgtcctcttgtggccatacctgaccatttaatacaagaacaaaaaacaacgatcacagaaaattcctgatgtggaagctgatatggttgctgatggcctccttttccccatccattcccttcccccagaaacctttgcctccatgaagaatgtgcactgctttccatctctctcctaagggtcctcaaatgtcacaaaaatcagaatggcttcttctaagagcaaaggatgggaactcctttgtctttacctttctagactagacttctttttttgtctgtccatgtgtggcagtccctctgtgcatatggtcatttagttattttgaccttcagatgtattaccttaatttaaatgcctacggcttgatataaatgtcgttccttaactcctatgacagtacattttcctatgtaactcatgaagacatctgtaattgctttaatggtaagtaccattagacttttccttgcattcttcctctcaacctatttagtggagggtgattcagaattccctgtgtcctcatcctgtcattattttcagaagttgtgggcattgtgtctcactccaccatgccgtgtattgatagactgcttttgtttctgttttcatgagaatagctgcttttcacagcattcagttcattagctccactggtagggatcaactgtgtgtggaaggggaaggggacagggacagagggcaagctaaatcagagcgggattaagcaactttcattgtcacacagtcacagagttagtgaccaaacttgaactagaacatggttctcatcagcattgtttatcaaactatatgcaagtatgctggtctcaaatgaaactcaaagaaaccataaggaaagaattaggtgaatccatcttataaccaggaaacctattcctatgcaatttgctgcccctgtgttttctccttaaaataacaatatcatgttaataattataattattaatataactaaaatggggggacgtgtgttcccaaaattatagcacaagtaaaatgaaattgtgcatatttaaatttatgtgtattatccacctatttaaaaagattctgccaagtacctcatcaagtggaatctgactttctatgtaagactatgttggaaataagtataggactattgttctattttaccactgtatttcctgagttttttaaggaagtttgctgagacttctgttaatctgcaactcaacagagatttgttgtagaatttggcttcaaaaataataaaatcatttaagctcaacatttcagtgtctcatacctaatctccactatcctcagtccaatgaacagtgttatttgaggctaaatggtcttaagaatctcagactttacaggagtcttagtcaaagcaaaatcaacttgagctgaatttgttaatgagaatcatacagctaacccatgtataatactaatacatgtattatcttatttaatcctcaaaataaatctatgcagtaggttgtgtatcccccattttatagaattgaaaatcaaagctcaaggtcacctagtttgggattgaaccaaacactctgattccagagcccacattcttgccactgtattccatgatcaacagtattttatgtaactttttatatttatttttgaccaggtgatacacttttggccattcaggcaccttctggtacacaactggaggtacccattccagaaatggtatgtaggataacttatgtttatataagtgggaaaaatgaatctactgtctcaagaaggatattttctttagctgaatgtgagctaattgtgtaaacactgtgagttagtcaagtttttatctaaaagtattgatagctgaatttgtatgtctttaattccttggtaaaattatagaactaaatgaatcataaatgattttaaagattattggctatatccttagtcatttattgatatcatttagctcaaagtcaatttttaaaaagtaatcagaatgctttatcaagtgatttttgtttcatacaaaaattaaaactattgtataaaattatcttcaggctatgtgaataaggtgtgtatgaaacaaatgaatattgtgtttagacttgggtcctatccctaagatatctatccccaagtaaccaaatgatttaaaatgatttaacattttgattaaattattttaaatttgaattttttaagttagaggatgtcaagaaatgactaatcatatggccaataatctataaaaataagttaaaatgaccacattgggctgggtgcagtggctcatgcctgtaatctcagcactttgggaggccaaggcaggtggatcacttgaggtcaggagtttaagaccagcctgaccaacatggtgaaaccccatctctactaaaaatacaaaattagccgggcatggtggtgcatgcctgtaatcccagctacttgggaggctgaggcagcagaattgcttcaacctaggaggcagtggttgcagtgagccgaaatcgcgccattgcactccagcctgggcaacaagagtgaaactctgtatcaaaacaacaacaacaacaacacatctacaattgatataaaaattgccactgaggaaaaagttcaatgtacatatcaacaatcaattcctttaaattaggtcttttataaaacattgtctggcttattaagtcaaagacatttattgactctatgagtttcatgattttcgttttcagattcagatttttaaaaacaaactaatttgaaagcaataaccaaaaaagggagtagaaaaagattactatattatctacctccttcccccacccgcttattaaaaaagtttacatttaggcatttgtattactggagtctgaagcctcaggatacagattactttttcagctggaagaatgttatatttatttctcagtaggagaaattagttgtctttgtgcttgcagatgggaaaaaaaagagtttgatttgtgaagcatgttgaactgaccagatctgtggtggccaactccaggggataaatttcctgtatatggagaatacctggagcattgctgggccctgacctattatatagtcacacacggtaacaacagatggttgccagaattctacaacagagagtttctaatgatcagtatttgtgaaaagcttactttttagaaactagtggtttagagccctcaaaattacattctactctatgtctctacttttgtgttttgacttaatgactttattgtgttatgtgaatttagtaagtccctaatagctttgcctgtcttattgtactgtcttaagttagctagaaatgttaataattatacatttgtttatacccaataacttcaaagggtcagaatggacaaaagaaataccagatcaatctaaagagtcattcaggacctatccatgtgctgcttataaataaagagtcgagttcatctaagcccgtggtttttcctgttcccccacctgatgacctcacacagccttcctcccagtccttgactccagtgactccacagaaatccagcatggcaactcaaaatctgcctgagcaacatgtctctgaaagaagccaggctctgcagcagacatcagctacagatatatcttcaggtgggttcagagcctttcttttgtaaattagagagggagaaatataaaaacaggttggctctcttatccaaagtgcttgtgaccagaaatgtcccaagcacttttgacattttggaatatttgcatatacataataacatatcttggggataggacccaagtctaaacacagtattcatttgtttcatacacaccttattcacatagcctgaatataattttatacaatagttttaatttttgcatgaaacaaaatattgactgtggcttgactgcagcctatcacaaggtcaggtgtggaattttccatttgtggcatatgtagatttcagcttttacctgaagtttacttggtaaggttcttttatctctcttagtaagtctaggataaattagtgaaatatgttccaactacctttaagaaaatatgttccaactatctttaagtatggaccatagtgacttatgcctcttgtttctccatattctttgttatactttttatttgggaagcttagttttatagaagtgataaatggtctcaactccaattatgtaggaaatcttactttcctcatttgtttcatttatgaaattttaaaaagctaaaacatttcacactgggtatcaggagtagagagcacaactcttaatttggcagtaccttactgattccaaataaagggagcatggtaggcaatctctcagtgactactgaatgaatgaatgaatgaatggtgccaatatagacatcatattgcagataatttaaaactatattgtatataatccaaattgtttattttacctctaggatgtgtctcattgctaaaatgggatttcacaggttaaaagtgacgctaacaagatataactggacatggaatgttttttagcttctttttgcccacatctattcctttctttcccctataaatatgtctatactacagaccattaggatgcacaatagaaaaggtagtgctggctgggcgtggtggctcacaactgtaatcccagcacttagggaagccaaggcaggcagattacctgaggtcaggggttcgagaccagtcttgccaacatatagtgaagccctgtctctactaaaaaatacaaaaattagctgggtgtggcggcgcacacctgtagtcccagctacttggaaagctgaggcaggagaattgcttgaacccaggagttggaggttgcagtgagccgagatcgcaccactccagtctgggcgacagagtaagactccatcttaaaaaaaaaaaaaaagaaaatgtagtccttaaaaagcttacaatctaattaggatataaagcaggcaagctttacatgggttttacctgggttagcttagacataattaacacactggcttcaacaaagtgtttttaaaaagtgagtattctgtttttatggtttcatgtttggaaatcctaactaaggaaagtaattttgggctacattagagcaggccttgaatttcagagtagttaggacatttatccaataaaccagtgaagatctgtgaccaaggaaatagcataattagctataatggtgcacacaggagtaatatgattaggaaagatgcttttggccctgggaagcagaattcagaagcgatggaaactgtagatgtttgcagttatgcaactgagagaacattagggctaaaacaagggccaagtgtggtggggctcatgcctgtaatcccaacactttgggaggccgaggcaggtacactgcttgagcccaggaatttgagaccaacctgggcaatacagtgagaccctatctctaaaaaaaaaaaaaaaaaaaaaaattaaaaattagctaggcattgtgacgtgtgcctgtggtcccagctactggggagggaggccaaagtgggaggattgcaagcctgggaggtcaaggctgcagtgagccctgacagcacttaatgtactccagcctgagtgacagagcgagatcctgtctcaaaataaataaataaataaaaaggctaaaacagtgattacagtgagatcaggaagagaaataacgaacagatttgagaaacactgtaggcaaaataacatttgatgtgtgagatctggagataaagttaacaggaatggaaagtgatgttgaagttttaaggttgaataactgggagaattatgaaactactgactaaaactgagtcagttttggtagaatgatgatgaggtttggtggtggtttttttttttttttttttttttttttggcagggtctcactttgtcagccaggctggaatgcagtggcgcgatctcagctcactgcagcctcaagtgatcctcccacctcagtctcccaagtagttgggactataggcacgtgccatgaatgtctggctaatttttttgtattttttgtaaagacggatttcactatgttgcccaggctggtctgaactcctgagctcaagcaatccgtccacctcactcagcctcccaaagtgctagaattataagcatgagccaccatgcctggcagataatgagtcttttggtcttcgtctggagtttggaagtttaaaagtaatgccaggcacagagtaagcgctcatgaaaacaacctgtccacaaagtactagtactttaaataaatgtgcatgtcagtcaagctgctgctgtgactacttgtgtttaaatatgagtatcttttactgttaacagaaatataacaaaactttattactgtttccagcaggatctattagtggagatatcattgatgagttaatgtcttctgacggtaagtaggttaaaattttactaactcacttatcagtaatgcttctgtggaatttataagtgaaacatgatttaaaagaaatgaacatatatttgctacctgctttactatgaagattcatgaaaattctcccttaacacttacagtaagtaataggcaaccttcagaatttatttttctttgcttgcattttgagggaaaggaatccatatggggatacttctcaccttcattgaaaataaactgttagccctttccactcctgaaggatctggtccaagaagagtaaaataacttgtctaaatcaagcaactgatctgaacacctgcctttgtaaatacccctacccaggccaatttcaagctgccaatgggaagtcactgaattagtattaatattaaccatgttgtcatctaacctgaaaaattattaaatatcagttagctacaatatgctaattactttaataatttctctccttctgtaagttcttggatcagagtcctactacctaacaaataaagtagaaacctacgaagtggtagcagttaagttagcaaatgttatagtaactagagatgtactaaacatgtatgtagaagcagagaacatcagcaaactttgtaagtccagttcattcttctgtttgcaaagtggaaaacaaaacactttcattagtgttctgttttttttttttaaggcagagtctccctctgtcatccaggctggagtgtcatccaggctggagtgcagtggcatgatagctcactgcaacctccacctcctaggttcaaatgattctcctggctcagcctcccgagtagctgggatgacaggcacctgccaccacacctggctactttttgtatttttagtagagacggggtttcaccatgttggccaggctggtctcaaactcctggcctcaggtgatccacctgcctcagcctcccaaagtgttgggatacaggnnnnnnnnnnnnnnnnnnnnnnnnnnnnnnnnnnnnnnnnnnnnnnnnnnnnnnnnnnnnnnnnnnnnnnnnnnntggtggcaggcacctgtagtcccagctactcgggaggctgaggcaggagaatggcgtgaacccgggagtcgggagcttgcagtgggccgagatcgagctactgcactccagcctggacgaaacagggagactccatcttaaaaaaaaaaaaaaaaaaagaaaaaattaacttctgtttctcaatctaatatcaatattcaatgtacaaattgttactaaatgagaatatttcaaaatacacattacacaagactttaatttggaatgatgtatttgagagtattttgttaaagatcattaaccgtatgtagaaaccatctttaacactaaatttgttttttgttcgcagtgtttcctctcttaaggctttctcctaccccggcagatgactacaactttaatttagatgataacgaaggagtttgtgatctgtttgatgtccagatactaaattattagattccatggaaacttgggactgttatctacctctaactgtgtaacattttagacttcttaataacctaaatatttaaaataatgaatgtaacaccttttttagttcactgattctgaagtgttcttccctaatactttctttacttcacaaaacttcaaccataaaaacaaagggctctgattgctttaggggataagtgatttaatatccacaaacgtccccactcccaaaagtaactatattctggatttcaacttttcttctaattgtgaatccttctgttttttcttcttaaggaggaaagttaaaggacactacaggtcatcaaaaacaagttggccaaggactcattacttgtcttatatttttactgccactaaactgcctgtatttctgtatgtccttctatccaaacagacgttcactgccacttgtaaagtgaaggatgtaaacgaggatatataactgtttcagtgaacagattttgtgaagtgccttctgttttagcactttaagtttatcacattttgttgacttctgacattccactttcctaggttataggaaagatctgtttatgtagtttgtttttaaaatgtgccaatgcctgtacattaacaagatttttaaaaataaaattgtataaaacattcaatttattggtctttgtggagaattagatgcatcaccagtatattacaacagagccattaatcttgtagcttcatcaacattaactggtttgctttcatgacgctgctgaggaatctgaaaggagaaagtattatatttaaaaacacagacaacaatagcagacaaatgacttatataagctgttattcaatttaatttttctagtcatatctttggaagtagaacaatctgtatattctgacaatgttttagagtctgaatatgctatttatactatagagcctagtactagagagccaagtactaaaaattacactcaacttacaggctttgaaaacttgggagtttaatttattagcctcaatttgttagccataaaaaaaagcaaatgatttctgcttaccagttctttctgcagaggttcaagtgaaatgctttttgcgaaatgtgcaagttccttttgtacatttacaaaagctttatttactctgttaactttttcctcattcataatgtttatcttttaaaaagaaaaaaagcattaatctatgatctcataaccattaaagataagatatattcaaccttaacctgttaaatctaaaatctaaaaactcttaccaacaaattagggataattcactcaaaaattcttatagtcttattgggaaattacagacaaaaagttttggtttttaaaaaatgggatttatgtggatatgcctcacacttatggttcagaaggctaaaatatgtgactgtgatattgtgattcataataagatatatatatatatttggtctttgtcctcatttcctgtcatacagctttttaaatcattgtattaagagggataagagtgtcttttgaatgctaataagatggctggtagctgggagtctctagatagcttcaggaggagggctagtcagataaaaacacagggttagaggattaggactttctgctccagaggagtggggataaaggttaagcccatcactaatggccaatgatttaatgaattatgcctacataatgaagcctccggaaatctacaaaagaactgggttcaaagagcttctggatagctgaacacatgggggctcctagaaagtggcatgcccagagagagcagggaagctccatgccccttcccatgtaccttgccctctgcacctcttccatctggctacgcatctgtcccctttgtaatatcctttataataaactggtaaaagtattttcctgggttctgtgagctgctctagcaaattaatcaaacccaaggagggggtcatgggaacacttatttataactggttggtgagaagcacaggtaaaacatctgggacttgtgattgtcactggaagttggggagaggcttaggactcaactctcaacctgtggaatctgacgctatctccaggtcagcagtgtcagattttaattaaaggacacccagctgctgcctgctgaagattcatctgcagaattgttaggtgtgggggaactgccccacaaatctagtattggaagtgttgagtgaccgtatgagagtgagagtaagagaaactgagttgcttttttcctgtatccttacagtgaccaaaatctttctaggctacagtgctgtcatcccgcatctatacaagaaacctggatcaaatacttttagtcccttctaacataacaatacgtctctgaatccttcctggaccttcttgtcttaatggaagacccctgatgacagcttccctcgcagtcctcctcttgagtttaacagaggtaggggtggtgctcttcttcttcactgttgctgctgccaaacaatttctccttcaaaacccttacctcctttgcaccttatgcagcctacccatagatctctctcttagatcctacctggtggcatatataaaagttctagtacctcctgtccaaataaaataatcttcctcaaatacaccaagcttttccctagctcagggcctctgcac

SEQ ID NO: 13022 - DNA, 25656 bp, Human
tactcattattttcattgtgtaatagttccttagaaagcagatttggatatagtttgttcatatctgctatatatttatttgctttataactattttgtaaatttaatttacattattttcctagaaatttaaaatcaaaatgttcaaaacagtattgtaacaagaatattttaagatgacttaaaaacactgctaaataattaaactcttagcaattttgtttcagacatctccactttaatgtcaactgcatgggtcaacaaactactgtggccccagtctgcctatttttataagcaaaaccttattggaatacagccacactcattacatttaagtttctgtcagccctggtgtagaggattttatcccttcgttcctgcagacacctagatctcaaagaatttctcttctgtatcttattaaactggcctgtgggctttctgtgtgtttcatttccctctatagcaaactgtttacttctttgagattggtcttttctttttctgcaacaggatcgcagtatgtggtagggaagtgatgctgtctgaaggtgacatcctgttctcctctcttctgtcctctccatccttattttggccacctggtaattgggggggaggggtagaatgctagtctaaattataaaatgaaattgctttaactatttcccctttacttgaaaaagggggttgggggtgattcctgccttgcagttgagaaataaaagttatctagctttcagcacaatctgttttggggtcatgggatcttttgagaatcagaagaaagttgtggagccactccctggggggaaaatatattcagaaatatattattacagaaatgaatctttgatcagtttttaaaccttgaaatacaagtgactttaccaatgtattctaatatacttgttggcagccacttctgatgttagaactttgaatatagacatttgagaaaaataattgattttaagtgttcccaaagtaaatcactggttcaggatagatctatcttagtgttcccaaattgtgaaaggaaagagattaagcccttaatgttgaaacgtgtgtctcccaaatcttgctttgtgcttagcagtagagctatgaaattccattgatcagagggcttgtttctgaccttgtccttttttcacttttgcacgagccctgccatttgaccagtgtgtcctaaactttattcattgagtgctgtcttcataagttggccttatctgcacatttcctgatattctttcaatgaactcagtttttaaaatatatatttttttaattttttaaatatggaacgactcacaaatttgcatgtcatccttgcacaagggccatgctaatcttctctgtatcgttccactgttagtatatgtgctgccaaagtgagcacctaatttttttgtaaagacaaagtgtttcctgggctagtcccaactcctgggctcaggcgatcctcccatctcagcctctcaaagtgctggcattacaggtgggagccattaactcactttttaaaacttaaatttaagcaaataattactgtctgtgaaatatgcgtttcatgtactaattcttttatattcgccacttaaaggatcatgtaaatattgggggttttgtttacctaaaaccatcttgtatctttttagagggcatcaagttcattttgggaaacattcccctatgtactggaattttaaagctttgattttgaaccagagtatgaatggtggaagctgctttaacttggaaataccagggaaaaggaggggtcatgggatgggtgggtgctgtctgctgaaataccccttgcttgggcaaatttatgtgtcctgaatatgaggatatttggctatgtgcatggcaaagcttgggatcgtacccttgcaagaacagttggtttgttttttaacctggccaaacatgcatacacacacacacgcacgtgcacatttcataagttttattttcttttacaggtttgatcttgctcttctacctagttttttatgggttcctggctgcactcttctcattcacgatgtgggttatgcttcagactctcaacgatgaggttccaaaataccgtgaccagattcctagcccaggtaattatcttgcagttatgactttgttttttgttttttgttttttttttgagacagagtttcactcttgttgcccaggctggaatgcagtggcatgatcttgggtcactgcaacctctgcctcccaggttcaagcgattctcctgcctcctcagcctcctaagtagctgggattacaggcatgcgccaccacgcccggctaattttgtatttttagtagagacagggtttttccatgttggtcaggctggtctcgaactcccgacctcaggtgatctgccccgccttggcctcccaaagtgctgggattacaggcgtgagccactgtgcctggcagtggttacggcttttaacaaaattgagttatagtttatcttcaccataaatctgttttatatagcagatagaagatagctaaaccttggagctgagtaatgtgaaggttttaatttttgttgttgttgtttaatatttacatactgatttaaagaccttcacatttatatactgataaatcttgagagtttgagtgggtttgttttgtttgtttcggtttctttttttttttgtcagaagtaagcaaatgaatattgagaattctagtaaaagccacgtttgaagaatatagttatagttatgagtgacttatgagtatcgtagagcagttttactttgccttgagtaattaaggtatatattttggcactagcttcagttagagctttggacttataaaatacatactttgtcgttctaaatggttagttatgaaattggtaagatgttaaataatgatacctcatagagaacaaaatgaatatactcttcatatgtttaattcttcttgattttcttctggaaaaaaaattcattatacaggagaatgtatgcagtaaaaaactgaaacatctaaaccacattttctacctcctgattttattctttttaaacagtctttttttttttttttttttttttgagacagggctttgctcctgttgcctaggctggagtgcaatggtgtgatctcggctcactgcaacctctgcctcccgggttcaagcgattctcctgcctcagcctcccaaggagctgggattacaagcatgtgtcaccacgcccagctaattttttgtatttttagtagagacggggtttcaccacgttggccaggctggtctcgaactcctgacctcaggcgatccacccgcctcggcctcccaaagtgctgggattacaggggtgagccaccacacctggcctaaacagtctttgaatgccagctctcccttggtgactggacatgacccttgtcctcagatgctgataattagaaaagtaagaaacagtaatgtgcagaacttcagtgtgtataattccaaagactgtaaactaactgctatagatgacagagaagggaaggttctacctaaagaagaaagttcagtcctagaggagtgggatttagagggcaggagagtggggaatcgggccaggaaggtgggagtctagcaggtttctctctagagcagtggttttcaaccactgagtcatatggcagcgtctggaaatatttttggttgttacagctagagaggtggtactgtgaatagaggccagggatgttgctaaacatcctacagtgcatagggcaacccccacaacaaagaattattcagcccaaaatgccaataatgctgagatggaagtgcccttatctagatccttgctcactgtatagacttctgagctatatcaccagccaaactgaactaattgtctcaaccattttttttcctagaacaatttttttctaatgatttcttttgtttacagctaatcttagtctaaatgtcttgaataactcttttaaaactcttagtgtattggagcaagtgtcagagattagttccatgctacttttccttcatctctcattgtagcactgtttttttctacctcagactaattctaagattattctttacttgctatttaagtgatgtgacttaccattgaacatagtctgatctattcaaaaacactgaactctgtttataattgcatgaaatatataagcatatgtgttaaatatttttaagtacacagtttttaaactgagtttcttaaaattatttgtcgattattttagtacttaaagtatcattagtttaaataaatatacatgcatacacatgtacatataatacatatatattacatatgggacatattaaacatttccttatttaatatatcacatgtacatgtaatacatatataatatgtatttatgtgttgtatattatatacatataatatgtattatatgtacatgtgtgatatattaaatatgggaatgtttgaaggctagagaaaattttaggattgttttaaagcctatgtgcaaggttgaattaatctagatctaatgcttttttttttttttgagacgaagtctcgctctgtcgcccaggctggagtgcaatggcacgatctcggctcactgcaacctctgtctcccaggttcaagcagttctcctgcctcagtctcccaagtaactgggactacaggcatgcaccaccacacccacctaatttttgtatttttagaagaaatggggtttcactatattggccaggctggtctcgacctcctgacctcaagtgatccgccagcctcggcctcccaaagtgccaggattacaggtgtgaaccactgcacgcagctgatctaatgctttttaaacaaggaaaacttacattaaagttggaagcctgattgcttgccttatcttcattagtaagcttaagcaacatggtctgtattacatgggtgtcaacttctgataggaaattgttggtggttatactccaaattcagtatgtgaaaaccacattttaattacagagcaatatctgctattgaaggaagaatatttgccataaagtttaaaatgcatagacctttttcattgaaaaggagttagctgtcttatgaatgtttccatacaatttaaatgacaaaagtacgtaggctttgatttgctcaaatttttttccttgtattaatggcacattgacaaaacctaaaaatgttatttgattttttaaaaatgcatatagaaagttcaaagtaaaattgcatcttttaaaaaggaagattataattaactgtagataaccaaatttagggacagtttctaatcggtaatgtctgagatggttttgaaggtttgagttatttttaattttagatgtctatgccttcataattagaattgggaagttcttgatagtttcagcatactgtcaacacaattttccatgtaatttgctgagatctgctttttagagataagaggaaggaaaagaagagaaggaaatttgataatctctcccttttatctctttataggactcatggtttttccaaaaccagtgaccgcattggaatatacattcagtaggtctgatccaacttcgtatgcagggtacattgaagaccttaagaagtttctaaaacgtgagtatgttttcttagagtaaggtcagagattttagttatagaaattagtaccaaattgtgggccgggcacggtagctcacgcctgtaatcccagcactttgggaggccgaagcgggcagatcacctgaggttaggagccaggtcttggacctggccaacatggtgaaacccctggccaacatggtgaaaccccatctctaccaaaaatataaaattagctgggcgtggtagcacgcgcctgtaattccagctactcgggaggctgaggcagaataatcgcttgagcctgggaggcaaaggttgcagtgagccaagtttgcgccattgcactccagccttggcaacaagagcgaaactccgtctcaaaaaaaaaaaaagagtcccaagttgtgattacatttagacacatcattcttagaatgtgtattaccttctatttccttctgttaagcagacaactgagcaagtgcattttataattacttgtgagactgttctaactatagaaagacacaggggcttactcatgggtagtagatttgatttttctgtcttataataaggacactaaatttcttgaaatgtaacatttattctgcattaaaactaaatattttaattaatagagcaaatctatattttatgaaatagtgtctctgaggacttggatttttttttgccattttattttatttctttttttttgtagctgatatacatttatgttgaatttgaaataggtcagtatagttattgagaaggaagaatctttttttttgtgccaggcattcttttttttttttttttttttttattatactttaagttctagggtacgtgtgcacaacgtgcaggtttccaatgtagtgcttgcttgggggatgggaaattatgtttattattttaaagttatgtctgtgtctgatttttaatacatccgtttttcaaagttaccagtttgtaatgctctttgatagccatcctagcccagtttttcctcctgttttgcttggccgagccatttatgtgaatggtgttaacagtcacatgagtaatcatcgaatgtcctggcctgctggttcatgatcagctcatctcttcctcagccacagacacctgcaactgctccctagaacattactttatctcatctcccaccccgtcttcccttttatgtagcttaattccatggttgttatttcatttttacttttactggtgctctaaaatcccagacctctcagtcttcatgtcacaccctgtgggagtaccccactcctggataaagccatataattactggatgtagctcatccttctgtgcccctgcccctgagcagatactgagcaggactaattagcactgtgagtacttgagcacctccctcaaatggacttgcttaactgcctggtaatcctatggaatttctctggataattctctgaaaggattatttccaactttcactcaagcctctaaccccttacctttttccttacaactcactctcttcatataacctgatttcttgcttcaagagataatagaagaactcagatgggagctcctccagtttccccattaccagtaaaacaaatctacaatggcagccattttgtctgtcacattcttcctgctctgactgggggctgcccttcctttcacctgaggccacctgtgtcactcctgctttggatctcatcctctctcagtgtctcagaaacatactgtgtactctctcttcttgtgtgtatttagcctttctgtctgtattggatccttcctgtcaacttgaaaaaatcttcaactctctcctatcttaaaccaaaagctgcttctgatcccacattatctactagctgtcttcctaagtctcttttcattgacagttaaatatgtactcattatttaaaaaagacttttgtgaaagtattatccgtggtttaatagctttaaaaggtctgcaatgaagtgttccctgccctcctcccttccagcagaagtcctattaatttattgacatattttttgagggcctgctttgtggcaggcactcatttgggttccagcaatgaacagaagaaaaattcctgtctttctggagcttagactcatggtgaattagaagatagtacatcctgagggggaaaataaaacagaaaaaggagatagggtaagttgggaaggattgtggtttttacatgcagagtggtctgggaaagccttatggaaagggaaccttgagggaagagctgaaggaggtgaaagaactagccctggaaatgtccagcacaggaagcagtaggtgcaaaggccctgaggcttatggtgctgatgtgttgaagattcatcaaggaagtgagaggggctgaatggagtgagccaggggagagcagtaggagactgaggttagggagttaaaggagatccagactgtaggtccttagaacccattgttaagttctttggcttttacagtgaccatgatgagggattttaagcagtgaacaataacatgatctaattcaaatttttaaaggatcctgcaggcttctctttgaaactagactagaaggggggaattggggaagccagttaggctattacaataatctaggtaagtggagatggtggcttggcaagggagagagcaatgaaggttgtgaaaaatagtctgattctggacacatttcttttttctttctttcctttgtctatttgtctgagatggggtctctctctgtcacccagtggcacaatcacagctcactgcagcctcagtctcctgggctcaagtgatcctcctgcctcagcctcttgagtagttaggaatacaggctcacatcatcacgcctggctaattttttaattttttgtagagctggggtcttgctatgttgcccaggctggtcttgaactcttggcctcaagtgatccacctgcctccgcctcccaaagtgctgggattacaggcgtgagttacagtagcacctggcctttggatgtgtttttgatagggaattaacttcatgcttctgaactttttcttacggtgtttttcttccatatctataaatattacacttttcctgctggttcttgactttttacttttctacattatcacttttctttattaattattatttatcacttttatacattttcttagttcacatgtctcagaccttccctcctttctcaactcaataataattgatttactatttttagtttcattattggttgcctttttatacttggtctttatatcttcttttatcatctatagatactctcttctgacttccttatttgtaaactatcatttgaggtattttcttgagtctcttttctggaaaactccttcctggagccctttccctcctgctgcactctactgtttctacatcagccttttactcccaactgtcctttggggaacttccttttaccactttctttagttggacccactgtttcttggctcttgccctgcccccccccttttttttaattatttttattttttctcttaatttactccttagttttgatggagtacattctcaagtaattttataagaaaagacacctgaaatgtaaatttgaacccttttatttctgaaaatggcttatttctgcctttatatttgctagtttatctccatatagaactcagttctttgtaatttgccttttctcttctctgaaagtttttcattttttttttcaattttctttatctcttttggattctaaaatttctatctggatttctgtctctaaagtattttgctgagacttgactgcaggtttttcaggatgaagacttaagttcttcagttcaggggaattatcctctgttaccactttgataatttcctcaactcaattttctggttttttctttctagaactattctgtttgttgggtcttagacctcttgtttttctcttactttgtttttacttaattagactttctgggggtttactttaattttcaactcctttttggtttttaaaacgttcgactgctgtcaatccttatgccctcctttttcatgtttgaaagatactataatatatctggttaaaaaataatgtcttctctattttttttcctgcagatactaattggacttaaaaagttttattttgttccaattatctctttcctttagggtcattcattcctccagttatcttggtctttttttttttttttcttcattgagacagtcttactctgttgcccaggctggagtacaatggcttgttctcagctcactgcaaccaccgcctcctgggttcaagcgaccctcatgcctcagccttccaagcagctaggattacaggcttgcgccaccacacctggctaatttttgtatttttagtagagacagggtttcaccatgttggccaggctggcctcaaactcctagcctcaagtaatctgcccatctcagcctcccaaagtgctgggatttcaggcatgagccactgcgctcggcctttggtctttcttattttaggcgttcttcagatgcatagggctccttggttactctggggtcagtgacctttctatgttcccatcatgccttctgcataatcttactggtcatcacacagttccttacacttaatagtatggaagtggaagtcagcataataaaaaagcaaggtcactgatgaactgacctataccaacagagtctatgcagtagaagcccttggggaaattggtgaagggcttatttttttgcaaagtgttggatgtcatgatgctgttttgttataaagtttatctctacccccacaaaatacctgaatcattctttgcttttaaatgagtacatagtcccacagtaacctagtttctggtaagtataagatgaaaccaaacattttgacagtgattttttcccccaaggtaaagactttacacttcctttttgaggcatactctttgaaatttggttcttatttatttatttatttatttatttgagatggagcctcactctgtcgcccaggctggagtgcagtggcaacctccgccctctgagttcaagcgattctcctgcctcagtagaatccgagtagctgggattacaggcacctgccaccgcacccagctaatttttttgtgtatttttagtagagtcgtggtttcaccatcttggccaggctggtcttgaactcttcatctcgtgatccacccgcctcggcctcccaaagtgctgggattacaggcatgagccactgcgcctggcctggttcttactttcattgaattcaatacctttttctggtaccaattgcacccacacaccaatagttcttcctgaggcactgttatatcatatgttaattatttattagtaagcattgtccactagattaagttaattgagggcaggggtcacatcaggcttgctcactttgtgcctcttgggctaaacactgtgccaagtacggagcagaattgtattgtctgttgcatatttctcctccctcttccctcccattaccaagttctaaccattttactcctttatcactgtaaactccatctctgctaaaaacccccttctatgagctagtctctcacctgggcggctttaatagtctcctaacttgttttccggatcctttctttttcccttctggactgactccacagaaaagtcagagttaatttcctaagtatgttcatactatccacttgccctggtttaaaacattttagtggattgttaattgatgtttggcaaaacacccacccacacccctcaaaattctttaacatagtttacaagactctatatggtctggcttctaccttccttcattggaagtgcttctcctagcttcattaactcccacatacccttctgcattcagctcagttgctttttttttttttagtgtaggttgtcataacactacatcttcatacctctgcaattctgattttatactcacttaatgactctcttccccacaaaaccgtaagctccatgagggcagcagcagtgcctttttacatcctctccattgtatcaccaagcatgcagaaggcattcagataatgctttagccatggctggtactgccacctaatggtgacagaagagatggatctataatccagtttgtatgattattgaaatgcagtaactttagagaactagttagctgttaaaaggtaaaggggcaaacttaacattctttccctaaagttatctggtaatttacattgctgtttttgtctttgaagaacattttccaaaggttaatatattcctggttgtttttagtaccttttttggctgatctagcacacatatatgtttcctttttagcatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagagtacgtacatattttacctctgctgctgcttttttctaatattctcttttaaggaggcaactatttttagattgttgtggttgggttaatgccttccttattaaaagttatcatttggggggtagcttgctttaaagactagcagtaatgtttattgatcactggaagaaagtttatatggcaaaaaaaagaggttcatagattaatcatggagtaaggagttaaagtaacttttaaacttttcttctttggaaatagctacatgcattccagcacacattaatgctccaaggggcaaatgttctccttgtcataaccaaagcagagacttgttagggtgcagtgctcatctgtgaatcctgtgttgtaaaataatttaaaattccacagactccataaagtttaaacttattaactttttcgaaatagtagcaaagcatagttttatagtatcagtatatatatatgtaattagataacagaaatacaaataaaatcccattctaacgagttcagtgggatgttgcagttgtatccaaagtagcagcattttgctgttttacagaagggtgcctaaattgtatagtaatgagcaaaggaagaagctaatgttctctgtgtgacaggagtaatgaattagggtcattgtgcaaaggaagatgatacggcttttcttgagtcatgaagtgatccctagcccccgtgccttgctgctctgtaaatgtacttcagagttgtgttctgatgcgcttactgttttgaggcctgcaaggtctcccttgaagagtgaagtcattcatggtcatttaaaacaggtgtagacttctcaaaatcatgagtttatgaatcactaaagtcatcattggtgagcaaattgccaccatccctaataaaagtaaaatttggatcttttgaagttggcactgctaaataagaagcttccctgtagggagaaccagctaggccctgaggtgcccagactgacacccctccaacctctgcttcatccctttgggaggccttggacaactgacagcttccagattgtcccatagcattctaggtgctcagtaaatgattagtggaatgtttcaaccagaccttattcagaattaagaattgaagttaacaaagtaagctgaaagtaatgtgaaactagatgatctagtttataaaatgaattaagtttgttttaacagagatgccttttgtaatcccagtctactagaagtatcctcacgacatctagattgctgaacatttgttcccagtagaaagccaggagaggatcaaccttctgggtttgttttctttctcaagatggtctccttgaatgataatggcctgagaccatgcttgctgatgactcagggcatggctttgtcaggaggacagcatcagacacacaggaatcattgatgagatgagcttacgtagtgtagcaggaggtttcataccagtatagttcccagttaggacgcaacaatacttgtcttttgagaggaatatttagattttacgtgcattcacgtggaaactgtgtataaattcagaatgccaaaaaattatctcacaaaatgtataaatatgtgagtttattcagttctgtcagctacatacacgaaaggagtcttaaaatagggctctcccagtgtgtgccttttggggagcagatgggttgtgagatacagtgaggctcagtggggccctcatggaaacacggagagtgtgacctgatatagttttgtgaagaacagttaattattatgcttctgcagttcttattatatacattaaattatttgttcatataaatattaataattagatttaagggtttctgtctgtttcatattttaagggtagcaaagggtacttttgtttcatttaattctttggtaatttatttattttctaaattgccccagtacagtaataagatatctgattgctgaagttattttatttaaaagttcattttaataccctcaaataagattaaagtaaaaggcagatgtatacagacttggtgttaatctcaaagtcttcaccccttgttcccagcaacagagggaggaagttccattgcatacttacgtgaagtttaaatttatcactatttcttaaccttagataattggattaaagcctgaaggagtgccaaggatagattgtgtttcaaaggttagtattcaaaaagtaactcctgttaaatctttgatgtttcttaaaatactttaaaagtctaatgatttagtcatcttttttttcttccctgtcacattttaaagtcctttgtagtgccttagaataaaattccaccaaccgtagtctttctcttccttaatgataattcagaaagacattttccatgtgtatttgattttgcacacattgcctttattttcacatataccgtatttcatcaattctaagattcactttttttctgccagctcagtaacactgaaattgggattacccttgtaattgatggtgtcttaatactgtatcatgacatttttctctttcttaatagttagttggcgtgctagtcatcagtgctatctgagatttaatgaaatatggtgcattttccttaaggtagaagcattatttatctcccctatccctacttacttttttttccagaatactgtgcagttttcatctcataactttcttttgttttctctccatgctgcaaatgccactaagacaaataatgtaaaagatgggtaagagttctgaggagacattaagttctaaatttatcattgtgctaaatattaacatttcaactctgattgtatggcagaaatattttacttagaatgttacattgaaatcacttttaaagttgtgaaaaaaaattctttttactgttaatggacttcttatttgggcagaaacttcttgctcagtggtcttcaaacttgatcactcatcagagtcatgttgccttgttgggttccgttcccatagtttctgactcagtaggtctgagatagggtccaaaatttgcatttttttctttttttttcttttagacggagtctcactctgtcgcctgggctggagtgcagtggcacgatctcactgcaagctccgcctcccgggttcacgcggttctcctgcctcagcctcctgagtagctgggactacaggcgctcccggctaattttttttttttttttttggagagacagggtttcatcatgttagccaggatggtcttgatctcctgacctcgtgatccgcccgcctcagcctcccaaagtgctgggattacaggcgtgagccaccgcgcccagctgagcttttcttgataaattcttctaaaaatctagtgggcagcatatactgtcagctctcaagtcagaacactatagctacaagatacatttagaaaaaatgttgggtaaccctttgtgatcctcagggcttgctcacaaagctttctggtagaaagttcttggggcttgggtgctaggcttcagctgggtagaagtgctaatttcatgacagtgcgcctgtatacaggagcctgtgagcaggctgcatagataagcttggatggagtgctgggtctacaaagccaataccacctgaagggaaaacacattcaagccagaagcgcaaaagctttaaattgtgtaaacctttggtcagtataaacaattccatatacctctccctttttttttttttgagacggagtctctctctgttgcccaggctggagtgcagtggtgcgatctcagctcacctttgcctcccgggttcaagcgattctcctgcctcagcctcccaagtagctgggactacaggcacgtgctatcacacccggttaattttttgtattttagtagagatggggttttaccatgttggccaggatggtctcgattccctgacctcgtgattcgtcttcctcagcctcccaaagtactggggtaacaggcgtgagccactgcactcggcccccttaaggttttaaatgcatttttcttcttgtttatctattacgtatcctttgcttctagaatagttgggggaaatgttaatgaaaaacccagatttaatgattcggatttcagttagctttcccttttgctttggagagaggtgtgtgaagtacataaaataatcaaagcaggtggagttttaattttgtttatttagttgtggattttttgtttgtttttagaaaagcacaaaagtggaagaaatgtttgtaaaatttggcatttattccctaggctagtcacaagtagtaaaccagttagaacccataaattttagaagtgtggctctccagaacagatggaagcatttactacatatcataattgcaattttctattagatttgtctatgtcaagcgttctttaaattctttagttcttttatgtaatacatatgtcttttattttgtcttgtattgattttgttctgccttgattgtttttatacaagttagagtcctgaaaatacaaacacttaacatacccttggaggtgctttttttttttctctctctctccatagagacagggtgtcaccatgttgccaggctggtcttaaactcctggcctcaagcaatccacccacctccgcctttgaaaatgctggaattacaggtgtgaaccaccgcagatggccaaggtggccttttatattatcaacttaaaagatgatcctgcaaaagatgtaattttcatatttatgtcatttttttctcagtgttttattttcttatgaaaatgaatcatactaagaaaatcaaaaaatgggaagaaacaaaatgcattaatttttaaactccattttgtttcagtggaacttagtgaccatcagtaggttcttagagttagttgctcatagtttacaatatgatgctattgccggacgcggtggctttcacctgtaattccagcactttgggaggccaaggtaggcggatcaccagaggtcaggaattcgagaccagcctggctaacatggtgaaaccccatctctactaaaaataaaaaaatgagcctgacgtggtggcatgtgcctgtaatcccagctactcgggaggcttaggcaagagaatcgcttgtacccaggaggcagaggttgtagtgagccatgatcgcgccactccactccatcctaggcaacagagcaactctgtctcaaaaagaaaaaaaaatatgctattcgtatacttagaaaattatgacatacatgcttcaccctgagtacctcattattattcagatactcattttaatattttacaatttctaaatgtttattttcacagaaggtataaattaaaagattaagaaaaatcctgccaagatcacggcttaggcacacacagagagcagttgagcgtctgccacacctgatggtcttgagccgtgatggccttaactctgagccccagtgccctgctccgtaattgatgctgtccactaaggcttgttaggcctaaaggagggaagtgtaagctaagtgtggtatctggtaggaaacccactctgggttgggtgtggtggatcacttgaggtaaggagtttgagaccagcctggccaacatgacaaaactccgtctctactaaagatacaaaaatcagccctgcatggtggcgcacacttgtaatcccagctattcaggaggctgagacaggagaatcgcttgaacccgggaggaggaggctgcagtgagccaagatcaggccattgcactctggcttaggcaacagagtgagactctgtctcaaaaaaaagaaaaaagaaaaaagaaacatactccaagatactcagtaaactgtttctcaaaaaaaatcctttttttcattttgcggaaatgtgttctgtgaaggtcatatattaaggtaaaataggttcaacaaaagcaattaatgcagaaaagcactgatatcagagtgactagtttttctctaatataaaatgttatctttgattttaagcttattttttaagttaaagagtacaaatgtagggtggagtttgagtagtgattgaaaatggcttttgcgatttctcctagcgttgttacttcctaccctttccacatattcatcatctggatcattagagcttgtctggtgggtggggcgcatcatcactctgtcctttgtgctgtctggccggtgcctttcatctgtctctcaccccaccccacagccatatgctgcttcataatgaaatgaaatgagcagaatctagaactccttagagtggattcttagttttgctttatgctgtttcatgcatgctttcaaccctgtctcaaaaaaatttttttatatatatataaaattcaagtatttaataatgttttattttaactagtgttccgtaagcccagcactgattttaatcattgtggtctgtttgctacttctcagtctgtgttaaagttacactcattagaattaggcccatttagaaagtgttacatgtgaattttcataaattgcttatttatcatgaataatactagaaataactaatagcatgaattaattggattacaggtgatgcttgatttgtatgttgataaacatggaattctagtagacaagtaatacttaatgatttatatatgctcataaatttattcctgatacagtatttaaatttgtcgaggagagttttgcttgtagtaccttaaattttccttcatgcttcccctctggttgcagttctggttattaatcacatgaaactcacacctgctgtctcccaggcctgagtgctgcattctaggttggcaccttgtggtggctgttgctttccagtctggaagcacagcattttattcatttcaggaaaacatcggtcctaaacctgctggtgcattcctgctgttagtaggtagaaaggctggcatttggtatttggagggcagataagattttacaggagtacatgagttaaagaagggactctcatgaaagagagtatagagtgtatctggaagtgtaagtatcaggatagttcatgtggaaggggttagttagataatatttgcaatcaagatgagcaagcttcttctcagaaatacacttgtaatgataatatagttggagcagcattgtagtttctgcaaactgttcatgattgatattcctttaattataaacatagtttttacaaattctttttgtgacctaaagaggatttcttttgttttcaacttcagaatgaagatataccaaatgtagcagtttatcctcataatggaatgatagacttaaaatatttcccatattatgggaaaaaactgcatgtaagtattgagaagttcttatgtggtgattactcttttgggaagctggagcatgtgttgacgtaccacttgtctggggtaggtagacgccagccctgtttaatttgtgcgtcatctattcaggttttgttttattttaatggtgatggtaaatggagttcccacatttacaattcagaacacagaacccaagcagatacgttaaagttagatgattatttctaaaatatcattttctttttcattatagaggtagtagtaggtgcttatgtagagaaagtagaaaagtacttaaaaagaaaatcaaggccgggtgcggtggcttactcctgtaatcacagcactttgagaggccaaggcgggcgcattacctgaggtcaggagtttgagaccagcctggccaacttggcgaaaccccctctctactaaaaatacaaaaattagctgggcgtggtgacatgtgcctgtagtcccagctactcgggaggctgaggcaggagaatcgcttgaacccaggaggtggaggttgcagtgagccaagattgtaccaccacactccaggttgggtgacagaatgggattctgtttcccccaccaaaaaaataaatgaaaagaaaatcaaggccaggcgcggtggctcacctgtaatcccagcactttgggaggccgagtcgggcagatcacgaggtcaggagatcaagaccatcctggctaacacggtgaaaccccgtctctactaaaaattacaaaaaattagctgggcgtggtggcaggcacctgtagtcccagctgctcgagagggtgaggcaggagactggcatgaacctgggagtcggaggttacagtgagccgagattgtgccactgcactccagcctgggcaacagagcgagactctgtctcaaaaaagaaaaaaaatcaaaagctcattgcggccgggtgtggtggctcacgcctgcaatcgcagcattttgggaggccgaggcgggcagatcacctgaggtcaggagttctagaccagcctgactagcatagtgaaaccccgtctctgctgaaaatacaaaaattagccgggcatagtggtgggtgcatgtaatcccagctactcgggagactgaggcaggagaatcgcttcaacctgggaggcagagattgcagtgagccaagactgcaccattgcactccagcctgggcaacaaagcaagactctatctcaaaaaaaaaaaaaataggttagtggactaatgagttatcataggagtgggactagcggctttataagaagaggaagagagacctgagctagcaggttagcatgctcagccccctggccacgtgatgccttgcaccacctcaggactctgttgaaagtacccagcagcaaagaaggttctcaccagatgcagctccttgatcttggccttctcagcctccattaactgtaagaaataaattcctttctttataaattacccagtttcaagtattgtgttataagcaacagaaaacaaagacagtagtacagttaacaaaggaagttaacatatagtgctcttatgaatctgtagactttgttgaaaatccatcaattgttccagtaatactctttatagtgaaagacaagtgttttcctgatcccagatgtcacactgttaacacgtttagcaacctataatcaggaatatttcctcagtctgtttcatggctttgtactcttcaaaaataagtacgggccttttatggctgattttatgttcattagttggagtttggtggtttttcatgattaaatataggttgtgcattttggcatgagtgcctcaaaagaaatgttgagttctcagagtgtcaggagggacatggtatcatttcattccgttaatggtgatactgccttgattccttggttaaggtggtatgagcgaggtttctacaatatactttttttcctctgtcatcaataagtatcatgtggggagaaaattaaaaagctcgttactgcctggcactgtggctcacgcctgtaatcccagcactttgggaggctgagacaggcggatcacctgaggtggagagttcgagaccagcctgaccaacatggtgaaacgctgtctctactaaaaatacaaaaattagctgaccgtggtggcacactcctgtaatcccagctacccaggaggctgaggcaggagaatcacttgaaccaggaaggcagaggttgcagtgagccgagattgcaccattgcactccagcctggcaacagaatgcaatgtctcaaaaaaaaaaaaaaaaggccaggtgcagtggctcacgcctgtaatcccagcactttgggaggccgaggtaggtggatcatctggggtcaggagttcgagaccagcctggccaacttcagtagcaatggcaaagccctgtctctactaaaaataaaaaaattagctgggtatggtggtgggcacccgtgactccagctacatgggaggctgaggcaggggaatcgcttgaacctgggaggtggaggttgcaatgagctgagatggtgccactgcattccaacctgggcaacatactccatttcaaaaaagaatattaaaaaataatgataagggtcgggtgtggcggctcatgcctatatattcccaagcactttgggaggccaaggtggacagatcacgaggtcaggagatcgagactatcctggccaacatggtgaaaccccgtctattaaaaatacaaaagttagctgggcgtggtagcgggtgcctgtaatcccacctacttgggaggctgaggcaggagaatcacttgaacccgggagtcagaggttgcagtgagccgggatcgtgccactgcactccagcctgggcaacagagcaagactctgcctcacaaaaaaattaataataataatgataataggccgggtgtggtggctcacacctgtaatcctagcattctgggaggacaaggcaagaggatcacttgagctcaggggcatgagctgtcacacccagtcaacatttttatcagtaattacaggtatggacttacagctccaaaaaattaaaaagaatgcagagaacagaaaataatagagctaaattttttttttaatttacaagccacgtatggtggctcacacctgtaatcccagcactttgggagggtgaggtggaagggccatttgaagcgaggagtttgagattagcctgggcagggagaccctgtctctacaaaaaaatttaaaaattagtgggctgtggcggcatgtgcctatagtcccagctacttaggaaactgaggtgggaggattggttgaggcttcaatgagccataattgcaccactgcactgcagcctgggcaacagtctcaaaaagaaaatttacagaataagccaattcctggtagagagaagtattaagtttccatagagtttgaattaatatattttccttttattgccaggttgggtatctacagccattggttgctgttcaggtcagctttgctcctaacaacactggggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctgttgtttattgttacttttctccttttttaaaaaaaaaaaaaggcagccgggcgcagtggctcacgcctgtagtcccagcactttgggaggccgaggcgggcggatcacaaggtcaagagatcgagaccatcctggccaacatggtggaatcccgtctctactaaaaatataaaaattagctgggcgtagtggtgcgtgcctgtagtcccagttactcgggaggctgaggcagaagaatcgcttgaacccaggaggcggaggttgcagtgagtcgagatcacaccactgcactccagcctggtgacagagcgagactctgtctgcaaaaaaaaaaaaaaaaaaacggcaaagcagatattcttgaggttttctttgtggtggtgcaagccagaaggggtgggacccaacccagctggctcaagaatggccgtttggagtaaacgtgagggctctgggtggccttgcctggccagatgggccttggtggcctggcggcagcctctgccctttagtagtgggcactcagccccacgtcagagctctgcttgttcctctgtcactaaaatcatagtgataagagattttcactgaaggaaattattggagtaattacagcaaaccttttctgggttttgattttcttctttatgctatctcttaagagtgtaaaacaaggataaaagaatgctacgatgtgagagaggtgacatgactttagttgggccagtgtgacctcatcctcaacagctgtaaactttggtgcctgtgaaattcatattaagtattctattaaattgtatttttgagtcttttgaagtaaatatggatggaatttctgttttaacgagcttagataaaagactcattctcaatacacaagaagaattgagatggcatccaacatagggtgggtgttggagacaaataaaaatggcacacacatgtaagtcactaaagcatcttgtatgcctccctggttcagaagtttggacgtggatcagcacctgactgcccagtgatcttagctgatctccccaacttctcctggctctgcttgcttcatctatcgaaattaaggcagtttaacaacaatttagcagacctgctatataccggactggatcagccagactttgaggatacagagatgaaaagacatggtttctcaaagatcttaaactaggagggaacaggctctgagacacagcacgtggcatgatgatggtgatggcgctgacatgcaagaggccatgaggtggggtaagactagattattccaaaggtcccacccttccctaaagtttatttttgtgaaagatctcaagagataggtggtgcttgatggaggaggaagagtggctggtagttgggcctgtatgggccaggtaaggactggactcggaacgaaggatgcctggacacagctggagtccgcctttctgctgctgacttcaggttttcctcagcatttcaggatgtgcttacagatcacctgggta

SEQ ID NO: 13023 - DNA, 13948 bp, Human
aagtacacgggaaacggtagtcctctctatccattacaacttgtactctcagcgggaagaatggtgttcagcctgtcccccacccaccatgatgtccagctcagttttgccttttaccaagtttaccaggcacaactaaaggattccctatctggctttaaatgtcctccatactctaagcctcttaactgactgacagtttcctccacagcccctcaacacagtcctgcctccttactggctcccagatatgccttgctcgttcctactctgtgccttcactcacactgttcctcctccctggaatgctaacccggtccttccccttccagctcctacctgtcttttacttctccactcaaacctcacttcctctaggaagccttccctgattacttcagtttattctcatcattcccttctctggactctctcaggaatcaaagttagtgaatacgcactgatatttttcacaacaatttattgggtcttggtcccctctcctccagaagttcggcagggcatgatagctcacacctgtaatcccagtgctttgggaggctgaggcgggcagatcacttgaggtcaggagttcgagaccagcctggccaacgtggtgaaaccccatctctactaaaaatacaaaaattagctaggcgcctgtaatcccagctactcgtgaggctgaggcagaagaatcgcttgaacccgggaggcggaggttgcagtgagccaagattgcgccactgcactctagcctgggtgacagagtgagactgagtctcaaaaaaaagaagttgataaatctcttatgaacagttgggatgttttcacctcctttgccacctgcacccagcacgtagccctatgctgggttcctagtaggtgtccaatactcatggattgatgtatccatatgcccaggtttggctaagggaagctgaggccctggctccctttctagcagtgagctcaagctggagtgaagaacagaaggcagggggccagtttctctgctaacttcccttgtttctccactgccattcaggccacagaacacagcagggtcttcaggtaagccgtcagtggtgcagaccttgaaactagactgatccctcagttaatggttgacagtctctgtttaccttaatgattgccaagattcattactgaacatgatacactttgcagttcaactgccttggccttgagggtagaaagcaatttctgaggttttagggttctgggataggattagaaatacttgggtccatccccagccactcaggatgtggacaataagcaagtggccggagggcaccctggtactgccatatgggtgggaagcactgccagctcccaccttgacctcaggtgccagcaggcatcacccatggctttttcctccccattgtcatctaatgtgtttatttatttatactttttgtagagatggggtcttactatgttgcccaggctggtctcaaactcctggcttcaagtgatcctcccgccttggccaaagtgctgggattacaggcatgagccaccatgcccggccctgtcatacagttttagaggctgggagctagaagggttgaccaggatggcagcctgtacaggatccctctctgcagcttgcccgcactgtggatctgcctaaggccagggcatgggggaagcctgagggatgctgaggagcacaggtccagctcagtctcccagagagactaaacatgggtgggtgacaatgatgcctctcttcctctgggacaaggcagtgactccaggctatgtgatctgtctctccaaacccatagggagctcagaggatcaatcttgtttaatgattgtatgtgggaggaggtggggctggttaatgtttgtctggttcctcttgggctgtgggccatttctggctctggccctgggttcgttgtccctcccctgggctgggctgacagtacctggtggcatagggcagacacgcctgcagacattctctgggaaagggcagcagcagccaggtgtggcagtgacagggaggtgaggagactgggggctgagggaggtgggccagggagggctgatgtggcacagtgggccggaaataggggccgggtcttgccttctactgacctccgccttcagccacttaggtcccttccatgcttccctctgaagctggggtgaggcccctcctgccaggtgccagacttgcttagcctctctctgcagcctctttccaggttcaacattgcttttcctctcactttttttcctctggccaaagattccccttattcccatagggccagattctcaggaagacttgagggaccccctaggtgcaaggtggccaagtttgtctctctgagacatttcctgccacacagggttagggtttagtgggaatgttgggcactgccaggtgctgttttccttccttgattacaaggcaagccaggcatgcacccaacacggggctgcgagtggatgaataaagcgtgctcagcgggctgcagagggctagccaacagggccaaggatttgggagcgtgtgtttccactttcttgaaggaggcagactgactcaagctgaacttggagtaattgatggttcggagattttttttttttttttgagacggactttcactcttgttgccctggctggggtgcaatggcgcaatctcggctcactgcaacctctgcctcccgggttcaagcgattctcctgcctcagcctcccgagtagctgggattacaggcatgcaccaccatgcctggctaattttgtatttttagtagagacggggtttctccatgttggtcaggctggtctcaaactcccaacctcaggtgatctgcccgcttcggcctcccaaagtgctgggattacaggcatgagccaccacgcccggccggtttggagatctaaaggaggggtgttccccagctgtttgaaagttgttgcagctgttgggaatggcacagcagaatgtgtaaacttagaaaatgaaatgaggagaggagaatacagacaagaggggttttaatggagagaagtatagattagaatgcagcctggcaatggaaaagggacccaggcttgggtgaggggccaatacgattcctactctgagctccagcacttgcttaccacctgtgtagtaagttactcagcttctgttagccttcattgcctcacctgtgagttgaagacaatagctcctggctcacggggttgttgtgagcgtgagagtctgtgaatatacacacagggggcactccataaatggcagctgttataataacccaagcagagagcaacaggaagtcaggtgggtgatggaggagtaagggagtagcgtccaaacaatggggaagggagctggcataagcagaagctctctgaaaagaccgcagcagagagggggaaagaacaaatcggaatgagctagactggacctgacccaagcctggccacggaatatgtatggcagggtggagaggctaagtccagtgactgagatattgcagaactgcagggtggaggcaagagagagaagcaggggaaggggaagagagctggaggagtttggccttagccacaccaaactgatgaaggcagccagaaattcctaaggaaatctcaaagaaagccccatgtcccttcctgaccagtgactgcctgcgaaatgggggagggagcatggagtccgaggctgaatgtaacctcatccatcccagcccacccctcttccccaaaccccaaatcacaaggattttcctgtagttggaaggatagggaggaggtgggggcagaaacagagagagacagagacagactagacgaatgtgtgtgtgtgtgtgtgtgtgtgtgtgtgtgtgtgcgtgtgccagcacacgcaggaaagtgtataggtttttgaatagtaggcctggtctcagaatgcaaactccttaaaggaagagaggccgccataagcagcgccatatacaaagactttgaggtaagaaaataaacttggaacttgattctaccatttagcagcagtgcaattgccgttgaggcaagtttcttaacctctctgagcctcaacttccttgtctgaaaaatggggataatattacaggactgctgtaaggactaagtgagatcacctgattttgcactgtgcttgagtgctagggcaaatctaaatctggggacagggccagagcctgacaaggccagagaagtcctgtctaattaaacatgagagcaaaacacgcgtgcagcaacaccgaggatatcaatacggggactttaacccgaagtcacaaaaacagtttggatttcaaaatcaggtcactcccctggatgtttttagaatgaaatccttgaggcattgatattgacatagggatcagttctccttccaaaggtaacagcaaaaattgagatcacagcacccagacaagggtccttagaggccccacagggagctactggctatgtcccagaagactcaagaagaaaaaaggcggggagttacaagaacctagaaactcaggggtggccaggatgtctgtggcacacccctgaagggcagagaagagaacagctaaggtttgctttgcagtttgaggaagcagcccaagaaaggtaaggaaaggaaaagcagaccaaatcaagaggcagcagaaaatcctgggacagaaggagagggaaagagttgtcaattgctacaacaaaagtaccttagaaaaaaaagagctgggccaggcacagtggctcacgcctgtaatcccagcactttgggaggctgaggcagcaggattacctgaggtcaggacttcgagaccagcctggccaacatggtaaaacaccatctctactaaaaatgcaaaaattagccaggtgtggtgacacgcacctgtaatcccagctactcgggaggctgaggcaggagaatcatttgaacccaggaggcggaggttgcagtgagcagagagcgtgccactgtactccagcctgggtgacagagcaagactccatctcaaaaaaaaagaaaagaaagagttgtcaattgataggaaaggggagaaggggctaaaagaaaataagacatagcagttttgaatctccctgttccttttttttttttttttcaatctccctgttcctaaaaagtacccacagaaagaaaagttatacctgtagccaagtagagcttatgggaaagagtatgtgctctgcgagaatcacttgaacccgggaggcggaggttgcagtgagccgagatcgcgccactgcacttcagcctgggctacagagtgagaccctgtctcaaaagaaaaaaaaagtgtgtggccaggcacggtggctcacgcctgtaattccagcactttcggaggccgaggcgggcggatcacgaggtcaggagatcaagaccatcctggctaacacggtgaaaccccatctctactaaaaatacaaaaaaattagccgggcgtggttgcgggggcgcctgtagtcccagctactcaagagtctgaggcagaagaatggcgtgaacccagggggcggagcttgcagtgagccgagatcgcgccactgcactccagcctgggtgactgagctagactccgtctcaaaaaaaaaaaaaaagtgtgtgttctggagtcagcttgacctggttcaaatcccagctctatcacttactgactatgtgactcttagataagtcctttcacctttctttgcctctgtttgctcatctgtgatatgaggataaagcaacacttacctcaaaaagttcttttaaggattaaatgacagtgcatgtgcaggggcctggcatataacaggtactcagtaaatttttttttaataaaaatgctacaatgttgaggtggtcttattattattattattattattattattattattattttctgagacaggctggagtgcagttggcgcaattgaagctcactgcagcctcgacctcttggactcaagagatctgcctgccacagcctcttaagtagctaggactatgggtgaatggcaccagccaccatgcctggataatttttgtgtttctttttttgtagagatggggtctcactatgttgcctatggctggtcttgaactcctagactcaagcgatactcctacctctgcctccttttaattttttttttaagagacgggggtctccatatgttgcctaagaataacctggccaggggccaggcgcggtggctcacgcctataatcccagcacttagggaggctgaggcaggtggatcacgaggtcaggagatcgagaccatcctggctaacgtggtgaaaccccgtctctactaaaaatacaaaaaaaaattagccaggcgtggtggcgggcgcctgtagtcccagctactcgggaggctgaggcaggagaatggcgtgaacctgggaggcggagcttgcagtgagctgagatcgcgccactgcagtccagcctgggcgacagagcgagactccctctcaaaaaaaaaaaaaaaaaaaaaagaataacctggccaggttattcttttattattattattatttcttttattcttttttttttttaagaggcagagtctcgttctgtcgcccagcctggagtgcagtggtgggatctcagctcactacaacatctgcctcccgggttcaagcgattctcctgcctcagcctcctgagtagctggaactacaggcatgcgccaccacgcccagctaattgttgtatttttagtagagacatggtttcaccacgttggtcaggctggtctcgaactcctgacctcaggtaatccaccagcctctgcctcccaaagtgctgggattacaggcgtgagccactgtgcctggccttttttttttttttttttttttgagacagccggctaatttgagacacctggctaattttttgtatatttagtagagacggggtttcaccatgttagccaggatggtctcgatctcctgacctcgtgatccacctgcctctgcctcccaaagtgctgggattacaggcgtgagccactgtgcccggcctttttttttttttttaaatataatagagacgagggtcatgctatgttgcccatgatggtctcaaactcctgggctcaagcaatccacccacctcagcctcccaaagtgctgggattcgaggcgtgagccactgcgcctggcctaggttttgtttgtttgtttgtttgtttgtttgtttgtttgttcgtcttttccgagacggagtctcactctttcccccaggctggagtgcagtgacgggatctccactcactgcaacctctgcctcctgggttctaacaattctcctgcctcagcctcctgagtagctgggattacgggtgcccgccaccacacccagctaatttttgtatttttagtacagacggggtttcaccatgttggtcaggctggacttgaacccctcagtgatctgcccgcctaagcctcccaaagtgctgggattgcaggcgtgagcccctgcacccagccggttattcttaataattctctggccacctgttctagagtgtaacacatctcaccacctgaagcatttcttttctttctttgtttctttcctttttttttttttttttttttttttgagacagagtctcgctctgtcaccaggctggagtgcagtggcgcaatctcggctcactgcaatctccgcctcctgggttcaagcaattctcctgcctcagcctcccaagtagctgggattacaggtgcatgccactacacccagctaatttttgtaattttagtagagacgaggtttcaccatgttggcctcgatctgctgacctcgtgatccgcccgccttggcctcccaaagtgttgggattacaggcgtgagccaccttgcccagcccctgaagcatttctttatggctaactgtggtgcctagtgcagcagctttgcatatagaatcccaggcttgggagaaagggcacccatagccctgcttccccatgctggttggcacatgacatgaactcactaaggctttttatttatttatttatttatttatttatttatttatttagctaaatgaagaaaccttgttctgagaagtaacctatgtcctgtggactgtccttctttccccagattctttcatcccatttcccaacttttgcagttgctgttaccccacccctttcctctacagcatagaggaccacccagggctgaatatgaggcttcttccacaaccagttgctctgctgtggagcatgcactggggtcaggaaatgactccagggatcactgcacctcctatggtccagggctgcatgtcctcctcacattcagtttcctgctgctagtatgatctccttgcaacttaatggcagaagtggcaagaggtgggagaagccttcttagcctgcctaagggatagaggagaatttcctccctagagcaactggcaagctcctgaaaccacgaggttgcaatatgcacttggggttgggggctgggcagcaatggggtctcagacagaccctataggtcaacaacagcattggggactgctcaaggtggctcacacctgtaaacccaacactttgggaggcaaaagtgggaagatcgcttgagcccaggagttcaagaccagcctgggcaacatagcaagccccccatctctacaaaaaaaaaaaattgaaaaattagctgggcatggtgacacatacctgtggtcccagctaattgagaggctgaggtgggaggatcgctggagcccaggaggtcaaggctgcagtgagcagtgattgtgccactgcactctagccttagtgatatagccagaccttgtccccaccctctaataaaaaacaacccacagcattagggagaaaaaggagagatcttgggtttgacagaccatttattcccccaaagcaactttgttatcttttcctgagaagatttttttttttttttgagacggagtcttgctctgtcgcccggactggagtgcagtggtgcaatcttggcccactgcaacctctgcctcctgggttccagtgattctcccacccagcagctgggattacaggcatgcgccaccacacacggctaattttttgtatttttagtagagatggggtttcacattgttagccaggatggtcttgatctcctgacctcaagtgatctgcccacttcagcctcctaaagtgctgggattacaggcgtgagcaacggcgcccagccttttttttttttttttttttaatggttagcctttgctttctacagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtatggaacaacgctcagcacagtttgtggcttcataaatgagctctctttcctgtcctctttcctctccatattccggagaggatctaagcctcagggaaaatcctggtgaccttaagcttctgacggggccatgggggagggcctcagcccagagcctctgggtcccctggggtcccctcttcacatccacctgcctgtgttttatctccctccccccgcccccccatggccattcttctggtggggctatggggcgggtgcggcgatggaccgggcgggcacagaacaggtgggtgcaggctgggtgtccggcgctgggacacaagtgctctgtgtgtagggtgggcggaagtcagggcgtttgatctgaattctaaagggcgttgttcagagccccacaaaggtctcattgtgcagacactgggtataaagcagcatatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctgaagagacaagaaatgattgggaaatttctcctgccccagagagtggcacaattccctgggtacctcggtgagagcccctcccccgcacatctggagacctatctccttactccctccaaactcagcatcccctacaagctgatgtcccacagtccacctgttgggttgcacgatgaccctgacccctttcagctggacagagcccctaatttcatcctctttcccagtttccttctctcaggaatcaatgcttcccactccagagatgcctccacacaggtcaaacatttcatagcagcagtttcctcaccagcatcaccctcccctgtcagctgtggtaggaaatgccccaggctgagacttggaaaagctgcgctggagtcctgatgctgtcacttagtagcggggcattcccttccccgaacctcagcttccttatgagcaaacgagaactggcccagcacatctctcagctcccttcaacactctgtgcttctgggattcctgaaagatttccccaagtaacagtgcattatcttcccccagcctcacaggggtttccttagagtcactgcccccacaaatagcctctcagagtaaaagtttcccccatggcaagtttgcctcctcagcttccttacctccgaacaggagaaattatttgccactccctctcagagtatgtggactccatgtaggaagtgctggatatcagaaagggagagaaaatcagacacaatctcatgtgaattgttctcccttgagacagtttttcctctttggagagaaagcatggaagttttctttatttgagatttctcctttagaaaaaaaaaaaaggaagactggatgtggtggctcatgcctgtagtcccagcactttggaaggccaaggggagagaatcacttgagcccatgagtttgagaccagtctgagcaacatagagagaccccatctctacaaaaaaaataaaataaaacaattagtcaggtgtggtggcatgtgcctgtagtcccaagctatttcggatgctgaggtgggaggataactcgagcccaggaggaggttgaggctgcagtcagctgtgatcacgccactgcactccagcccgggccagagagtgagaccttgtcaagaaagaaacaaagaaagaaaaggaaggaaggaaggaagggagggagggagagagggagggagggagggaaggaaatgagacctttagaggccgaagcaagaggattgcatgaggccaggagttcaagactagcctggacagcatagcaagatcctatctctattttttttttttttgagacggagtctcgctctgtcacccaggctggagtacagtggcgcgatctcggctcactgcaagctccacctcccgggttcacgctgttctcctgcctcagcctcccgagtagctgggacaataggcgcccgccaccacgcccggctaatttttttttgtatttttagtagagacggggtttcactgtgttagccaggatggtctcaatctcctgacctcgtgatctgcccgcctcggcctcccaaagagctgggattacaggtgtgagcaaccgcgcccggcctcccatctctatttttaaaaaattgaaagaaagaaaggagagagtaagtattcctttccaccacacttagtaatccctgagagag

SEQ ID NO: 13024 - DNA, 21516 bp, Human
tccagcctgggtgacagagcaagactgtctctaagtaaataaatataaacagtacatacatagaaaatagaaacgcaagaaagtggtcataattgctatctctagagaatgaatgggggggagactttttttttgagacggagtctcactcattgcccaggctggagtgcagtggcgcaatcttggctcactgctagctccgcctcctgggttcacaccgttctcctgcctcagcctcccgagtagctgggactacaggcacccgccaccacgccggctaattttttttttgtatttttagtagagacggggtttcaccatgttagctaggatggtctcgatctcctaacctcgtgatcctcccgcctcggcctcccaaagtgctaggattacaggcgtgagccaccacacccggccaagacttttctctttatactgttgggtattgtttgatttttctttttttttctatgagtaagtattagttttcttcttcttctttttaattgagacggggtctcactctgtcacgcaggctggagtgcagtggcgcgatctccactcattgcagcctctgcttcccgagctcaagctatcctcccaccttaaccttaacctcctgagtaggtgggactacagggacactccaccacgacaggctaatttttgctttttttcggagatggagtttcgccatgttacccaggctggtctcgaactcctaggcttaagcgatcctcccgtctcggcctctcaaagtactgggattataggcatgagcactgcacctagccggaattaaaaattcaggttctcagttgcattagtcatatttcaatggccacttatagttagtagctgccatattgaacacagcagacataggacctttccatcattgcacacagttctattgaacagcccaagtctagatcattgtgtccccacataaggtggtgcccattgggataccctgcaaccctgagtgtgaattaattaatgggaattaacaacacatacttatcaattgatccttgtagtccttggttaaccacgggggcggggcgagttaggcattactgaaacaatgaaggttagttactgataggcctcctatggaatatacagtctgatctagaggcctacaatatatccatggcaatgatgacacctgttgaatctctcagtaaatcataggaacaatagtgatgtttggactgctaggttttctggttaccatggaaatgagggtgctggttacaattctgtgtaatcacgcagagcctaaggtatgatgcaccccctcctcccccaccccgtctgtaaccatgaccaaagagttgactatttcagttgcgtttcccgagtagccccagcaacaggagaagcatctagaaatatgattaagtatggggtgtcaggatgcaagccctaacaaggaagtgtgaaaaaagaaacatggcggggcatttttttcagtaggaaaaggccaaatctattccattgaatacaatgacattgttactcttgcttcttgcacaggcgcagtgcaggactgctccgagcacgcctacgcgcgcattttctccccttcctctccctctttccactttcctctccctttttctcctctcctttccccctcccaccacttggtctttcagtctttcagtcagttcgtttaggtctctcctttccgacccccacccccagctcctctccctttccttttccccctccccctttcctttcccgtctcacgcgccaggccgcttgcacatgcgcattaggtacaaagcctcgctctttgtccccatctgtcgttcacacgaactcaagcctttggcattcggcagccaatagaatctaagaaatggcggaaaaatgattccgcctcgggagctaaaccttgattggcagtttagctaaccaatcgagaacgccattttgtaccccttggcaggcaccgagctccgtcgtctcgtttccggcggtcgcgcgctcttttctcgggacgggagaggccgtgtagcgtcgccgttactccgaggagataccagtcggtagagggtgagttttgggacgtcttggttcttgtttgggagggtagtgggatttcttggaacaatcagcgaaggaagaggctagggcgaagctaggtttggagggtggatggcgcttccgaggccccttgaggccttgtctctgccgccacactgccttctcagcccacccgcggggggccacctttctcaactcgcttcgcttcgggctttccccattttcgttcctgccctgtttctttgtgcaactcatctccgaatcttacccgtgtcagtaagttgccggcctctgagccgccctgggcccgacggtgtggggtctattatgagagatcgctgaagtcgtggttggttagaggaggaggcgctttgtcgggcgctcctcctctcggccccgcgaggccattaattcagaatgggcaagtggggcccctcaagcgatatttctttgtcaaaactcttagctggaaagttcctctgcatatccagagcccgccgctttcgtagtcagatttctgtatgccctttttctaaagtcctaaccgcctagctccttgacgcatttatatagcatcactttttaaaatgaaacttaaatttatggatttcgcatcgagtattttattttccagtttgagaaactcttaccataacctgacacgtttctttgtgtttttaacagagaagtcgaggttagagggaactgggaggcactttgctgtctgcaatcgaagttgaggtaggtgtaaggaagggatagggttgccagacaaaacaccgggcacccagttgaattagaatttcacctacacaaccaattatttttaagtatatgttgcatagttttcaattaaatttcaaatttaattgtgggttgtgtattttatttgctaaatctggcaactctagtgggggggccctggttatatttatactgtgtccttgtccaccttccttgttattaaatgaaaagtcctaagaaactcttagagaaggaccttagttcattttacagctttcaggctggccatccaggcagccatctcagtcttgtaaatttataccagatttagatttcagatatgtgtgatgtagtgtttggtcctctacctaaacatttgtttaactgtagcatgcccagtggttagagtctttctcaaccagcaatacgtgttttctctcaaaattcttcatcaggattattagtctcagggacacaagtagacagtaatctttgctgctgatcttcgtgctgtgttctcttttcagaggcccagtatttaggcgacagtgaatttattactctgaagagggttctgcacatatttccaaattatattggtggtcatcagaagtaggtgataggaagaaatacttctcaaggtacttgctacttggtgggcactgttataggtgctttattatgatagtcttcactagtgcattccatcctgggcctctccggggccaggggaagagagatgtttaacacctggaacccaagtaggaaaagatttgattctgatgcccaccttgccccatccccaactatttccagggtggactttagattttgtatgttttaacttcctgcttttatatcttattttttaaaacactattttctttttttgttgtttttttttaaaggtatctcatttgccatgaaactgctacacctgctcatggcgtttaaaatccttacaactttttgagaaaacgacgttgcactatgtggcaagagtcacaggatagattctatttttaagaatttatcctatggaaataattaaatggaaataaagctgaaagccagaagacatttactgcagcgttataataggaaaagccaaaaacaaccacctaaatgtcttatagtagggagtagtttagtaaagtagtacatcctggtgaactttatatagtcattaaaaattacaattatgttgacattagcagaaatgaggaaactctgaatatacaagggtgcattatcagttactgaaatgataatgtatgtctaaataagcaagaatggaaaattgtgggaggaatatttaatcatggatatgtccaaagatttagctatgagcattgattataatggtgaaaaattagaaacgacccaggtgtccaacacaatagggacttggttgacaactgaatgctgtgtccgttaacgtaaaagatttaatgacatgaaagctgtttatgatacatcataaagtggaaaaaacaggttacaaaatagtatttatcatatctcatttcaaatacataaattaatgactagaaggatataccaacatgttaacagtgactatttttagtggcaggtctatggatttttatatttgtatttttatttattttggtttttctaaattttctataatacattttgtaataagtatctgattgtaatttctgtttaaaaatttttaaataaaattttaagttgtaatttctgataccttataacattaatgagaaacaaaattgattaaatgatataaatgtgaaaatttaaatcttggctgaaatgtcagatgttgtgaggtttaccatctgcctccttctccctatccactttgccttcctcccccatttttatttattttcccatagcacttacctcttaagtactatataatttacttatatatattgtctctcactagaagcaagttctgtaggcaagaatctgctttgttcactaatccactgtaaccatctagaatagtgcctagcaaatggtaggcattcactgaatattttttgaatgaaatcgtgaattgaaaaattatcagtaacctaaaagcaatgcagttgttttcatttttgcctaccttctgttcccttgtctatattcacatctttaaaattagaaaaaacctttccccgttagaatatcagacatactcgtgtttatgtggtcttcataatttttaaggctgtgaacattctgttgtatagatgtaccgtactttcatgaaaaccattcccctaattttggaaatttaagtcatttttattgttttcttaccataaaggccattacaatgaacactttcacgggtgtagtttttaattttaaaattattaggataaatttccaggagtagaatttccaaattaaagactatgaattaacatcttgatagctcttgttactttttttcttactaaacttttggatacagaatttggtaattgcattaatgttttcagttttggtgggatgtgacattaaacagattaggaatgtttttatacacttgaaagtattcccgtatactcatcatcaaaatcaatagttaccaagcctttgtcgcatttctttcatctgagaaatataattttctgtgtttataattattttttgagacagactctcactttgttgcccaggctggagtgcagcggcactgtcttggcctactgcaacctccgcctctcaggttcaagtgatgctcctgcctcagcctcctgagtagctgggattacagatgcccaccaccatgcccagctaatttttgtgttttcggtagagacgggttttcaccatgttggtcaggctggtcttgaactcctgacctcaagcaatccaccctcctcggcctcccaaagtgctgggattaccagtgtgagccaccacgcctggcctattcatttatttttgagaccaagtctcactctgccgcctaggctggagtgcaatggcagcatctctgctcactgcaatctcgtcctccttggttcaagcaattctcctgcctcagcctcccaagtagctgggactacaggtgcaagctaccacacccggctaatttttttgtatttttagtagagacagggtttcaccatgttggccaggctggtctcgaactcctgacctcaggtgatctggcctgccttagtcccccaaagtgctgggattacaggcatgaaccactgcacccagcctatttttttctctattttttttgagacagggtctcattctgttgcctaggctggagtgcagtgttatgatttgcctcactgtaacctcctcttcgtgggttcaagtgattctccagcctcagcctcccaagtagctgggactacaggcatgagccactgcacctggcctcccctcccccctacccttttttttttttttttttttaaataaagaccgagtcttgctatgttgcccaggctggtctcaaactcctggggtcaagccatcttcctgcctcagcctcccaaagtgctgagattacaggcctgagccaccatgctggcttcatttttttttttttttttttatttcaacgtttgggagcacagagcacttgttttctttttaatcttatgttgatttttaaatgatagaatttaacattttattatttttatctttttttttttttttttttttcttgagacagggtctcattctccctgcccaggctggaatacaatggcgtgatcacagctcactgcagcctcagcctctcaagtagctgggactacatgagtgtgctatcatgcctgtctaatttttttaatacatattttttgtagaggtggggctcactatgttgcccaggctggtctctaactactgggcccaagcagtcctcctgcctagacctcccagattgctgggattacagatgtgagccactgtgcccagcctatttatcttttcttttttttttgagatggagtttcactcttgtgcaatggcacaatctcggctcacggcaacctccgcctcccaggttcaagtgattctcctggctcagcctcctgagtaactgggattacaggcatgtgccaccacaccccgctaatttttgtatttttagtagagatggggtttcaccatgttggtcaggctgttcttgcactcctgacctcagctaatccactggcctcagcctcctgaagtgctgggattacaggcatgagccatctcgcctggcctatctttttatgtttgcttttattgctttagtagtcatttgtctttccactgtaattaataaatatttagagtgtgtactgtatgccagtagtgagccagcattttcacatgtttattctcatagccactttgagagacaggtatttttatcatcccctttagaacagctgaagaaacaggtacagagtaatttactagtaagtagtacacaattgaggaacacaattcaaacctaaggatgcctaacctcacagcccatactagtaccactgttatttccacggtatgtactgtgggctaggattggtaggtaccagagaagataagactttactagtctttgtccttgtgataaccagaatctatttcgatcattttgtttttaaaatatgcttaaatgtgtgatggggcgagtttttaagagtagattttttggaaaagtagttttctattaatgtgtagtattgaactgggaagttccttaagcgattctagtgcaaacagttctcatccagtactcatttagtttttatgtgcagtataactgctgatgcctcgttgtttttaattttattattttttaaattttttaaaattttttattttattttattttcgagacagagtctagctctgttgcccaggctagagtgcagtggcgcaatctcggctcactgccagctccgcctcctgagttcacgccattctcttgcctcagcctcccgaatagccaggactacaggcgcctgccaccacgcccggctaattttttgtatttttagtagagacggggtttcaccatgttaggcaggatggtcttgatctcctgacctcgtgatctgcctgcctcagcctcccaaagtgctgggattacaggtgtgagccactgtgcctggccagatttttatttttattttttatttttttgagatagagtctttcttggttgcccaggctggagtgcagtggcacagtcatggcttattacagcctctaactcgtgggctcaagtgaacctccagctccagcctcctgagtagctgggactacggcaccactatgcctgggtagtgtttttttgttttgttttgttttttggagacggagtctcactctgtcaccaggctggagtacagtggcacgatctcagctcactgcaacctccacctcccaggttcaagccattcccctgtctcagcctcccaagtagctgggattacaggcgcccgctaccattcctgggtagttgtatttttagtatagatgtggtttcaccatgttggccaggcttgtctcgaacccctgacctggtgatccacccaccttggcctcccaaagtgctaggattacagtcttgagccacacgcccaacctgcctgggtcatttttaaatgttgttgtagagatgggggtctcacggtgttgtctaggctggtcttgaactcctgggctcaagtgatcctcccacctcagcctcccgagtacctagaaccacaggcgtgcgccaccacacccagctaatttttgtatttttttggtagaggtgaggtttcaccatgttgcccaggctggtctcaaactcctggactccagcagtcctcccacctccgcctcccaaagtgttgggattacaggcgtgagccactgcacccagcctttttatttattttttctttatttttttccttttttgtttgatttttactatattttgtaacctccagaacgcaagattttttttaacatagtttccatatgcagcactgatagatttttgaattgttcttctttgtcatggttgttcaaagtaacaaattgtttgcctctgacaaaagccagagcacttaaggtgatgaattacatataagtcatcaggaaggtggctgattgtgttattagtactgaatttatttattagtctactttttctttgtagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaagtgtgtatatgctaggtgatggagtagaaatggattccctctgggaatggtttcttggtttttagattagtttctcgggcttataagggaataggcctttatggcacacctttgttcttttttctctttacctcttaatacttacgatggaaaaggctgattctccggaaccaaggagcaaacatgtatgacagcagttgagtacaggttgctctgctgtgttgacacattctactgttaaacagatgtctgcatgttttacctcagcttggttcttagaggtagtcatcagatgactggtagttaaaaataatatagaaaagtctttaaggcttaaatggagaagtctggtactgaatactgtacttttagccttgagcctgtaccagctcattgtaaaaagtctttaagtatatgttcctgtttgagtaccaattgtgtgcctctaagactagaaccaatcccaactttgtttatttccagagattactataaagagttgctctttcctaactcatttcattctgttgcccccagcctgaaagaatgggaactgttaaggttatgaaaattggtgagagattaggaaaatggaacagttactttgttttttgtttttttttttgtttgtttattctcatctgaaggtacgttttgaatgttaaaatctgatgccttgtaacatagggctgcttccttgaattgcttaatttttctctttggccggtaacgcctatatttttctttctcttgcttagtccagcttggcttctggcccgtcgtagagctgttcagatgtcctctgcatactgctttcacattctaaggcacaatttactcataagtggttaggttgccttgggaaatggtgtttacattctctacaacaattaatgtttcctcatttatcagtggttataggtctttgaggatacgactataattctatttccccagtcttttaagtgactgtgtgtcttctctcagatgaaggcttgactattgacctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggataaaggatttggctttatccgcttggtgagcaactgttggcttttgaggcatgtgctctaaaggtggggaagctggagaataatagatgtgcaaaaataggcagtggaaataattctcagatgatgtgttccttgaaagcttgatgaaacagaaccacaaaaatggcacattttaatttttcctcataagttttgtttcaaggataacaagttttttgcctaggatactggagctaaagtatgccctttggaactttttttttttttgagacggagtatcactcttgtggcccaggctggcgtgcagtggcatggtctcggctcactgcaacctccacctcccgggttcaagtgattctcctgcctcagcctcctgagtagctgggattacaggtgtctgtcaccacacccggctaatttttgtatttttggtagagacggggtttcactgttttggccaggctggtctcgagctcctgacctcaggagatccacccaccttggcctcccaaagtattggggttacagatgtgagccactgcacctggctggaacttttttgttttaattaggaaatttcaaacatatagaagtagacagaataataatgaacctgcacatatgcattgcatagcttcagtaattatcaagttgtggttaattttgttttatctgtaccctttccctattttgtccccccatgatcaagagatgggtatctcaccatgttgccttggctagacttgaattcctgagcttaagcaattctctgtcctcagcctcctgagtagctgggacaaaggcaacgcaccacggtgcctggtttatttgtatctttaaaaaactattttaaattgaattaaccaggcatggtatacgtctgtagtctaactactcaactaggctaagctgatagggctgattgagcctaggagtttgaggttacagtgagctatgctcatagcactgcacttcagcctgggtgatagagtgagacccagtctcttaaaaaaaaactaatgatggtaaaacatacataacataaaatttactatcttaaccgtttgtaagtgtagacattattttaaaatctggttcgatttagggaaagtatatgagaggaaaacatttctagacattatctacctccataaatggaagagaataatgtgacagcaggatcactggatggggtggtcagaactgattttcattccaatctgccaagtcatttttctctgggtatcaggtttctctttagtaatatgaaagggatcctgtcaaggttcctggttccaaagaggcttcttggaggatattcgtgattctggtacatacctagcaaaaattagactgagcatggtggctcatgcctgtaatcccagcactttttgggaggccaaggtgggcggatcacttgaggtcaggagtttgagaccagcctggccaacatggttaaaccccgtctctattaaaactacaaaaattagctggacatggtggtaagcgcctgtaatcccacctgctcaggaggctgaggcaggagaatcgcctgaacctgggaagcagaggttgcagtgagctgagattgctccactgcactccagtctgggcaacacagcaagactccgtctcgaaaaaaaaaactaaaatattctaggtggttttagggtggtctttgagtttttgttttcgtttttttgagacggagttttgctttgttgcccatgctggagtgcggtggcgtgatcttggctcactgcaacctccgcctcccgggttcaggcagttctcctgcctcagcctctggagtagctggaactaccagtgcgtgccactgcgcctggctaattttttgtattttagtagagaccaggtttcaccctgttggccaggatgatctcgatctcctgacctcgttatccacccgcctcggcctcccaaaattctgggattacaggcgtgagccaccgtacccggccaatggtctttgttttctggatgatctgttgtcattgggagaataatacctatgaaattgatgatcacctaagtgttattgacttctagaactacatgtgatttattgcaaggccatcagaaagcaaactagggtggccaaagagctgaagcacacagttaagttctttcacttctgtttctttgtatggttgtttagtttttccggggagatattgaactatactgctttagactgttgatggctgctaaggtgttctttgtcaaactgagttattctgattttcctctgcttcctaggaaacccgaaccctagcggagattgccaaagtggagctggacaatatgccactccgtggaaagcagctgcgtgtgcgctttgcctgccatagtgcatcccttacagttcgaaaccttcctcagtatgtgtccaacgaactgctggaagaagccttttctgtgtttggccaggtagagagggctgtagtcattgtggatgatcgaggaaggccctcaggaaaaggcattgttgagttctcagggaagccagctgctcggaaagctctggacagatgcagtgaaggctccttcctgctaaccacgtaagtgagggtcattttcagacgtagaccttagattgctaattccttccatggtctggagagttagcctctagtaaccacttttctatgtttaaagacttttggtcagcctggcatggtggctgactcctgtaatcccagcactttgggaggccggggcaggcggatcacctgaggtcaggagttggagaccagcctgaccaacatggtgaaaccctgtctctactaaaaatacaaaaaattagccaaacatggtggcgtgtgcctgtattcccagctacttgggaggctgaggcaggagaatcgcttgaacccaggaggcagaggttgcagcgagctgagatcacgccactgcactccagcctgggcaacagagtgaaactgcctcaaaaaaataaataaaagactgggcaaaacagcggctcacgcctgtaatcccagcaatttgggaggccgaggcgggcagatcatgagttgaggagatcaagaccatcctggccaacatgctgaaagcccgtctctactaaaaatacaaataaataaaataaaaataccaaaattagcgcacatgtagtcccagcaacttgggaggctgaggcaggagaatcacttgaacctggaaggcagaggttgcagtgagccgagattgtgccattgcactccagcctggcgatagagcaagactctgtctcaaaaaaaaaaaaaaaaaaaagacttttggcccaggcgggacagatcaccaggtcaggagatcgagaccatcctggctaacacggtgaaaccccgtctctactaaaaaatacaacaaattagccgggtgtggtggcgggcgcctgttgtcccagctactctggaggctgaggcaggagaatggcgtgaacctgggaggtggagcttgcagtgagccgagattgcgccactgcactccagcctgggcaagagaacaagactccgtctccaaaaaaaaagacttttggtattagcctgggcatggtggctcatgcctgtaataccaacacttcaggaggctgaggcgggtgaatcacgaggtcctgagtttgagaccagcctggccaaggtggtgaaaccccgtctctactaaaaatacaaaaagtagctggacgcggtggtgggcgcctgtgatcccagctactcgggaggctgaggcaggagaatcacttgaacccgggaggcagaggttgcagtgagccgacattgcaccactgcactctagcctgggcgacagaggaagactccgtttccaaaaaaaaagacttttggtactaagctttctcgtatgatttttctgtaatcttatattaatagacgtgggatgacgattatgaaaaataactttttagtcattcggtaggttgtcatgtagtcagtgttaagtctctctttactttgaagatttagagttctgaaaagttgatttgtgcctgcagtatctcttagtgtttaccacaagtcatttctcagagtgtctgtagatgtttaggctgtacttaagtactgcacctacctacttggaatatctttttgagactgtattcagagatctaagtcctgatttcgtcctgtcaaccccagattttcttttttctttttcttttctttttttttttttttttgagacagtctcactctgtagcccgggctagagtggtgcagtggcacaatctcggctcatttcaacctctgtctcccgggtccaagtgattctcctgcctcagcctcccaagtagctgggattacagacgtccgtagagtcagggtttcaccatgttggccaggcttgtcttgaactcctgacctcatgattcacccgcctcgtcctcccaaagtgctgggattacaggcgtgagccaccacccccagcccaaccccaaattttttataatgtcattaggtataaaaacttcagaagcctccaatcctgagccctagctaattcattgtgccagtgacatgtgtagagaagaagcctggtggggtatgatttgattaacactgaactttgttctttcttccagatttcctcgtcctgtgactgtggagcccatggaccagttagatgatgaagagggacttccagagaagctggttataaaaaaccagcaatttcacaagtatgcagtcttgatagatttccctattaggtgtttccttcttaagaaagcttataaagggatatgtaaaagaggcaggtctttgctgcacatgttcactggcagccattatcttggtcctcacaaggaatgcaattcttagctggggtaattctggacaaagttagtaacctaggaaccttgcctatagggaacgagagcagccacccagatttgcacagcctggctcctttgagtatgaatatgccatgcgctggaaggcactcattgagatggagaagcagcagcaggaccaagtggaccgcaacatcaaggaggctcgtgagaagctggagatggagatggaagctgcacgccatgagcaccaggtcatgctaatgagacagggtgagtctaggcctgtaagtcttaaagctgaaaggacaaaatgacatttttaaatgggtttctttgtatcaattaacagaagggcctacatctctgcttttatacttagtttgcgttgattttggtagataaataggcttggagatgtggcagagatactggattctgtggagaaggaaatgataggtataacttcattttggaatctggacaccacaggtggttccaaaggaattagatcctctttgctttctggatctttatttgaagaaagtcattagatctatatgaagacaatgaggaatattcttagtctgttgtttttttagatttgatgaggcgccaagaagaacttcggaggatggaagagctgcacaaccaagaggtgcaaaaacgaaagcaactggagctcaggtaacttttctcgaacactttttccctaacaactctaaaaggtaatgtctcactcctctttcctactgccatgctacctcgtgtatttataaatgtgttggcaaatatttcctggctgcttctcaggttctttctttggattggagatgttttagctgcccatggtcctagaagttacctgctaaaaagaaagcagctgaatgctggtctcatgaggtttctttgggggttgcctcagggctgggcacacttaacagtgagtttcctggtgaactgatagttttcagtaggccagtctccttggttgagtctcctgttaatctgctcaagttctgaaatgcctctgtcttaaatacattggtgactctctgtaggcaggaggaagagcgcaggcgccgtgaagaagagatgcggcggcagcaagaagaaatgatgcggcgacagcaggaaggattcaagggaaccttccctgatgcggtatatctcccatgtgcccgtgatgtaccagaccagtcctgataaactcaccatgaattgtctgctaggttaccggttatgaccaattttcccgtgttgtgaaataaccctttagaaaaaagaattcataagaaggagaggtaaggtttgaagaggagatcttgcctcacaagcaatataggatgaaaaactgggtctgctgtattctgtttagactcagtgactataggaagagatatgcaaccttggctagtcctctgctgtccttgcaattgtacaagttggagcttcagaagcaatctcttccccctttcacctctctgttgctaataggaggctctggcttacgtcctagtagctctgtgaccttgaatttgttgcacaactagcaagggttgtgctcctcagctttctcagtgctgtttggacgtgttatcactctatctacttcccttagtgtgtggtccttgatggattgtggtagaatgcactgctgtcttggactgtcttgagtattttttgtttttcagagagagcaggagattcggatgggtcagatggctatgggaggtaaggacttaggaggttaatggctctgatttccttttttgtttggtcttgggtgaactatgtagcttctgctgcctactttaagggggtgacatatatgtcttacttagcccagaggtcttgttgaattgtttcctttggcatagaaagagactaacaatctttatcccttgtgctgatcacactactctgccttaggtgctatgggcataaacaacagaggtgccatgccccctgctcctgtgccagctggtaccccagctcctccaggacctgccactatgatgccggatggaactttgggattggtaataaaactgcagtgccttaacagtaattctaaatggtggtaggaggagaacaggcattgctttcacagcccctgggggcctacctcagtttgctatagatagcagtctttttttttttggagacagagtttccctcttgttgcccaggctagagtgcaatggcatggtcttggctcactgcaacctccacctcccgggttcaagcgagtctcctgcctcagcctcccgagtagctgggactacaggtgcttgccaccatgcccggctaatttttgtatttttagtagagatggggttacaccatgttggccaggctggtctcgaactcctgacctcaggtgatccaccagcctcggcctcccaattttgtatttttattagagactgagtttgaccacgttggtcaggctgttcttgaactcctgacctcagataatctgcccgcctcggtttcccaaagtgctgggattactggcgtgagccaccaagcccggcccagatagcaatctttaggactgctggtatccattaaatgtaacctcaaggtctttatttttgaatcttgagcaaactcaatctctatacttaatctaggagttaagtaaatgccaccgtctgactggccagtctgattgactatgtttgttggagggaagtcaatgaaggctaggcattatcacataaaatagttgtgaatccaaatacttcatggctcatgcaatcctggggttgttttggttatggtgttaaaatgccaaaactggatagtttggttgtttctgtttttgtttttctttttttctttttctttttgagacagagttttgctcttgtcgcccaggctggagtgcagtggtgcaatcttggctccctgcaacctccgcctcccaggttcaagcgattctcctgcctcagcctcctgagtagctgggattacaggcatgcgccaccacttttggggttatccactagagttctaaacagacttagtcacccactcctacctaccatcaggagccttgaatagttgaatggaaatagcctccagtggagggactacagatgggtgggaagcttccaacaatggctctgttacagtgttgctctctttttctctttaagaccccaccaacaactgaacgctttggtcaggctgctacaatggaaggaattggggcaattggtggaactcctcctgcattcaaccgtgcagctcctggagctgaatttgccccaaacaaacgtcgccgatactaataagttgcagtgtctagtttctcaaaacccttaaaagaaggaccctttttggactagccagaattctaccctggaaaagtgttagggattccttccaatagttagatctaccctgcctgtactactctagggagtatgctggaggcagagggcaagggaggggtggtattaaacaagtcaattctgtgtggtatattgtttaatcagttctgtgtggtgcattcctgaagtctctaatgtgactgttgagggcctggggaaaccatggcaaagtggatccagttagagcccattaatcttgatcattccggttttttttttttttgtccatcttgtttcatttgcttgccccgcccccgagacggagtcttactctgtcgcccaggctggagtgtagtggcatgatctcggctcactgcaatctctgcctctcgggttcaagcttgtccaggctgatcttgaactcctgacctcgtgatcccctgcctcagcctcccaaaatgctgggattacaggggtgagccaccgtgcccaacctcacttgctttcttatccttacactcccccagtcccagagaaactgccacatacaccacaaaaaccaaacatcccccaatgaccttagccgcattgctccattcactcccaggtgagaattcaggtaaacgtccacaaaggtcacaggcaacgtacatacggttctattatatcccatatattaccccttcatgtcctaaagaagacattttctcttagagattttcattttagtatatctttaaaaaaaaatcttgtgttaacttgcctccttttttttcttgggtgaggacacccaggaatgacccttttgtgtctatgatgttgctgttcacagcttttcttgataggcctagtacaatcttgggaacagggttactgtatactgaaggtctgacagtagctcttagactcgcctatcttaggtagtcatgctgtgcattttttttttcattggtgtactgtgtttgatttgtctcatatatttggagtttttctgaaaaatggagcagtaatgcagcatcaacctattaaaatacattttaagccttttaattttctgtggtgtttttgaaggggaaaggagggaggggagttatcttaggagatgagcagtagactctataaaggtaatcctttatgacctttggattacagtattgatctagacaaacatggggaggaggtggggatgaggtgcatcaaatggctggaggggttggcaaggattagcgctattgatactacatggaagtaatgatggaggaaagctgcccctctgaaagaggaagaaaatgggcttaatcctcatcgagctgggggcgcggggggggtctcaaaattggtatttgtttcttagcagctgctgctgtgtccaaggcttggaattgctgtggtgaatctaaaactgtctcagtagtggtgagctgacctcacccaagttcaaagccctactctgcctgatccttttttcctgagcctcagagctaaaatgcccccgagctctttcctattggctggaaagacgaattgaagttcccttgcccatgttaggaggtgtacgcctcctgaactaaagatagaaacagctggcccttccaggcagctaaaagcctccagactaagaggtgttccccattcggcagccagactccttgaaataccctttcagtaatcattcaaccaacgcttccatgtctctactctgtcgtaacaaaggctgtgggcagcactttgaccctaataccaaccttcctggtgagtaaagaatcctgacctggccaggggctctgtgtgggtgttggggactggtcagctggggggcagtgtgtttgaggagcggggaaagaaactacctgccctagtttaattggtctgagtgatcttacagcctttgctggcttttttttttttcttcacattatatgggaagaaaccataaatagaaacccggggaagaggtgaaaaatgatacttggtatagttatcttcccttccttgataacttctactgatgtccacagattcctgttgccatcaccctggggtcccaatcttccatgatgcacttaaggtgaggagtaggtgaggggggttagcaagagcatttcccagaagagataatacccaggaagctaagctgatctgggtctcttgttatcagggttggtcctgctgccgaaagcgaactgtagatttctctgagttcttaaacatcaaggtaaattatttatgtacttggattctgcccccaatagaaggattctatccctaatcctatctccttatctatactagggctgtactatgggaccacactgtgctgagaagcttcctgaggcccctcaacctgaaggccctgctacaagcagttcacttcaggagcaaaaacctctgaatgtgattccaaagtcagcagagaccttgcgccgggagaggcccaagtaaagaggaggaggcccctggacttttcttattttcatgtagcttcctaggagtgattaatgggtcattgaggactgggaactagggaccagggatgtgaggagggccagatgtcagggtttggatggtgtatatcctgtgccttaggggaaatttgtgtctggaaataacgccctttcctctaaggtggtgtgggatgatgggatagatacctgaatcaacagagtagatagcccctcacaaatacatccttagtgtataacacaaaagggattgttgagaatgacttctctttctagaaaagaactttaagataaatctcatatcaagaaaaggatgtattgtattattggcagccaggagacttcccaaattttgtgggaataataagagcaacagaaggaagtcatattaggtccacgattagataaagaggaagaggatatgactcagttctgcagagaaaagtggttaggtttagagcaactgagtagatgggtaagagaagtgctggggatttctctagggttcaggtatttgggatgtccacagagatgaaaattggcaatggggttgctacccaacctctccaactctgcctcactttca

SEQ ID NO: 13025 - DNA, 102053 bp, Human
  misc_feature (1)...(102053): n = A,T,C or G
tggtgactactttatcaaggtgatgaaatttagcatcaccaatactaggacaacactgtatttgacagtgtaccttctgatggctgataaaatatttaacctgggccgggcgcggaggctcactcctgtaatttccagcacttgaggcgggcggatcacgaggtcaggagtttgagatcagtgtggccaatatggtgaaaccccggctctactaatcatacaaaaattagccaggggtggtggcgccgagatcgcaccacagcactttatcctgggagacagagcaagagactccgtctcaaaaaaagaaaaaaaaaaaaaggccgggcgtgtggtggctcacgcctgtaatcccagcattttgggaggccgaggtgggcggatcacgaggtcaggaaatcaagaccatcctggctaacacagtgaaaccccgtctccaccaaaaatacaaaaattagccgggcttggtggcgggcgcctgtagtcccagatacttgggaggctgaagcaggagaatggtgtgaacccaggaggtggagcttgcaatgagccgagatagcaccactgcactccaccctgggcaacagagcgagactacgtctcaaaaaaaaaaaggaaacaagagaaattcggatcatggaatgttttcaagacaacttgcctggattcttccaaatatttagtgtcatgaaaaacaaacaagaaggcaggtgattctggactaaaggaagatgaccaaatacaatgcatgaaacgtgaatggatcctagtattggaaaaaagggagaatgaggaagagtgctatgatgtggtaaagaaattatttcagtctatattatcataatatgtgaaaaaagcaaggtgaaagccggggtgttggctcatggctgcaatcccagcactttgggaggctgaaacgggcagattgcttgagcccaggagtctgagaccagcctgtgcaacatgacgaaaccccgtaaaatgttccaactaggacaactggggaaatttaagtgcggactcttccttaaataatattgacttacttcctaaagttgtgataaaggtactttggttccatagttaagatgcttatttttaggagtgaagaacaagatgcccataaatggtttagaaaaacaaaaatcctagcaaaatgttaaccattgtgagtctaggtgaggggtcagctgttcattttactaaactttcacattttccgaaataaaacgttgggggaacaagtattttttttgaggcgggctggagtgcagtggcccgatcacaggtcactgcagactccaactcctggctcccacctcagaccccccaacagctgggactacaggcactggccaccacatctggctaatttttttgattttgtgtatggatggagtctcgctttcttgtccaggctggcctcatactcgtgggctcaagcgatcctcccacctcggcctctcaaagtgctggaattacaggcgtaagccaccgcgtccggtcaaaaaatcaatttctagggaaaaatgtcaactcaaaacaagtaacctgcatagctcgggaatgcctgtataatttacgtcaagtctctccttgggacggaccggtgaaattgcacgcagcacaaagaccggctcttacccttacttccgggtattgtggtacaggaacccgaggttgcctgcgcgtaagccacgtgactcgagcagctccttctgattggaggaagagccactgctctaattcggtgccgtgagaaagctcgcgcgcggagcagtgggagcgggcgggactgaatattttctttgaccaaccgctttccacatatccatcctcctgatcccgtagcgtcgaatcaaaagccgttagtaaagtagttacttctttctcttaggatagccggtctttccgggttttcccccccttccccctcccctctccccacttccccctccctttcccctctgttttgagcttccggtagaggctggtagggtaagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgtgagggggtgggcgtgggggtagggctcggggggtggggctaagcagaggaaggaggtgcggggaggaaaggagagggtgctcaggcagcgagaacagggcgcagctaacgccggggaggaggatcccgtcctcatgggtgcgggagcaacgtggcgtgggagtgatcgttctgggggagagtgggcagaagagagcgcgaggcgagcccggggccaggggcgcagggaatagtggctttggagctagcgctctgccgaccagacagtaggacacatgctggtttcgcctactgagatggcttcccacccgtaacctgcttggagattcttgacactgcctgcccctctgacatcgctgccctgagatggctctatagagccagaggactggacaggacctgcctcccgctcgtttggttccggcctcaggcttaggacaatggggtgttcctagcacccgagcgggcctcctggtcacagtgcgccttttaggtggctctcccagcgtcttcactgactttcgtgaaatagtgtcctgcgccctagtgaaactaccctgccttcacttaggcccgttttcttgaggagtgaagctgtcggccgctgtggcccctcctgtgccgcaggcgcatgcgaaacagggaccgaacgagccccgcctcgacgcctccaatcccactgatccccctgcctcggccctcgttccgagaacgaccgttccattcattcagtcttggcagtagttatttgattcgtcttctcttgtagtatactttaaagtgtgggcgatgcagttggctgtggtgctttaataaagatctgatcgatgcggagtttggtagatgtatattacagttctcgaacgtgttgcttgttttggcacactgcacagtcatttttcatgtggatttgtgactttgtcgtggaccagggaaataagtcctgtggtgtgggagtcgtaggtttagttgttatcttcgactcgtgctgtccctttttcaggaatgtaagaagcacttggcaggcttgggggctttggggctgggcagcctgatcactgaactcacggcaaatgaagaattgaccgggactgacggtgccttggtaaatgatgaaggtgaagtctgggttgtggggagtaggcgggggaggaggctagccacctactatgtatgtacttttttgtgtgtgtaagacggagtttcgctctgtctccgaggttggagtgcagtggggcgatctgggctgactgcagcctccgccacccgggttcaagcatttctcctgtctcagcctcctgagtagctgggactacaggcacgcaccaccacgcccggctaatttttgtatttttagtagagacagggtttcatcatattggtcagactggtcttgaactcctggcctgaggtgatccgtctggcttggccttccaaagtgctgggattacaggcgtgagccaccgcatccagcctgtacatgtacttttaaatgggaattatctgagggagtgagggtcgcttactgttgttgcgattctccctgcttttttcatagggtgggttaggagtacagaagatgctgtggactattcagacatcaatgaggtggcagaagatgaaagccgaagataccagcagacgatggggagcttgcagcccctttgccactcaggtgattctttggtgtattggcttgaacattccagtgcattatcctgctgtatagtccagtttgggctctggtttctatacccgctgtctgccattgtttctgctctctatgcctttgctttggctcctccactccctttgtcaggtcagttccaagtagctgctatctttttttgtgttctggccagtcttaaccgtattcatgtggttattcctcacactgttcagtcatgaattcttagttaatgacaagtagctttcttgtcacctggtatttgaatacctacagggtttgtgagatacacttcaaagttggaaactatgaaacaaattcagtttttgcccttaaggaatggatagttcaagaaggatacaacgtcatacataagcaatgaactaaggcaggacgtggtggctcaccagattacctgaggtcgggagcttgagacagcctgaccaatatggagaaatcccgtttactaaaaataaaaaattagccaggcgtggtggcgcatgactgtaatcccaggtactcgggaggctgaggcaggagaattgcttcaaaccggcaggtggaggttgcagtgagccgagatcgtgccactgcactccagcctgggcagcaagagtgagacactccgtctcaaaaaaaaaaaaaaaaacccaatataaaacaactgtttttttttttttttccgagacggagtgtctcactttcttgcccaggttggagtgcggtgacacgatctcggctcactgcaatctccacctcccggtttgaagcaattctcctgcctgagcctcccaagtagctgggactacaggggcccgccaccaagcccggctatttttttgtatttttagtagagacagggtttcaccgtgttagccaggatggtctcgatctcctgacctcgtgatccgcctgcctcggcttcccaaagtgctgggattacaggcgtgagccaccacgcccggccacatctggccaatttttttgtatttttagtagagaaggggtttcaccatgttggccagattggtttcgaactccttacctcaagtgaccctgctcccctcggtctccataagtgttaggattacaggtgtgagccaccgcaccctgcctaaaacaatgaacttgatacctgcttgcaaatatgtttttttcctctctggtatagggtgctacattgtagaatcaaaacatcagacttagaaggtagagtcagtgagtggaaggagtcttaggaattatttattcgtaatctctagtagaaaaggaaaacttgaactttagagaactttataataaaatgtgggattttatcaaaagtaatacaattagctagtagtagactgactaatttagctcagttcgttagacattgtttgagcacttgttatgtactctaaactgataggcagtgtgtttcttttttttttttttttttgagacggagtctcgctctattgcccaggctggagtgcagtggtgcaatcttggctcactgcaagctctgcctcccaggttcatgccattctcttgcctcagcctcccgagtagctgggactacaggcgcccaccaccacgcctggctaattttttttttttttgtatttttagtagagatggggtttcactgtgttagccaggatggtctcgatatcctgacctcgtgatccacccgcctcggcctcccaaagtgctgggattacaggcatgagccaccgtgcctggcctaggcagtgtgtttcaaagataatgaagtccgctgggtgtggtggctcaggcctgtaaacccagcactttggggggcccaggtgggcagatcacgtgaggccaggagttcgagaccagcctaggcaacatggagaaaccccgtctctactaaaaataaaaaaattagctggacatgatgtcgtgtgcctgtagtcgcagctactcaggaggctgaggcgtgagaatggctggaacccaggaggggcaggttgcagtgagccgaaatgatgctgctgcattccagcctgggcggcaagagctaaatgctgtctcaaaagataatgaagtccattttctgatcttgagaagttcaatttagtggtctggaatctagaggtattggtccatagttcatttttggcactgccctgttctacctctcactgcttgagactcccccaccccaccccacctgacagagtctctctctgtcaccagggctggagtgcagtggtgtgatctcagctcactgcaacttccacctaccgggttcaagtgattcttccacctcagcctccccagtagctgggactacaggcatgtgccaccactcccggctaattttttttgtatttttagtagagatgaggtttcgccatcttggccaggctggtctcgaactcctgacctcaggtaatccgcccacctttgcctcccaaagtgttgggattacaggtgtgagccaccccgcctggcctgcttgaaacttttatgtgaagttgctcgttatttattcatcgtccacctcttcgaactagatttcaggcttctgataaatgtagataaaaccttggtaaatacttgaacttagttttttcgggacagcttatggatttgagtgctacttatatgaaaagaattaactgtgttgcatatacaaaaagtaacccacgaaaaatagaagatataagccctgcctttaaggatattgttatcttttggggaagatgatgtgaacaaatgcagaacaattattcatagtaagacaaaccacctatgagatcatgtttctgtatatagagtgttacatttagttttgatgggctgcaagaataggtaagtcaatagctgtcatttttgggcaccctgactggggggacatggtggcagttattttcagtagaagttataatttccaggtttgtgtttgttgtcttgactagggatggtaaggaaaaggctgggagtttccctaggtgagttttatgagctaacttcctataaaaggaggatgctacatttgacagaatctcagtactctgggatgctcatttctaagttctcttgtcctctaggggtgccttcacctatacccttagttttttccttccttggcattggctcctttgcatggcttggtttacaagggtgcttctttggaataattggaagtgggtgtagattgctaataaagctttcatggaggtgaattttgagtaaaattttgaaagtgaggcaaggtttggtggagaaggagcagcaggggattttggtttggaaacacggcttgtctaaaggtttggagatatttagaaataagcaagtagtgtgtgtggagggggaattagccagtaggttttcttgaaaggagtagaaaacatgctgccaaatagcaagaaccaaggatagagcaatttcacagtacctttatgtatgcattacttgggatttgatgacataaggaattgcaaaccaacatagactgttgagtgagaggcaggatggtataatgaaaagaaaaggattttggagtcagtgtcctaggcttagagtgtcatagattcaaattccaactccatatttagtgtgaccctgagcaggttgctgaatctctgaggcttggatttctcatttgtaataatcccccagttttcttgtctgtagtaaaggtgataatattcacacttttgtgagaattgaagttcattatcacatgatgtaaaagcacatagtataatattatggtaaatgctctgtaaatattagttggctttcctttttttctgctttgctagtttacagtcttagaggcttccctttctgaggctttagaagagtgatacttgtcgctctggggttttgattagtaaaagagtgaatgtcacaccaacttgcaggctgttcttgcaggctagagatgtaaagttattaaggtccgaagtagggtgacagttgtagaaaatgatacctagggtcaggctgggcgtggtggctcacgcctgtaatcccagcactttgggaggctgaggtggacggataacttgaggtcaggagttcgagtccagcctgaccaacatggtgaaatgctgtctgtactaaaaatgcagaaattagctgggtgtgttggcacacatctgtagtcccagctactcgggaagctgaggcaggagaatcgcttgaacccgggaggcagaggttgcagtgagctgagatcatgccacggcactccagcctgggtgacaagagtgaaactctgcctcaaaaaaaaaaaaaaaaaaaaaaaaaagatagctagggtcaaacttagaagatactgataaagtatcgtaggacttggttgcctatagtcccagctactcaggaggctgtggcgggaagataacttgagcccaggagttggaggttgcagtgagctatgattgagcttctgtgctctagcctgggcaacagagcaagacccctgtctcaaaaaaaaaaaaatacagggcttggtgagtgaggaattgtgttggaaagagtgtaggctttgttgttaaaccaggcttgcattctgattttgtcacttaaaattcagtctcttccgtatctcaggataattcctgttttgaagtgttattgggaggattatacataaaacagctagaaatgcctggcacataatggaagtttagtagtaggaagttgctatacttacttttttgtttgtttgtttgagacagagtctcgctctgtcacccaggctggagtgcagtggcgcgatctcagctcactgcaagctccgcctcccaggtttacgccattatccggcctcagtctccggagtagctgggactacaggcacccaccaccaggccaggctaattttttgtatttttagtagagacggggtttcacagtgttagccagggtggtctcgatctcctgacctcgtgatccacccacctcagcctcccaaagtgctgggattacaggcgtgagcctctgtgcctggccacttttttttttttttttttgagacagaatcttactgtgttgcccaggctggagtgcagtggcgcaatctcggttcactgtaacctctgcctccccggttcaagcatttctcctgcctcagcctcctgagtagctgggactacaggcccgtgccacctctcccagctaattttttgaattttagtggagactgagttgcaccatgttgcctaggctggtcttgaactcctgagctcaggcaatccgctcgcctcagcctcccaaagtgctgggattacaggtgtgagccacctcactggccctatacttactatttgtaatgatcaattggataaatgtatattgggggttatgagattgatgaaggagacagtggactaaagccataagctgggaaaatgcatatggatgtgatgttgatagggaatttaaaagagataaaggatatttcagtgttttataaggtacagctgttaaatatctgagtagaaagtttccttaggaagcagaagagtcgtggagttgtagaggaggtaaattagggccgcatatgtagatttgggtttaatctaggtgaaggtgattcttgagagagggaatagggaacgtataggggaataaaagcagagtctttaggacgaattcttgagtgatgccaatggttaaggggcagtgaaaagagtaataaactgcagatgacagatagaaaaagtgtgtcatctctcatttgagagatgaaagaccagtcttaagggaaactgacagagggagaagattcccaaagtgctgggattacaggtgcgagccactgtgcctggcccagtatgaaaattctaaaaaagatatggtcaggaaaggagcaaatgtttcaagcagctcttggaaacgctttcatatgttgtatgattttttcttttctttctttcttttttttttttgagacagtttcactgtgtcgcccaggctggagtgcagtggcgcaatctcggcttactgcaaccttcacctcccggttcaagtgcttcttgtgcctcagcctcccaagtagctgggattacaggcacatgccaccactcctggctagtttttgtatttttgacagagatggggttttgtcatgttggccaggctggtctctgaactcctgacctcaggtgatctgcccgcctcagcctcccagagtgctggcgtgagccaccatgcccagccatcatatcttgtgtgagatattatatatgttatagcaattgacttgcaccgtgatgtcatctctttctgaaggctaaagctatgtttcagatagatatgtaaaatattttgaggcatggtcttgctctgtcacacgattactgctcatcaaagccttgacctcctgggctcaaactgtctcccgacctcagcctcctgagtagctggtactacaggcgtgtgccaccacgcctagctaatttttgtattttttgtagagatggggtttctccatgttgtttaggctggtcttgaaattctgggctcaagtgatctgcccatcttggcctcccaaagtgctgggattacaggcgtgagccatcatgcctggccctcaccttgcttttttcacttgtgtgttcttaagggatatgcatagtgtttcatgtggtgctttaaattattgagtggccctgtaatcccagtactttgggaggctgaggcaggtggatcacaaggtcaggagttcgagaccagcccgaccgacatggagaaaccccgtctctactaaaaatacaaaaattagctgggcgtggtggcacattcctgtaatcccagctactcaggaggctgaggcaggagaactcgggaggtggaggttgcagtcagctgagattgcaccgctgcactccagcctgggcgacagagcaagactctgtctcaaaaaaaaaaaaaaaattgagtggcaaggaagcttaaggcggttgtataatattttggatattgaggagatcaccttcttggttttattagattatgatgaagatgactatgatgctgattgtgaagacattgattgcaagttgatgcctcctccacctccacccccgggaccaatgaagaaggataaggaccaggattctattactggtggtaagtagagattgtctacttttgtctgaggagcaagttttcattcctaagtccaggcttgtggcacacacataagggacaaacttaagcttatatgaagggacaaaacttctagaaataattcatacaatcgcaaattttagtattaaagggaagttttacttttaaaacatttggcaacagtattttaacatgtgctcaagaaatagtagtttagtcagtggttctcaaatctggctacccatcagaatcacttagaatctttaaaaaaaaaaaacaaatacctgactttcaccccttgagcctgattcagaagatcttgggtagagtccaggaatttaattaaattaattaaaatttttttgagaaagagtcttgctgtgttgtgcaggttggagtgcagtagcacgatcttggctcactgcaacctccgcctcccgggttcaagtgattctcatgcctcagcctccagagtaggggctggaactcctgacctcaagtgatccgctcgccttggtcttccaaagtgctgggattacaggcgtgagccactgctccctgccgaacccgggaatcttaaagagtttcttaagtaatttatgatacaactgatctgtatactggtatttggaaactacttgtttagatggctttattttaaatgaagtggttaaattaggaaggtgccctggaatgttgataaatcagatagtgtcaactaccagatattcagagatttcaaaggctagtagagtcttcagtgtttatcttacctattcctataacagtaactgtcctaggcttgaaaactggggaagagcagtgtttttgacctcctgtattttgaggcttgtattaacctaaattcttcctgttggagttttaagccatttcttttaacagtctgctaaatgtcagctgttaactttgttttatagatcttatttatgccaaagaaccttaatgttgtcccgtgggcttaaaaaaattctccagctcatgagtctctgaactaggactacctgagtggtataaagtattacatagttttgctattggtcacaacattggttacaatattggttacttatcagaaagtagggccaggtgtggtggctcacacctgtaatccgagcactttgggaggtggaggcagatgatttgaggtcaggagttcaagaccagactggccaagatggtgaaaccccgtctctactaaaaatgcaaaaatttagccagctgtcgtggcgcatgactgtaatcccagctactcaggaggttgaggcaggagaatcacttgaacccgagagagagaggtttcagtgagctaagatctcaccactgcactccagcctgtgcgacagagcaagactctgtctcaaaaaaaaaaaaacaacaaaaaatcggaaagtagtaaatgtagtaatagtgtttgttttctcatcacaaccctagggtaccaggtacgtggtgagttgggggacgatgggagataacgagttagaatgagttttctgggttgcatactagtattatgatttgggtgcttgggcctatatctcctggcattgagccatgtgtatagcctaaagtgggtgtttgcggaattcgaggaaatatgttcacagttacatgccaaaggggtttctcttccttgttgcagtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtacattctgtggagaatgctcagattgcaaaccactgacctcttccaaataatgagttttgttgttaagatgctgagtatggaatggggtttccttactcagtgacatattattggctacataagagctcttcacactgtattaggtcttttttttaaagttgtatgtattgatagtaaatgtgatttatgctgttctcattggaaatttctctgttatcttaaaagaactagcccaaattattaaggaacgcttctttactttcttagacgttacaagtctgaatgcgacactcctttgtttctcccccacatttgaagagatctctcaagggagttttcaggcccagatgctgctgttttcccatctgactttgagtctgtgtcatagtaatgtattctgtgttctaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaagtaggcaaaatagagacctgagattaaggcctatgagaggaacaaatgaattcaatgagttctccctaatttatgtctaaattgtaaataataccatagcagatagaatctgtgctaattttcaatgagtaatcatgggttcaatctcagtggctgccccttccctattgtaaaagaaaaatgtttggtggggtaggcggggatgagaggggtagatggtgatatgctgctgaataagaaggtttgattgataggtggaatgtgctatgatacatctccattgtttacattctaactccaggtaaatcatcctcagtttctctaagttcccctcctgactgttaactctctatagccttaggacatctgggatcaggaaattctccctgctctacttctttcttctgttacagatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggtgagcaacactggtatgtaagaaaggaatcaatgtactcaggtcctattacttttactaactttactctttaattggggagatactgggtggtagggtttctttggtgggagattgaggtgtctcagccttttatttggtatggtgtatcaccctggtagctaggtcctattctaaggattctgtttgtgaaatgaatgctgtgccagactaggagtgggaagaggcaaatattcctccgttatcaggtggttgtttcaagtaaaggaccacttacaatgtgtctgatgtatctttaatgtggaatttggagtggaaaccttgaccagtgaccaatcaaggatgtgttttttcttccctacttacacaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggtgtgcttctgtgccagctgtgtctagcagatactgcccttaatcttagtcaccataagtgggctcagctgtgatttttttttttttttttttttttcggtgagacagagtttcgctcttgttgcccaggatggagtgcaatggtgcagtctcggctcactgcaacctccgcctccccagttcaagcggttcttctgcctcagcctctggagtggctaggattacaggcgtgcaccacgatgtctgactaatttttgtatttttagtagagatggggtttctccatgttggtcaggcaggtctcgaactcccgacctcaggtgatcacccgcctcagcctcccaaagtgctgggattacaggtgtgagccaccacgcccggctggctgtgatgttctgagctgccaagagatagtgaaatttttaggatctgaggcctaattctagtccctgtaatttttattttatttttatgctcaacctggaggaagatagtccatgtaattttttgccctgttaagaagctaggccagactcaggtttcttaaaaacatgtgataaagatctttttttttttttttttttgagacggagtcttgcttgctctgttgcctgggccggagtgtagtggcgcaatctcagctcactgcaatctctccctcctgggctcaggcgattctcctgcctcagcctcccgggtagctgggattacaggcatgcgccaccatgcccatctaattttgtatttttagtagcgatggggtttctccatgttggtcaggctggtctcgaactcccgaccttaggtgatctacctgcctcagcctcccaaagtgctgggattacaggcatgagccaccacgcctggcctgaagttaaagatctttctgaactataacagtactttatagtatatttttgttcccaagtccctttgtatttagaattctagtttcctatttttctccttaaataggtttttttttttaaggtatgccatgattaatgtaaaaaactttgaaaatacagtatagtgttaaagtcactggtaatctatctggagattatcaactgttaagttttggtgtattttcagtgttctgtgtgtgtatgtagttgagctcatttccgtatgtacagttttgcatactgtgcttttcacttactaaatatttttctctctttcattttttatttttcattgttgagacagggcctcactttgttgcccagactggtttcaaactcctagactcaagtgatcttcctgcctcggtctcccaaagtgctgagattacaagcaagagccaccccacccagccacataaatatttttgtgtcatttagagttctttataaaaatgtttaatgacatgggaaactcgttcattttattttaattaaattattattttttgtagaggtagagtcttgctattgttggtcaggctggactcctgggctcaggtgatcctcctgcctcagcctcccgagtagccaagacttcaggggcatgccaccacgtctggcttgagaaactcattttaaatggaaataaagaagatatgaaacaacatatatgatatcctattagtgtaaatgaaaaaaagcagactatataaacatagaaagctggattacttttatattttggaggaaaaacaaaattttttcttttttgagacaagagtctctgtcgcccagggtggaatgtgttggcgcgatcttggctcactgcaacatctgcctcccaggttgaagtgattcttgtgcttcagcctcccgagtagctgggattataggcgtgcaccgctgtgcccagctaatttttgtatttttagtagagacggggtttcaccaggttggccaggctggtcttgaactcctgacctcaagtgatctgcctgccttggtctcccaaaatgctgggattacaggcgtgagccaccacacccggatacaaaaatgtctgatttttaaaacctaagaaataggttttttcccttccattctgcccactttatgggttatatattactattacgaatgtttcataatttaccgataacatgttgcatttgttaatacaatttattaccatttattgttagcatactttaccatatcatttattgtcataatttaaccaattccttcttaaacatttaggctatttaaatttcaactattataaacagtattgcagtggacatttttgactgcaacattatttttatttatttattttttgagacagaatttcactcttgttgcccaggttggagtgcaatggcacgatctcagctcactgcaatctctgcctcctgggctcaggtgattctcctgcctcagcctcctgagtagctgggattacaggcatgtgccaccacacccagctaatttttgtattttttgtaaagatggggcttctcaatgttggtcaggttggtcttgaactcctgacctgaagtgatccacctgcctcggcctcccaaaatgctgtgattacaggtgtgagccaccgtgctgagcctgcaacattattttaaagtgagaaatacactgtgtaggttccttttcagtggacacatgaataactccactaactcgctctactaacatgagtaactctttttatctttgccagaatcttgattgaaaggggcataaatgttttctctgttactatttcctccttgcactttgactaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttgggtatattactggcagaggccagtgtttcttctcctttgaaaacttgctgttaatgtcaacgggcaggaggaaatcagaagggttggagatgattaggactagaaacctgtaggtagcggcttgagagagcgaagttttggctgttagtttatattatttgtgtatatgcttagggaacactcacgtaggaatgttggaaagttgcaactttgagatgtcaagagcatagtttgttccgttagtgaatcatggactcgaaacttctaggtagcagtttgagagagcaaaattgtggcagttagtttttattatttgtgtattccctagggaaaactcatgtaggactgtcggaaagtagtacctttgagatgtcaagcgtgtagttcacttagtgaatcatgtactagaagtgatttgggatgggatgaaaagatacaggtgtagttcagttagtaaatcgtggactagaagttacctgggggggggtgggatgaaaggtctagttaagaccttcactggaacatccgtcaccttaaagaagaaaactggatacttgtctgtaggaaaggtgaatcttcagggagagcaactcaagtgatttttgttttattctcagaaattcctgatgagaaggaagaggccacctctaactccccctccaaggagagtaagaaggaatcatctctgaagaagagtcgaattctcttagggaaaacaggagtcatcaaggaggaaccacagcaggtgtgtgaagaaaaaaggggcttggtgtttagaagaacaaagaaaggtaatagagaaggatagtctgaccgagatttgtttgattatctatcattagaacatgtctcagccagaagtgaaagatccatggaatctctccaatgatgagtattattatcccaagcaacagggtcttcgaggcacctttggagggaatattatccaggtacaaatagtgtcttttctgtgatagaggagaaccccatggctttgttctgacggaggatatgggaaaatcttgcttaggatggaattagctaattttaacccttctatttcctgttttagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaaggtataattgaattctggttagaaaacagctataaaggatattggggtataaattaagggaatgtaccaggtattagattgtattagggaattggttattttctcagatgtgatagaatgttattttggttatttaggagaatgtctttattgttaggtgatgcatgtgaaaatatttaaaggtgaggtgtcagaatgactgcatctttcaaaaactgtccagcaaagtctatagaaagataaaagtttaaaaaaatggcgaaatataaacagcgacgtgggataataagtgttcatagtacagtcgtccttcgttatctctgggagattggttctaggaccttctctggataccaaaatctttagatgttccagtttctgataaaatagcataatatttgcacataacctatgcacatcctctcctatagtttaaatcacctctagattacttataatacctactccaatgtaaatgctatgtgaatagttgttaacactgttattggttagggaataatgacaagaaaagtctgtacctgttcagcacagatgcacttgtattttctgaatattttctatctatggttggttgaaatcacggatgcagaacccatacatggatatggagggccgactgtactattctttgaactttacagtatgtttgaaaattttgattatgaaattggaaaataggtaaaatgtttttggtgtgtttgtctcagattgaacaacgtcattgtgtgtagtagtgtcctgtcaggagctagatggtattttctttgttctggacagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacgggtgagtctctgctcagaaaatttttttcccatacataattctgcttatgcttccataaacttttatgtacaaactttttgttattaacatagctgtagtgagacaaactgcaaacttacatacaaattttttattattaacgtagctgtagttagagatctactggtaatctgtgaacatataccataaatttcttgggagaaaggagtggtacctttttttgtagttataacatgttgagcatctcaaatctcaaaattcgaaatcaaaatccaaaactttttttttttttttgagactgaatcttgctcttttgccaggctggagtgcagtggcatgatctccactcactgcaacctccacctcctgggtttgggcaattcttctgcctcagcctcctgagtagctggactacaggcgtgtgccaccacacccagctaatttttgtatttttagtagagacagggtttcatcatgttggccaggatggtctcgatctcttaacctcgtgatctgcccgtcttggccttccaaagtgctgagatacaggtatgagccaccatgcccggccaatcctaaactttttgagcactatgatgatactcaaatgctcattggagcattttggatttccagatttgggatgcccaactggtaagtataatgcaactattccaaaatccgaaacacttctggtcacaagcattttggatgagggatactcaacctgtattagtaaagtgctatggtcatattgtgtaggattattgatatattctaaataactgggtcttctgtgttccttatagaaacctggaaaagatcctggagcaccagattgtaaatatggggaaactgtttactgccatacatctcctttcctgggttctctccatcctggccaattgctgcaagtgaggaattctttcctgtttttactgttaactaaggaaattgataaatgaggaaccagtcagctcagaaagaactattataattctagttgattgagatgctttaattttaagtacaaagaaaataagtataatccaaaaatgttttaaagaaatctttttcttaaaactggctgtgaattgtgttattctcaggctaaatgtaaaataggtttttaaaaatacacactggtaagctcagtaacatctgggaagcataaggaagtcaacctaggatgaatttactataaatttactataatttatgaatatttaatttttgtgtataaaattgataacattttgatcacattagctgtggttattgtgaatattgaaccacacctgaactgtgccatctacagtccccagccatagtgaaatgctttttttttccctcctttgttctaatgggtgtaaagaggctctcttataacagcttttatatattcaaggggggaagtatgatggtccacaaatgatgtggaaaatctctagcactctcccatcttgttttttttctccatttcatttctcttggcaatcttaaccatttgtcctactcttatacctagtttattctactgttgttgttgtttattctcctaaagcatctgcaaagctcagtttttttctttatcctttacattcatagtctattgctaaccggatgtttagtatcatctttgtattgttcttctcctttccctggaactttctgttgaggttttctaccaattcagcctcttcttttgtggctacttttgtagtctcttaaagatctttttctggccgagcgtggtggctcacgcctgttaatcccagcactttgggaggccgaggtgggcgaatcacctgaggtcaggagttcgagaccagtctgaccaacatggagaaactctgcctctactcaaaatacaaaattagccgggcatggtggcacatgcctgtaatcccagctactcgggaggccgaggcaggagaatcacttgaacccgggaggtggaggttgcagtgagccgagatcgcgccattgcactccagcctgggcaacaagagcgaaactccatctcaaaaaaaaaaaaaaaagatctttttctgtattcttctgtaattctttttctgcctatatttcacatgtagaattttctttccacactcagtgatggtcttccctctttctgtctactcttctgattttcggggaaggctttccttagactcaggcttcttgtgacagtttatccctatcttgcctctacttaaactggctcaaatgtttctgttcagctgtcctctgtcctactgtcttgtgttttccttttgttttttcccagcctattctgtctagcactctttctacctcattggttgttttatgatttatttgtttggagatagggtctggctctgtgacccaggctggagtgcagtggcacgatcttggctcactgcaacttctgcctcctgggctcaagccatcctcctacctcagcctcccaagtagatgggacaataggcgcacgccaccacatccagctaattattgtattttctgtagagatggggttttgtcatgttgccgaggctggtcttgaactcctgaggtaaagtgatctacctgcctcggcttcccaaagtgctgagattacaggcatgagtcactgtgcccggcgttgttttgttttttaattagtttaataatttattcaacaaatgttgctctcacacgttgtgtgttgggctacactggggtctagggtagtagtatagtacttggtacattatgaagtgattttcatatgtaatcttcatagcagtcctgtgaggtataggcatttttaagtatctctgttttgtagatgaggaaaactaaacttagacatgttaaatagcttaaatagacatgttaaatcatagaggtaatggcagagctagcatcatctgaattcacatcctgtattttctcccctactgactctgaaagatagtggatgaaaaattgtttagtcacatttgataatctatattttaatttatttgtattactggatagaccttagatggcgtaattaagatggagagcaataagcttggtatttctttctcagcagttgactgaatttcctagggctactctgtatataatttttgtgtttttacttttgttaggcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtaagaatgggaggatagggaggggattgggttgtatacagaaagggtatgttggggccgggcatggcggctcatggctgtaatcccagcactttgggaggccgcggtgaatggatcacttgaggtcaggagttcgagaccagcctgaccatcatggtgaaaccctgtctctactaaaaatacaaaaattagctgggcgtggtggctcacgcctgtgatcccagcactttggaaggccgaggtgggcggatcacctgaggttgggagtttgagaccagcctgaccaacatggagaaaccccgtctctactaaaaatacaaaattagccaggcgtggtggcacatgcctgtaatcccagctactcaggaggctgaggcaggagaatcgcttgaacctaggaggcggaggttgcagtgagccgagatcgcaccactgcactccagcctgggcaacaagagtgaaactcagtctcaaaaaaaaaaaaaaaatttagccaggcatggtggcgcacgcctatggtcccagctactctggaggctgaggcaggaaaatcactggagcccgggaggcagaggttgcagtgagctgagatcaaggcactgcactctactctgggtgacagagcgagactccgtctcagaaaaagtaggctgtgtgggtttgggagcacatcgggaaagatgaaaatacattagagcttagcaaaggaagaggccctagtgaggacttttatccttttctttgccaaataaaatacacttggtttgttgggcaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacaggtcgtctgttgtgactagttatttgtctgcctttttccaagaaaagaattttgatggctttgagttaaaggataagcatatagttaataaaatagaaattgatggctgttgaaaggaggtagcagatcttctaacactctggttgcttttttgaatttggctgccaggaagtttaatgtgattgttggatatcttctatgagttgtaggaaacttagcagctggggttttcttggccagtcatgccaactgtggctaggcctgttacagttttggtttgctgtccctgttgctgtcaataaatatcagggcctttggaattcagaatggtctcattctctatgtatatgtcttttccagggatggactcaaactggtgggtgcttaagtctgattttcgtttaccaacggaagaagagatcagagctatggtgtcaccagagcagtgctgtgcttattatagcatgatagctgcagagcaacgactgaaggtgaacaccttcctcttagacaccacttatgcctgtggttttttgtttttttttttcttccccccagagagatgagagagaagattctttctctgactggcttagggaggatggtttactagattattaccaattactaaaaagttcaatttgtataaagtacttctacgtacatcagttctggagaaaaactatagtgtagctaagtatcagtgggaaggcataatgaggaactttgggcatattgttttgctttgaaaatggtgactgggtgactttaatctcttctttgcaagataagcatataagcagggaaagtacttgtcagcctctcaggtaggcagagatgatgatggtgctgaatgtgtggtttagagaagcacagaattcttataaggccaaaagagaaaaggtccagctgaggtgtgacagcacagctctgtcccactgagttaatgagactcagttattgagcatctctgttcagcttgcttatgggctgtaactatctgtatatcagctagtaagctccttggcatgttgtaatgtatcttatagcttaaggatgtgccgtggtgttagatatagtgaagactttatggaatccatctatgcaaaatagactttggtattctgtacttgtattcagtaaaaaaaaaacttgtgctttgtgttttttaactgactgatttatgcatggatctgtcctcttccaggatgctggctatggtgagaaatccttttttgctccagaagaagaaaatgaggaagatttccagatgaagattgatgatgaagtaaggctttatactagtttgtattagtcattaatacatctcatttatccttttaaaagagacagctttattgagataacataaaataaactgtacacatttaaagtatactgttagatgttcttgctttattcatgccagaaaaaatgatgcgatatatcaaatattatattttatatgatatgggtttgtttttttttgtttgttttgttttttgacagaatcttgctctgtcacccaggctggagtgcagtggtggcatgacctcgactcactgcaaccttcacctaccggggttcctgcaattctcgcgattctcctgcctcagcctcccgagtagctgaaattacagttgcacgccaccatgcccagctaattttttgtatttttagtagagatggtgtttcaccatgttggccagactggtcttgagctcctgacctcaagtgatcctcgtgccttggcctcccaaagggctgggattacaggcatgagtcactgcacctggcaggattttcatttcttctagaaaaaagactttgacctgatttataagacttcacatgatttgggccttgcatattaatctgacctcctttcatctcctgtcactgcctgtcttatattctaagctccaaccataccgaagttcattcagtttcctaaatttctcttccctttcagaatttttcagttatgtcttctactgagatattttttctccactcctctgccatttgactctcatctacaagttattttctctgggaagctttcctggacttttcccctcattccaccctggatttcgattggatgataattctcctttcattatgtacatatagtacccctttacttttttctttcccaagatagggtcttgctctgttacccaggctgtaccgtggtgagatcacagctcactgtagccttgaactcctgggctcaagcagtccttctatctcagcctcccgagtagctgggacaacaagcacacaccaccacacccagctaatagtttaaattttttgtagaaatgtctcacggccgggcgcggtggctcatgcctgtagtcccaacactttgggaggccgaggcgggcagatcacctgaggtcaggagttcgagaccagcctggccaacatggtgaaaccctgactctactaaaaatacaaaatgagccgggcgtggtggcgtgcgcctgtaatcccagctacttgggaggctgaggcaggagaatcacttgaacctgggaggtggaggttgccgggagctgagaccacgccattgtagtccagcctggactaaaagaacgaatctccatctcaaaaaaaaaaaagaaagaaagaaatgggatcttactgtgttgcccaggctgattttgaactcctaggctcaaacgatcgtcctgccttggccttctaaagtgttgggatgataggcatgaaccactgtgcctggcctctactttcttcccgtggcactgatcacatagtactgaacttggttggctgtttttccctcactaacttgaggttcatgaaaaagtagtatggaggagtagtgtgtagttggtattcaataaatatttgttaaatgaattaagtgattataaaatgaagcagaaaatgaggccacacagagtgagtaaagaatcgttgtactactctcttgaggttggaatgaaaaatgagtggatatctaagaatttcagaaattaagaattcttttgaggccaggcgcagtggctcaggcctgtaatcatagcatttggggaggccaaggtgggagggttacttgaggccaagggttcaagaccaacctggccaacatagtgagaccctgtctctaaaaaagaaaaacaattttttttaaattaaaaataaaaaaagaattctgttgaatggctttccagattgaaccttagagaatggccattttcttgctaatcatatatactctttttttttttttttttgagacagagtctcactctgtctcccaggctggagtgcagtggtgcagtctgctgactgcaacctctgcctgctgggttcaagccattctcgtgcctcagccttctgagtagctgggactataggtgtgcgccaccacgcctggctaatttttgtacttttagtagagatggggtttcaccatgttggccaggctggtcttgaactcctggcctcaagagatctgcccgcctcagcctcccagagtgttgggattacaggtgtgagtcaccacacctggcctcatgtactcctgactggtctgtgtgggcaggcacattcaccccttggcttaattctttaagaatcttgcaggggttggtaaacactattcagggtcccaggagaggacagacctttttgaccaaaccagtggcagaaatagaatggactttggtttagtgtcactggaaaaggggccaatgctttgaaagcaagcatgtcaagtatttcgagaaaataggtttcattctaaaacagctgtttgagcaattggacaatcaaatgtagtcattagtctaattttgagcatcatgagggtgagggaaacactgtccttaagaatgtttattgaagcccaagggataaggggctgaagggataccactgttctttatttttctccttatcctgcctgagctcttgacctctatttaatatcatgttgtaagtattgtaccataggatagaagagaactgagtactaggtagctatatttaactgttgatttttgtggacagtttaagagagcatgaacccacagaaattaaaaattagaaaaaaagaacatgaaaatagtttgtaattattctactcttgtagatattggctagacatagaacaaatgtttcccactgccctgagaatctttttctttatctcaggttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggtgagattgtgtttatttctagaatgaaaaagtcaagggagaaagaaatgggtgagtggaggacttggaatgtagttaaggtagcagaatgacttagatgcctacttaaaaggaattcaggtttttaggagtctcacttttttttgtttgaggtaggatgataaagaaccgcagccagtgaagaagacagtgacaggaacagatgcagaccttcgtcgcctttccctgaaaaatgccaagcaacttctacgtaaatttggtgtgcctgaggaagaggtgagtgtggaagtggaaaatttagagtatactaggggctttgtatagagttggaattgctaggaggcagatgtaaagaactatctggggaactttattgtagggtatagtaagctaagtcttagatattgttttaggagttatctttctatgtaatctgctttggggtgatttttcttttttggtctaactgtgtacattggcttgtcctttgaaatccctgaatgatttttgtgtgtgtgtgtgtgtgtgtgtgtgtgtgtgtgtgtgtatatttatatttgtgtgtggctatttgtctcgtagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaagtgggtcgttttagtgctgcagaaaatccaagctggaaagggggaggagttccaggcactatttcataataaagaggaggtcacctaaaagtttgactacctaggtagtcagatatctgacatgtcagggtagtatatgtttgtaatcccaccaccagattacctattcccttcaacccaacttggcaaaatttttgaacagaaggaaacgctagtcttgtgttctaggttccatgacaacttttatggcctacttgggcctaacaaatagcacaatggtagcaggtgacaggtagggcttttttctaaaggtttagttgtgagaggatgttaatacactattaaaaatgaccagtgtgctgatttatttatcaagttgtctccaggaattctgaaagagttactacaatttttcaaacttatcttgttgaccaaatgtctaggaaaactttgtaaagcttttctgttaagggccccatgtcttagtggattttgagtatgcctttttaaggttgatttcccaattttttacttttgcctgcaaccatatttctttagttctttctgcacattgctttttctctttttagggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactgggtgaggatcttggcttcacagacagataaaaaagagaagggttaaaaaaggagcctacgtaactgcagactgtaattgagggagatctggaggcagaagatgtaagggatgcatgtagaaaagtctgtgaatgaagtagaaagctttttacaaactggactctaggattgtctgtggaggaccaattgcagagatgatgccactccactaactgcctctgtatcaggtgcctggccaagcctgggctattagtgctgtacttcaaatgagctttttgtgcatttatcctagagggtaagagtttttaatacagaatttgtaaatgaatttagggagttatctttgaaacttctgaaattacatgtaaaatatgtaaatgtgcattttattatttttttattttggagacagggtttcattctgtcacccaggctggagtgcactggtgtgatcttagcttactgcagcccccgcctcccaggctcaaacgatcctcctgcctcagcctcctgagtagctgggactataggtgcatgccaccatgcctggctaatttttgtattttgtattcctcctgcctcagcctcctgagtagctgggactataggtgcgtgccaccatgtctggctaatttttgtattttatagaaaatgttgcccaggatggtgtcgaactcctgagctcaaagtgatccgcctgcctcagcctcccaaagtgttggcattacaggcgtgagccactgcgcctggccttaaatgtgcattttctgagaacattcatggctttcagaagaccctcagaaggagtcttagaccataaaaagagttttaaaattgtagaaattgagggtgggaataataaagacctgaattgggttgggatatggagggcattaaggatgaaaatcaaggcaaccttaagatttcactctgggattactagaaagatgttggtaccattgattaaagtagtgaatttcaaggtctgacatgctggctcatgcctgtaatgctagcactttgggaggtcgaagtgagaggatcatatgagccccggagtttgagaccagcctgggcaacatggtgaaaccctgtttctacagaaaatacaaaaattagatgtggtggcaggcacctataattccagctactcgggaggctgaggtgggaggatcgcttgagcctgggaggcagaggttgcagtgagctgagattgcgccactgcattccagcctgggtgacagggtgagaccctgtctcaaaagaagttaggaagggaatgtgtaatatgtggagtttgaggtccctttgacacccttgaagtatacatgttaaagaggcagttgaaaacttggttgttgatactgcgagagaggataaaggctgatgatgaagatttatatggcttctcagtcacagtagtcttccctttgtttcctcttttctgtaaaagttttgtgtaatttcattgttttgggtcctttgtaaaaatgtgatatagcccttccaccaatgtggtcatctatgttttctagtatagtcctggaacacagtatctgtatcatttgggaattagaaatgtggaatctcaggcctcactccacatctactaaattagaacctacatttgcagccgggtgtggtggctcacacctgtaatcccagcactttgggaggctgaggcaggcggatcacctgaggtcaggagtttaaaaccatcttggccaacatggtgaaaccccatttgtacaaaaattagccgggcatgatggtgggtgcctgtaatcccagctacttgtgaggctgaggcaggagaatcgcttgaacccgggaagcagaggttgcagtgagctgagagtacgccattgaactttaccctgggcgacagagtgaaactccgtctcaaaaaaaaaaaaaataacctacatttgaacaagatcctcaggtgattcctattcatattaatgtttgagaagcttatgttaggctttaagactcggaacttgttttttgtagtgccattttcccccccgagttgcgtgcttgggtactttttttttttttttttgaaacaggacctcattctgttgcccaggctggagggcagtggtgcaaccatggcttgtttactgcagcctcaacctcctgggctcaagggatcctcccacctcagcctcctgagtagctgggaccacaggtgtgtaccaccacacctggctagttaaatttgtagagacagtgtcttctctgttgaccaggctggtctcaaactcctgggctcaagtgatcctcccaccttagcctccccaaatgctgggattataggcatgagccactgtactcggccttgtgtgcttttatctgtaatgtgatcatcacccacttcctacatggtcttttctcttgcactgttgttcagaggaatctgcttctctatctcctatagcaaacatgtagttctttgaggttttttcagaactttttgtacttacaaaagttgggaaattggccaggcgtgtggcttaggcctgtaatcccagcatgttgggaggccaaggctggcctatctcttgagcccaggagttagagaccagcctaggcaatgtgacaagaccccgtctctacaaaaatttagctgggtgtggtggtacacgcctgtagtcccagctactcagaaggctgagctgggaggatggattgagcctgggaggtggaggttgcagtgagccgagattgcaccactgtactccagcctgggcaacagagcgagagagatcctgtctcaaaaaaaaaaaaaaaaaaaaaaaagtggggaaattggcagtgcctaaaatgaagtcaggaaaggacaaatcagcatattcttggggctgatgatgactttgatgctttttgtagaaccatagttttgtggcatgttgaactttgatagctccactcaatcccaagaaaatgatcatttgggagataaggggaacgtttggaaatcttttctacctaccttgcagcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcatgtgagtttgatttaccacttccttttttttctttgaggacagagtcttgctctgcggcccaggtggagtgcagcggcgtgatcttggctcattgcaacctccatctctcaggttcaagtgattctcgtgcctcaacttccagagtagctgggattacagacatgcaccaccatgcccagctaatttttgtatttttggtagagatggggttttgccatgttgaccaggctggtgttgaactcctgggctctagcaatctgcgtgcctcagcctcccaaagtgctgggattacaggcatgaaccacggcacctggcctgattcaccactttcgagtgtgatagggagaatagtaataatggtggggaatggtgattggggtgggtgcttgaattttagtgacaggattcttcacagttatttctagaactctgctgtaattgagaactatcttgcctttagattgggtttgaatagagccaaattacagggaaaattctattcggtatttgccacgagatgaaggcatgttttgttccattttggtcctttgcattttgattggttggtttgcaaaaatcttagagattactggccgggcgcggtggctcacgcctgtaatcccagcacttggggaggctgaggcgggcggatcacgaggtcaggagttcgagaccagcctgaccaacatggtgaaaccctgtctctactgaaagtacaaaaattagctgggtgtggtggcatgcacctgtaatcccagctactcaggaggctgaggcaggagaatcgcttgaacctgggaggcagaggctgcagtgagccaagatctcgccactgcactccagcctgggcgacagagggagactccgtctcaagaaagaaaaaaaaaaaaaaaccttagagattactcaggacttattctaagagagttacctctgcaaatggagggctgactagggagggagatgggaatggcatgtagccccttttatcttagcctggatggattactttagtcctgagatgttagctatcacgatagtcttcttggttaaggtttgcttatggtcctgtgatttttcttcctctgctgctcacactgttcagtcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaagtaagtataatgtggtgtgattacagctaacggagcaaaggaagaatgtataccttttcctttagcttttgatatcctcctttactgggaatgagggaagtatattgtggaaagctggtttgaattgatgtgactacttgggggtgttctcaatactaatgtgagtggtattgacaattccacaccaaatctggtgctattgttctctctctcttttttttagacagggtctggctctgttgcccaggctggagtgcactggcatgatctcggctcactgcagcctctgcctcctgggctcaagccatcctcctacctctgcttcccaagtagctgggactacaggcacgtgccaccacacccagataatttttgtattttttgtagagaccgggttttgccatgttgcccaggctagtctcaaactcctgagctcaagtgatcctcccaccttggcttcccaaagtgctgggattgcaggcgtgagccaccatgcccggcttgtcatttattctctttttttttttttttttttttgaaacagagtctcactctgttgcccaggctggagtgcaatggcgcgatctcagctcattgcagcctccgcctcctgggttcaagcgattttcctgccagagcctctcgaatagctgggattacagatgtctgccaccatgcctggctaattttttgtatttttagtagagacgaggtttcaccattttggccaggctggtctcgaactcctgacctggtgatctaccagcctccacctcccaaagtgctgggattacaggcataagccaccacgcctggcttgttatttattcttttttttttttttttttttttgagacagtgtctcactctgttacccaggctggagtgcaatggcgcaatctcagctcattgcaacctccacctcctgggttccagcgattcttgcgcctcagcctcccaagtagctgtgctaccaggcatgtgctaccatgcccagctaattttttttttgagacagagtttcgctcttgttgctcaggctggagtgcagtggcgccatctcagctccctgcaacctccaccttcccgtttcaagcggcaatcctgcctcagcctcccgagtagctgggattacaggcgcccgccaccacgcccagctaatttttgtatttttagtagagatggggtttcaccatgttggccaggctggacttgaactcctgacctcaggtgatctgcccacctcggcctcccaaagtgctgggattacaggcatgagccaccatgcctggccttattctttatctgaaatattttctaggagttgagataggtttggtaggtttttttttgtttgtttggtttttttagagacagagtcttgcttaatcgctcaggctggagtgcaatggtgtgatctccacttactgcaacctccggcttccaggttgaagagattttcgtgcctcagcctcccgagtagctgggattacaggcgtgcaccaccatgcctggctaattttttgtatttttagtaaagacagggttttactatgttggccaggctaatctcaaactcctggcttcaagtgatcctcccaccttggcctcccaaagttctgggattacacgcatgagccactgcttttggcccaagtttggtaggttttttaacatgtactttcatgtctgttgtctgtgtgtatatatttttaaatatgtacctttaaaatattgtacatattaaaagaagcaacaaaagtaaaacatacaagttgttttccataacttaggatcacagatactactgtgattgtaataagcatcctaagatgaggcagttgtggtacagtggaaagagccatgagcttggaaacggaagatctgaattcaggttctgtttctgccatttaataggtctgtgaccttaacctctccaaacttgttttctctaatatcaaatgatatgtccacagtgttgttgtattaaatgatataattcaggggaagcactttataaactataaaatattcaacaaatgaaactgttcttaatgcatactgaggtcattaagtgttttaatgttcctttttgtatgtggcattagataagtgtgatacagtattggccccattttacagatgaaactgaggtctaggataccagagctactcatttgcaaaactgagatggagacttggtgtcatcgaacctttttcttgttttgactagagaatgggaatacacccagcaggctgatgatgctgctgaatgtagatgggcttccaacagcttgtctcctgcatatttaatattttcatagtttacaacttaaattgggagtggaaatcttctctttattcttcttacctgatttttaaagcaatgtttagtctctggatttcattttttttctatgtgtcatttccatacatgcagatttgtctagtggcttctggttgatcagtgcataacaattctattagagcaaaagttctgaagctgactttgtttttcccatcttgtatgtacagttgagctttgaacaacataggtttgaactgcatggttccacttatgcgtggatcgtggtacgtggagcctgtgtatatggagggctggctttttgtatatatgggcttcactatgtgtggattttggtatacttgggggtcctggaaccaatcccctgcatatactgagggatgactttatttcttacctgcttatctctgatatgtgtttcagcctacttacctctgacgtgtttgatacttttccttttgcagctgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagaggtaagagataccaggcaggaagtgctatgggacagatttatttgaggttggttatattggtggctggcaggggtagatgtgatgtgttctctgaagtggaactgaaggaacaggaattttgatggcgtttcctcagttattgttgccagtaatgaaaattatagcgctgattaggttgtaccacttgttttggagcatgctgcctaacttctgagtctgtttccttagttacaaaataaaaccacctttaccaggatagttaagaagataaaatgagacagactacaaagcatacagtacagtgcctgacatatagtagatgtcagttatctcttcttgttctacttctagacacttataatatttgcaaggtccctaatcttgttgtgttttttttgagacaaagtgttgctctgttttccaggctggagtgcagtggctcactgccacctctgcctcctgggttcaagcgattctcacgcctcagcctcccgagtagctgggattacaggcgcacgccaccacgcccggctaatttttgtatttttgtagagatggggtttcgttatgttggccaggctggactcaaaactcctgacctcaagtgatccgcctgcctaggcctcccagagtgctgggattacaggcgtgctgggattaccatgcccggcctaatttttgtatttttagtagagacagggtttcgccatgctggtctcaaactcttgtcctcaagtgattctcccacctcggcctccccaagcgttgggattacaggcgtgagccatcactcccggcctcgtagtgttctaataaaggaccatcccaaaagatggatgagacatagaaactgtgcttatacttgtgtcttgccctcagagagtttaatagataataaaatggagaagttgtaaagttctttcccctaactttttagtttgaaaatggcaaaacctacagaaaagttgaaagaatataatatataattcctctaaattcactaattgttaacgttttgtcacatttgcttcatctttatatacctaaaacttttttttcctaaatcatttggaactaagttgcaggcatcatatttcactcctaagaaagttaacattaatgtaataatatataatattcaggtctcatttagtcttccctagttgtctcagtgtcttttattgcttccgtccccagttctggattcaatcccagttcaaacattaaatatattttgaatctctcttaatctagaatgattttccctaccttttatgttttccttttcttttctttcttttttttttgagatagggtctggttctattacccaggctggagtgcaggggcatgatctcagctcactgcaacctgcgcctcccaggtttaagttatcctctcacctcagcatccggagtagttgggactacaggtgtgcagtaccacacctggctaatttttgtattttttgtagagacaggattttgccatgttgcccaggctggtctcaatctcctgggctcaagcagtcctcctgcctcagcttcccaaagtgctgtgactacaggcatcagccactgcacccagccccatttatgtttttcatgacattgaattttttgaagattccaggccaattgcctcaaaatattccatattctggaattgtctgttctctcattgatcagattccaattaaatgttgttggcaagacatttaatgtcatatttaggtgatatgcttactgtactatatcagcaagcacataatgtcaggttttcccactgttttgatcatcttgttaaagtggtgatcctcagatcctataataaaatatgttttttctttataattaacatgttgatgaatatcctgttccctgacaatcttttaatagttttagcatcggttgatgaccattgctttattcagttatttcagtgggggttccaaaatggtaatttttctaattctagcatttcttcaacattagctaacatttttctataaaaaagagctttctactctccctttccaagtattactatggattctgaaattctttcctttggaaatttaatgttttataattccttaacataattaattttgatgctcacatagtgtcccaaatttgactccctcaagccagatcctgtgttttttttttcttttttttttttttaatgaccctataaatatttgagaacttccttgctttctggcacaagatgtttttgtgttttttctcgagacagagtcttcctcctttgcccaggctggagtgcggtggcgcaatctcggctcactgaaacctttgcctcccgggttcaagggattctcctgcctcagcctcccgagtagctgggattacagacctgtgccaccacacctggctaatttttgtgtttttagtagagatgggttttcaccatgttggccaggctggtcttgaacttctgacctcgtgatccacctgcctgggcctcccaaagtgctgggattacaggcgtgagccaccgcgcccagccttctggcacaagatgttaaaagctctctttcaaattttcctatcctatatacctagagtcggccatttctccaaaagcccaggttcctttttctttttgagacggagtcttgctctgtcacccaggctggagtgtggcacactgtaacctccacctccccagttcaagcagttctcctgcctcagcctcccgagtaactgggactacaggcacgtgccaccttgccctgctaattttgtatttttagtagagacagggtttctccatgttggtcaggctggtctcgaactcccgacctcaggtgatctgcccgcctccacctcccaaagtgctgagattatagacatgagctaccacgctcagctggtatacatatattttaaattacaactttatactgatacctccaatttagtttatagatctttttttctcatcttcccttatttcatatttgtatccattctcaagaaataacttaatttctgtatgtatttacttagaaatcaatatatttattgagaaatttgctctgtcctatgatatgtacaaaatagtttcagaattactataataataccactaccaccaacaaacccataaagtaggttcaagatggtttttgtagtttatttttcttggactacatgccactgaggtatagttaggttattccaaactttttttttttttttttttttttgagacagagtctcgctctgtcacccaggctggagtgcagtggcgcaatcccagctcactgcaacctccgcctcccaggttcaagagattctcttgcctcagcctcccgagtagctgggattacaggtgcccgccaccatgcccagctaagttttttgtatttttaatagagacggggcttcaccaggttacccaggctggtctcgaacccctgacctcaggtgatccacctgcctcggcctcccaaagtgctgggattacaggcgtgagccaccatgcccggccttccaaacatatttgaatcacttctttttttgtgtgtaatttaagaaatcaatttgatacagttacagtcatttatgtgtttgttttcagttttgggttccttttcccatccttgttgatttattttatatgcccaggctggagtgcagtggtgcaatctcagttgactgcaacctctgcctcctgggttcacgtgattctcctgccttagcctcccaagtagctggtactacaggcacgtgctgccacgccaggctaatttttgtatttttagtagagatggggtttcaccatgttggtcaggctggtctcgaacttctgagctcaggcaatccgcctgcctgggccttccaaagtgctgaaattacaggcgtgagccactacacccagcctccatccttgttgatttaattactaatatccgtaatagtcattgttttttgaaacacattagaagaggaagatgggccggacgtggtggctcatgcctataatcccagcactttgggaggctgaggtgggaggatcacttgagctcaggagtttgagaccagcttaggcaatatagtgagaccctgtctctattactgaaaaaacagtttttaaatttaaaaaatgaagaagaaaaaatgtgataccatggtcccttatagtggaaaagaagaaggtgaatgagctttaatgattgagggaagcccaaactagtttgttttctgttttcaaaccagtttttaatttcttgtttccattctgaacctagccttttaacatttaagatagaatgttggggctgggttcgatggctcacacctgtaatcccagcactttgggatgccaaggtgggtggatcacttgaggtcaggagttcgagacccgcctgaccaacatggtgagaccctgtctctactaaaaatacgaaaattagctgtgcgtggtggtgggcttctgtaatcccagctacttgggaggctgaggcaggagaatcacttgaacctgggaggtggaggttgcagtgagctgacattgcgccattgcactccagcctgggtaacgagcgaactacatctcaaaaaaaaaaaaaaaaaaaagagaatgttggaactagaaggattcttaaaattctttagtctggtttccttatcttcccaataggaaactgaggtaaaattgtgacttgcctagttatttattaacttggagagcctatgagggcttgcctgatctgaaccttagaaggtggatgtttggcctttggtttggctttttcctcgctaggctcgtgcttaggtaccttggacttttttttaattatagttgctttttttccccctgggaactagaaataggggctgtatctaactaaagtgttttgattttagtgcggatgaggttcgcagaaaatctctggttctcaagtttcctaaacagcagcttcctccaaagaagaaacggcgagttggaaccactgttcactgtgactatttgaatgtgagtatgtgcattgcttccttctgattaggtaggttatcattgattccccagccctgtatgccacagctctgacagccttagattctccagttgccttgccctgagaattatttgtactgttcattataagatttctaaaatatgtttgtctagttagagaaagtggatttttttttttttttttgagacggaatctcactctgtcgcccaggctgaagtgcagtggcacagtctcggctcactgcaacctccacctcccaggttcaagcaattctcctgccccagcctcccaagtagctgggattacaggtgcacaccaccacacccagctaatttttgtatttttagtagagatggggttttgccttattgaccaggctggtcttgaactcctgacctcaggtaatccactcgctttggcctcccaaagtgctgggattacagtgagccaccgtgctcggcagatttttttttttttttttttttgagacagagtctcgctctgttacccaggctggagtgcaatggtgtgatcttggctcactgcaccctttgcctcccaggttcaagtgatcctcctacctcagcctcctgagtagttcagattacaggcacatgccaccacacccagctaatttttgtatttttagtagagacggggcttcaccatgttgcccaggctggtgttgaactcttggcctcaagtggtccacccacctcagcctcccaaagtgctgggattacaggtgtgagctactgtgcctggacagaatgtggattttttttggtctgaggaagcattctgatttcacatttctccttagagacctcataagtccatccaccggcgccgcacagaccctatggtgacgctgtcgtccatcttggagtctatcatcaatgacatgagagatcttccaaatgtgagttcattgcattggatatctatagtagggatgtcaaggccttttgttctgtctgtgatttccaatagagggcagtaatctgtagatttaggtaactggaatgcctaatttttagggagttagttttttttgtttgtttgtttttttaagcagtttagtagaggaaacagacgtgctccatctagaaagattcctttcagtgttgatagccaggtagataggtaagatgtgaaagtcttcaggaattggctctggcaactgttatttgctgatgtatggttctggcccttgtttgcagacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatggtaagaatcaaatgttccgtgattgcaaaggtcactgttcagatccttattccttactggccctaaattcagactagattggactgagaggactacagtgtatttgtgcattcatttgtgggtatgaaaatcaggtaatgtacattttcagtcatttaataaatatcacttctttttttttaaggagggggttggagtctctgtcatccaggctggagtgcagtggcgcaatcttggctcactgcaacctccgcctctcggttcaagcgattctcctgcctcagcctcccgagtagctgggattacaggcatgcgccaccatgcctggctaatttttgtatttttagtagagactgggtttcaccatgttggtcaggcttgtctctaactcctgacttcgtcatccacccgcctcagcctcccaggattacaggtgtgagccactgcgcccggcctaatgtcacttctttttattcccactgtttaattcttatatcctttggagaatttggagtctattcgttgcaatgaaacagttccatggaaagtagtggaagacgtggtcctaggttagtacaaaagagagacattcggctgggcgcggtggctcacgcctgtaatcccagcactttgggaggccaaggcaggcggatcacaaagtcaggagattgagaccatggtgaaacccccatctctactaaaaatacaaaaagttatctgggcgtagtggcgggcgcctgtagtcccagccactcgggaggctgaggcaggagaatggcgtgaacccaggaggcggagcttgtagtgagccgagatcgtgccactgcactccagtctgggcaacacagcaagactccgtctcaaaaaaaaaaaaaaaagagagagagacgttcagtgtggatggaacctgtgtagagtatgcgcttgtgaccatatttgctgtgtctgaatcttcgatttggtctacaaatttgttagaggtgctgttacatgttcactttgctcaaaagctgagaagacaaagaggaagaaatctgtttgtcttttttttttttcccttgtgagacaggatttcattcctgttgcccagtagcctcctgagtagctgggactacaggtgctttccatcacaccctgttaatttttgtacttttttggtagagatggggttttgccatgttgcccaggctggtctcaaactcttgagctcaaccgatcttgcccacctcggcctcccaaagtgctaggattacaggcatgagccattgcgcctggcctgttgctgtgtcttaaaaagaggaaacagtatagcttctgcatgtaaaggataaggttttctggtttccatttgcatccttgagcacagattcacagatataaatgtagggattcggagtacagatagagtgtaaatcatggctctggcacttactaattgagttaccatagacaagttatttaacttctcataccctcctcagttttctcatctgtaaacatgggatagtagtactacgtgaattttaaaacctttcacaagcaggcccaacccatttatctactttccatctccaataactggctcccatacccactatcgacccctgccacactcagcattatatttcacaaaatatcccttatcatttcttcatgactttgcagtctttgctctctcagtctttgctctctttctgggatgcctttcttccctatatttccagaccaactcatattacctctttttatttttttttttgagatggaatcttgctctgtcgcccaggctggagtgcagtggcgccatcttgtctcactgcaacctcctcctcccaggttccagtgattttcctgcctcagcctcccgagtagctgggatcacaggcgcccaccaccacacctggctaatttttgtattttcagtagagacgggatttctccatgttggccaggctggtcttgaactcctgaccttgtgatccacccaccttggcctcccaaaatgctaggattacaggcatgaaccaccgcgcccggccgcattcttttctttatttcaccataagaaatctttaaaatggatactgttataaccctcattttccagatgaacatacaggcccgtagtgtttaaatagcttaaaaaaatttattttttttatgatgaggtgatgggttgatgtgtgcagcaaaccaccatggcacacgtttacctatgtaacaaatctgcacatcctgcacatgtactaaaaaaaaaaataaaagaggaagatgactttacctttaggggcatttcttttttctttttttttttttttttttttgagacggagtcttgctctttgacccaggctggagtgcagtggcgctgtcttggctcactgcaagctccgcctctcaggttcatgctattctgctgcttcagcctcccgagtagctgggactacaggcgccagccaccacgcctggctaattttttgtatttttagtagagacagggtttcaccgtgttagccaggatggtctagatctcctgacctcgtgatccactcgcctcggcctcccaaagtgctgggattacaggcatgagacactgcacccggccttttaggggcatttctaatctacatttgtgattttctttttttggagatggagtcttgctgtgtcgcccaggctggaatgcagtgctgcgatcttggttcactgcaatctctgtctcctgtgttcaagcgattctcctgcctcaccctcctgagtaactgggattataggcatgcaccaccacaccgggctaatttttttatttttagtagagatgaggttttgccatgttggccaggctggtctcggactcctgacttcaggtgatctgccctcctcagcctcccaaagtgctgggattacaggcgtgagccactacacccggctgattttctcttttgaagcagtctcactctgtcacccaggctggaggagtgtggtggtacaatcttggctcactgcaacttcctccttttctgggattcaagcgattctcctgcctcagcctcctaagtagctggaactacagctgcgccccaccacgcctggctaatttttgtatttttagtagagacagggtttcaccatgttggccaggctggtcttgaactcctggcctcaagcgattcactgaccttggcttttcaaagtggcgggattacaggcatgagccaccactaggcttaggcatgagaatcacttgaatctgggaggtggaggttgaagtgaaccaagatcgcaccatggcactccagcctgtgcgagagagcgagactctgtctcaaaaaaaagaaaaaaaaagataaagtagagatgttaatccagttatatctaacgtcagagcctgtactcttaaccaccatgctccatatactgttctccactttttcacttactgtttatgcctcacaaccctgcacttgtcttctgctgaagtaccagctacatcctaattgctggatccactggccacctttcagaagtaaccttttatttaaacacctttattgaaatataattcacgtaccatgcagtttaaccatttaaagtggtcaggttttttgtttgtttgtttgtttgagatggtgtttcgcttttgttgcccaggctggaatgcgatagcgtgatctcagctcaccgcaacctccacctcctgggttcaagcgattctcctgcctcaccctcccaagtacctgggattataggcatgcgccaccactcccggctaattttgtatttttagtagagacggggtttctccatgttgttgggctggtcttgaactcccaacctcaggtgatctgcccgcctcggcctcccaaagtgctgggattaaatcaggcatgagccaccacgcccggctggctaaagtggtcagttttaacatgtcatccatattgtaacatgtatcagtacttcattcctggttttttttttttttttttttgagacagggtctcactgtgttttccaggctagagtacagtggtacagtcatagctcactgcagcctcaccctctcgggctcaaggaatcctcccgtcttagcatctcaagtagctggaaccacaggcgcatgccaccatgcctggctaatttttattttttattttgtagagacaagagtctcactatgttgcccaggctggcctcaaactcctgggctcaagcgatcttcctgacttggcctcccaaagtgctgggattacaggcatgagccattgtgcccaacctcatttttttttaatcatgtaatactccattgtatggatgccccacattttgtctgtcaattgatggacctttagattgtttataattttggctaatgcaaataatgcatctgtgaacattttgtgaacatttttgtacagacttgtgtgtggacatttggggttttttttgttttggagacagagtcttgctctgttgcccaggccggagtgcagtggcacgatctccgctcactgcaacctccacctcctgggttcaggcgattctcctgcctcagcctgccaagtagctagggctataggcgcgtgccacccacgcctggctaattttttgtattttaagtagagacggtttcactgtgttagccaggttggtcttgatctcctggccttgtgatccacccgcttgggcttcccaaagttccgcgattacaggcatgaaccacgcatttgctttttttaattttaattttttttatttgtcaggcaagtaagacagttaagggacacttgtttttatttctcttgggtatataaagatcgagcatcccaaatccaaaaacttgacatgctcaaatcttaaactttttgaatgcctgcttgatgctctaaggaaatcctcattggagcatttggatttctaattttcggattagggatgttcacatatttgcagatattccaaaatatttcagattcttaaaaaacctgaaatctgaaacacttgcggtcccaagcatttcagataagggatactcagtctgtacctaggagccgaattgctgagtccacatggtaactcttatgtttaattaactttttgaggaactgccaaactgtttgccagagcagctgcaccattttgtaatcccaccagcagtgtataagggttccagtttcttcatatccttatcaacacttgttattgtctatctttttccttctaaccatcctagtgggtgtaaagtggtatttcattgtaattttgatttgcatttccctattgactaattatgctgaaaatttttgcatatggttagaaataccattcttgaacttttgtgcatttgccactattgaccactttttcctccttgatactgtcttctcccttttccagaaatactttctcgaatcatttccttgccttttcattctcattacttcagccataatatatctgttaacatcactatctccagccccatacctctcttcagggctccatacctgtgcttctagttgtctgccagacatgtccatttttcattgcccaactggcaacttattgtctgattgtctatctagttgtacatcctagaaatcatagtcataatttattccatcttcacttccccatactcatagataaccaagtcccataaattggaaattctaagttgccaatggaaaaacaaataacaaagatactggtctggggttaggagagtgttcgcagtcatcatactcctcttggccagcagtgtcccacgtgttcaggctaacgatttgcccatccacggatgtctggacgctataattgtcaaagacagtggggggatatactcctcaggaaagacatttgttgtataactgatgaggaggcaggttttacctatagcctcatctcctacaaccacacatttgattgtctgcattcttcccttgtagtcctatgtacaagagagacagaaagaatattcagagatgcttggttaatgtagggagctattctaaacatttctctctgaggagaagatgaggaagataagatgccccccacactctctatacccttaatgccatacaagagtcagctacaaagggttgtataagtcaagagttcttaccctggagtctgtggactactagaggatgggcttcggtaggtcctagaagcctcttctgaagttgtgtacaatactatgtatatgtgcataagtgaatttttctggaaagaaggtccagagctgtcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtatgctttccacaagcccactaggggttgctctctgcccacacagagccaattttgagtggcgaggcctcccacctagaagtcttctttagcacaggttccacagctaaaataagtccagagcataatttaactctggtaggaaaccaccccagggtattcactgaccatcagccggttctttttccatctaggaataggcataaggatcaaacacacaaggtcgatagaaaaggggcacagtcatcaccaccttcctcgagaatagccttctttgactttcctgatctggataaatgtatttcccctctgaattcctacaacaattactgtctgtgcaactcattttcccagcttcctctaggtatcatccagtgtccaacacctctgctcaaagtgactgcttccagaacaacagtgcaacttaggcagttgctgaaccagagtaaaactcttagggacaggccgggcacggtggctcacgcctgtaatcccagcagtttgggaagctgaggagggcagatcacttgaagtcaggagttcaagaccagcctggccaacactccaacctgagtgacagagccagaccctgtctcaaaaaaaaaaaaaaaaaaaatttcatattgaaacttaatgcccaaatgtggcagtattgagaggtggagttttcaagaagtgactggatcttgaggaccctgtcctcatgaatgaattaatccattcatggattaatagattaatgggttaatatgggagtggaactagtggcttcataagaagaggaaaagggacctgagcaagcatgctcagccccctcaccatgggattctctgagccacctcgggactctgcagagtttccactagcaaaaaggctcttactaattgtggcccctcaaccatggactgttcagcctccataattataagaaatttcttgttttttgtttttgagacagagtctcactctgttgcccaggctggagtacagtggcataatcacagcgtaatgcagtctcagtatccctgggctcgatgattctcccacctcagcctcccgagtagctgggaccacaggtgtgcttcagcacacccagctagtttttgtattttttttttcttgtagagacagggtttcgtcacattgcccaggctggtctcgaactcctgggctcaagcgatctgtccacctcagcatcccaaagtgctgggattacaggcgtgagcaaccacccccggccccagtaagcagatacagttgttgtaaaacaacttatagcatactgtgttgtgctgtcagcagtaaatgcatttatgatgttttccactcattatgtgtttattgggatgtaaccctatcataagtcaaggagcatctgtatctcatatgcagctcctccataattcatggcaaccaatatattcctctatttatactaatactctatttttaaaaaaaattatggaaattgttagacacatacagaaataaaagaggaagtaaacttcagtgctattcagtcagttcaacactttgttagcatatggtcaatctagtatatattttcagcttttgtattatttcatccataaatacttaaagcatttatactctgtcttgcaataatttattttcaagtcatttctttgactagaccagcaactatctttatttttttgttctattttttgagatggggtctcactgtcacctaggctggagtgcagtggcacaatcttggctcactgcagccttgacctcctgggccgaagcaatcctcctgtgtcagcctgccgagtagctgggactacaggtgcatgccatcacatccagctaatttttgaatttttttttgtagaggtgaggtcttactatgttgcccaggctggtctcaaactcctaggctgaagcaatcctcctgcctcagtctcacaaagtgttgagtttacaggcgtgagccactgtgtctggcctaagccaataagtctcataggcaggaagtctgtcttatttttccttatattcccatcattgaacacattgtacacagtcattaaacatttgttaaatgaataaacaagtgaatgctgaattaaataataagtgagaatagaactgacgttttggctctggggagcactaacacaaaaggatagacagaggaatacaatctagcaaaggatatgtaaaagaagtaattggaattacttgctagatgaaaatattttagctgctttatgatgagcttaaattagggcattcataagcagggagtgtaggagataggtcagatagttcaaggattttctgaagcttctgatagggatcagtatggagattttttttttttttttttttttttgagatggagtttcactcttgttgcccaggctggggtgcaatggcacagtcttggctcacgcaacctccacctcccgggttcaagtgattctcctgcctcagcttcctgagtagctgggattacaggcatgcgccaccatacccagctaattttgtatttttagtagagacggggtttctccatgttggtcaggctggtcttgagctcccaacctcaggtgatccgcctgcctcggcctcccaaagtgctaggattacaggcgtgagccaccacgcccagcccagagattcttttttaacataggcttgtattaacccgatgttattagaacaccacaaaccgtaaattctacaaacaaaagttgcaatcacaaattttatatgttaagtgtgggaaaattacaagtcacccatcggtctatttaggcattctttttctttttattgtattttcaaaaacaactttattcatcgcacgtattaaaaaaaaattcccacccctggaaatgagctaaaaaagtaaacaaaatccacctcccacctccctgttcccacttcctccaattcccaccaaataaaagggaaaaaaggcaaaggaaaaaaaaacaaaaacaaaaacacccctaaacccccaaaatcaaggtagtgcatttccccagggagaaggggaatttacactggagctgctaggggcggaacggagatcttccggctacagaaacctgcaaagaaagacactcaaaacagaaaaagaaacacaaaaggaaacaaaatagatcaccaggcaatctggaggggcagggagccggagaagaggggtggggtgggtggtagacctgactggacaggagctggcaggagaggactgtgaaaggttagaagacggagggaaggtgacaagcagaacagtttggtgtccttccagagccctggctaaaaaataaaaaaacctcctaccacccacacccacctacccttgagcagcccccaggggggtgaaatggggcagggaaacatggggagcagcttgctagttgagacgtgtccatggcgaatccccagagtgaataagcagcctcctgccccactccctgggccttcccctgctccctaaagcaggtccctcctcagcagttagttatgggattctcccccccttccacagtatatctttttaaaaaaatacttttttcccatcaaggtcatcttctgttttttgtttgtattttttttaattctttttttttttccccttctgtcctctttttttcttctctttcctcctcatactttttttagtaaggggagtaccatgatgtcgctctagcctggcctctgtagacgtgaccccggggcctgctgttaaaaccactgtggaatcgagagagggaactgctgtagttggtggtccgggcatggtagcgggctcctggaaaaccccgatctgttgtgctgattcctggtctgttggttcattttgggatcaccttgatttgccttcctctaaatagggagtcatctaaggccagggaagtcctcactgactctttgtctgagaactctatatatgcaaaccctttggaatggccactaaatttgtcacagagtatggtaacacggttgactgaaccacagccatgaaagtgagcttccagctcttctgctgttgcaccatagtcaacattgccaacatagatggaacgggcatcggcctccatcttctcctcaatgacatgatcactgggccagcatttcctggaggtggactcatactcatctgcttctctacctcgttctgtagctcctttagcttctcagcttcttcctccatctccctaactcgagctttgatagcttccagctccggatcctcaatggcgctgtcttccgggtcaccctcgaccagtcatggctcctcctcctcctcttggctgccaggggctcccgaaccaggcctggagctcccgtgggggtggggggcgcaaggccagggcggctcctcttcaggcttgggctccggctcggggtccagcggcagctcctcaggctacagttcctcagactccaggccgttcccgtagtcccctacgccccccggggccccctccccggcctccccaccggccccaggcacaagatggcgccaccgccctgacccggaggcctgaccgcctgcagccccagccgcccgctgccgcctgctcactctttaggcattcttaaagaaattattgctccccttccatagtattatgtttgaggtattaaaagcagcagtagtactactgtgtgtagatacacacaaggaaagagttaaagttagtttattcattcatattgtgtaactgctatgttttaggtgctggaaaatggacataagtctggtgtatctgtctaacccatcagttagcctggtgcctgacacattttaggttcttaagtaagtgcattaaaaggataaagaagtgttggcagcttttgcctcccgttattagtggtttcatctctttctgttcctctacagggccaaaacactcattgactcagatctctcaatccatgctggatctctgtgatgaaaaactcaaagaggtaagacagttagaatgagagaaaggcagtggaatttgaaggtgggggtgggatatcagggtttaggaagtagggaatttaacagaaggaaaaatatatgcgggagtagcagatctttagtatatgtgaaggctggaagggacttatagaactcataggccagtcccttttgtagatggaaaaactgggcccgtagaagaaaagtatttgctctggacatcttgactattaacaaagttagaattaagatccagcacctacataactcattagaaagggcaaaggaaagtgagtttccaggaagtcagctgtagctaagagaccagtcaatgttttaggaagaattttcattttttcttcatatttttaaccaaccaagcagcaagtgctagaagttttaatttttaaatgataatctatctatattccctcttcttactgaaaacaattaatggtactttataaacctacaaaagtgtaagtatgaagtagacatttcacaaaagaggacaactagccagtaaacacggaaagattctcaacttgattgattattgaggagatgcaaatttaaaccacgatgtcactacatacccactgcaaaggctaaaattaaaaagactgacaatactaaatgttgatgaggatttggagcaataggaatacaaactttttcctactagagtctaaaatgaatttattgggttaggtcccattacgcaaaagtcactaatcagtaataatgtttagtgtttccagcagtagttttacagcaaaaacagagagcatgatcttaaagcctaaattgctaaagatgtttttttgtgtgtgtggggagctatgatgttgacactcagggaagtataaattttggtgaaccagaagaatagaatgtagagtacctaaagaagttgttgacacatcctttttgacccttttactggaattttttttttttttttttgagacagggtctggctctgtcacctgggctggagtgcagtgggatgaccttggctcactgcaacctccgcctcctgggtttaagtgattcttggcctcccgagtagctgggaccacaggcgtgtgccaccacgcccagctaatttttttttttttttgtattcttagtagagatggggttttgccatgttggccaggctggtctcgagttcctggcctcatatgatccacctgctcggcctcccagattgctgggattacaggtgtgagccactgtgcccagcctggaatatcatttatcttgactttttgtcattccataggcaattcaaagttacactttctggggcaagggtaatagatagctagctgaacttaaattatccttaatttattttttatttatttattttttttgagatagagcttcgctctgtccacccaggctggagtgcagtggtgcaatctcggcttactgcaagctccacctcccagattcacgccattctcctgcctcagcctcctgagtagctgggactataggcgcccgccaccacgcccagctagtttttttttgtatttttagtagagacggggtttcaccgtgttagccaggatggtcttgatctcttgaccttgtgatccgcccgcctcagcctcccaaagtgctgggattacaggcgtgagccaccacgcccggcaaattgtccttaacttttctatggtgatcacaccttagggaaacctctgtcttggctttgctttgtttaatttcagaaagaagacaaattagctcgcttagagaaagctatcaaccccttgctggatgatgatgaccaagtggcgttttctttcattctggacaacattgtcacccagaaaatgatggcagttccagatgtaagctgtctctgtgccaaatactgtgaggatcgtgcaggggaaaggaaaaatgtttagggtgtacacgtgtgtgtattttggagagtctgagtggtggtgtatgtcagttgtgactggtatgtgattttaaatattgacctttttgctatatgggtacattatcttttttttttaagagtacattatcattgaaatcaaagaggccaggaatctttggatgtagggaggtttttgcttcctgttgttgacattcagtatatgaatgctcctgaatagccctgtagagagaggatgctagcgaatgtgaggcttttgatttagaggtgcttctaagcaaatgatgctttgataattagacaccattggttgtcttttatttcatttttatattgttacagtgatcctccccaggaattctcaacagagtttccttttgtactataggaatgtgttctatatgtgtaatgctataaaacttctcgttgggactagggaataaggaattttaattatgactatacagcaagtgtttttatcctatcatggcatagaaatccttaaaggaatctatgaaccccttacattataaacagaagttttgtatgattatgtgtttttctaggaaaagagtccatagctttttttaggaatatttgtaacccaacaaaggtggtgaaattctcgtatgaagagtggtttccatttaatttcttatgctttctatttactagtcttggccatttcatcacccagttaataagaaatttgttccagattattacaaagtgattgtcaatccaatggatttagagaccatacgtaaggtgagtgagtgatttgatctaaatgcctttttgtaatcaagtgactgtgtgtgtgtgtatctgagtgcctgattcttttcatcacagaacatctccaagcacaagtatcagagtcgggagagctttctggatgatgtaaaccttattctggccaacagtgttaagtataatggtgggtatttctcattattttctttccatgaatccgtccatcttctatccatctaacattacttagcattattaaaaaatttttttttgagacaggatcttgctctcttacccaggctggatgctgtggtgtgatcatagttcactgaaccaggcacacgccaccgtgccaggctcttttttttttttttttttttttttggtagagacagggttttactattttgcccaggctgagctcaagcaatcctcccacctcggcttcccaaaatgctgggattacaggtgtgagccaacacgcctaaccagtattattaaaatttatgtgcgtaaagcaaccttgagcagtgatagcagaatcaattgagtgacctagtctttctatttatttatttattttgagatggagtttcactcttgttgcccaggcaggagtgcaatggcacgatctcggctcactgcaacctccacctctcccaggttcaagcaattttcttgcctcagcctcctgagtagctgggattgcaggtgcctgccaccatgcccagctaatttttgtatttttagtagaaacggggtttcactatgttggccaggctggtctcgaattcctgacctcaggtgatccacctgcctcagcctcccaaagtgctgggattacaggcgtgagccactgctcccagccagtctttttttttaaagcaagcatatattttagtgtgtatgttctataaagattgctattagccgttaatgatgaaaaagtagtatacgcttacttttggaatcttggaaagcacagaaaaatgaggtgagcataaaaatcaaatggatttttatccatttgggctctgagctatcactgctttttcctggaatgtgaaaactcacctatgtcccaggcccttacatggagcttagggaaatgggtagctatagaccatggtgagcttccttggtgcatggagttttgctcagtacatgagttgattgaataacatatgccaggccctgtgctagctgcttaatctactgataagaaagacagtcactgtcctcaagtaattcacaatccagttggcagaaagagacaattaaaatgcagcttggaaccaggcatggtggctcatacctgtaatctcaacactttggtaggctgaggtgggaggattgcttgaggccaggagtttgagaccagcctgggcacacatagcaagaccttccttgtctgtataaaaaacttataaacaaaagcttagctaggtgtggtggtgagtgcctgaagtcttaagatatttgggaggctaaggcaagaggatcacttgaactcaggatttcaagactgcagtgagctatgatcacgcccctgcactacatcctgggcaacagcaagaccctgtctctataaataaataaaataaataagtaaagtgcagcttgacaagagctataatagaagtatgtgcagattgcatcagacgagagcaaggaataacctgagagttagggaaggcttcataaacgagctaatatagttcagtttttaatgactcaatttttaaacattgagtacttacatgcgctggcactgatagatgttactaatatcaaattagatatggtctctgctccaagttagtttagttggagaaacagaaaagaaaaattatagtacttaaattttattactataagcatgcacagagtgtcacaggacagtatatctaaattagagtggggctgggtgcggtagctcacacctgtgatcctagtaccttgggaggccaaggcgggcggatcatttgagctcaggagtgcaagaccagcctgggcaacatagtgagaccccatctcagaaaaaaaaaaaaagtggggttagaggaagctttctggaagagggttttctttcttctttttcttttttgtaaatagagatgggggtcttgctgtgttgcccagtctggtctggaactccagggctcaagccatcctcccatcttggcctcccaaagtgttaggattacaggcatgagccaccacacccatccagaagagagttttcttaagctgagttctgaaagatcaatggtgtttacttggcaaagaatgtggaggagaaaatgttctagggtagagagaacagcgatatgtaaaggcacagaggcctgaaattgcatgataggtttaggaaacaggctgggtgtggtggctcacgcctgtaatcccagcgctttgggaggccgaggccggcggatcacctgaaatcgggagtttgagaccaggctgaccaacatggagaaaccccgtctctactaaaagtacaaaattagctgggcatggtggtgcatgcctgtgatcccagctagtcgggaggctgaggcaggagaatcgcttgtaccctggaggtggaggttgcagggagccgagatgccgccattgcactccagcctgggcaacaagagtgaaactccatctcaaaaaaaaaaaaacaaagagacagtgttggggttgcagttcaagtgtacatactggtaaataactgttttgagaggcaggcaagagtcaaatcatagaggattttgtgtgctatacttgagtttgtacttgatcctaaatgggaaaacattgaaggaatgaagcagggaaacaatttcttataattccttaaacaaatagaagagggagctaaggacgtttgagagaattatctggcgtactgaggttctcaattaagaatccacatgattataagacttttctcctgtaatttttagcagtaagtagtacggctgttaagtttgtcagaaggggcagagaactggagagaaaaggtgaaggattggacagtcagaaagactgatgaagaaataagcattctgggcagagaacacaatgttcaatatcatggaagaatgaaagagcagggcaagttcagggaactatacgtaactagaacatgcatatatcattaaggagatgagattttcatttttgttcattctggtttgggttgaaagaatgtactttctcagtttgctgtgcttattacacattggaaagtggagagtggaaatgtcccttgttgggtcaattatccattattgttttatgaaaacacctaatcacccagaattctggcagtagaagtgttggtaagctcacagatgtctaaaaaagactatgtatagcaagtgataagcaagagtgttacagaaaggtacttgacctggtgatggctgacttaggacatagggcagacttaacaaggagcttatgtaaaacagtaagaaaaacccagaagatactaataaaaaagtaagcagagggcagatggacaaatcacaaaagagaaaaattaaatagctaacaaacatgaataaatattctgttgcactagtaatccaagaaatgcaattgggccaggcatggtggctcatgcctgtaatcccagcactttgggaggctgaggcagatagatcaccttaggtcggcagtttgagatcagcctggccaagatggtgaaatcccatctttcctaaaaatacaaaaattagctgggcgtggaggcgggtgcctgtaatcccagctactcaggaggctgaggcatgagaattgcttgaacctgggaggtagaggttgcggtgagccgagatagtgccactgcactccagcctgggtgatagagtgagacttagtctaagaaggaagaaaaaaaaaaaagcaattgaaagaaagagatacttttttttttaaacctattagattagctcaattttttttttttttttttttctgagatggagtcttgctctgtcgcccaggctagagtgcagtggcgcgatcttggctcactgcaccctccgcctcccgggttcaagcaattctcctgcctcagcctcccaagtagctgagattacaggctcccgccaccgtgcctggctaatttttgtatttttagtagagatggggtttcaccatcttggccaggctggtctcgaacttctgaccttgtgagccactgcgcttggccaactcaattttttagtagacataatggtagtgagacaggtgctctcacgtattgctgttggcagtataaaattgtgtgagatttctggaaagctatttggcaacattgagagactaaaataaattgttgagtgaacagactttattgtcaagtagacttggatttgaacattggccccaccacttaatagcaatgtgactttgagcaaataacttagtctctgcttctcctatctgtaaaataagaataatagtaccccccttcaagagggttgttttgaggattaaataaaatagtgcatgtaagtacttaccatgtggtaagattataatcctaatcagagatgtagttaaaggtattcatgatattgttacttatattagcaaggatttatttaacctgaatagttgacataaaggggatgatgttatagtgccatctgtataattaattattaggtacagatttacctaataagctcttttttggaaaacttaatgaccaaaaaatgctcacaatgttaagtgagaaaagcagagcacaaagatgtttattttatctcagtcatgcttttttaaaaaagatgtatatacgtacaaaaaaggctggaaggaaacacaccagagtgataatagtggttatttctgtgacatggggttaggattgtctttgttttcatcttttatatgttttccgtggtttttcctcatataggaagcagggaggccgggcgcggtggctcacgcctgtaatcccagcactttgggaggctgaggtgggcggatcacaaggtcaggagatcgaaaccattctggctgacacagtgaaaccccgtctctactaaaaatacaaaaaattagccgggcgtggtggcgggcgcctgtagtcccagctactcgggaggctgaggcaggagaatggtgtgaacctgggaggcggagcttgcagtgagctgagatcgcatcactgcactccagcctgggcgacagagcaagactctgtctcaaaaaaaaaagcagaaggaagcagggaactctcctaagaagaagtgacttttgaactgagttttgaagaatgatgatgataataactacttattgagcacctactgtgccaaggaaatagtcaagtggaaaatggtgggggagaagttcctggcagatagcacaaatgcaaaagtagatgaaggtgccttggatagggaagtgtgctggtagttaaatatgactaggatgcatggtggaattacgtttggtagtgagatacgagattttaaaggtagaggggccaaatcatgaaacgcctagtatgttaacaccaaacctttagaaggagaaagggacatatcaggtactagtacctgaatgtatcattctgaaacccatctgaagaatggattggaggaggagaataagacagagaccggtaaagaaactattgacagcattcccagttaaaaatactgacggcctgaactaaggtcagtatcaataagagtaaaaaaatgaagatggggtgtagagatacttaggaggtagaattgatatttcataaatggttagaagttgggggcacgggtaaaggatagagattttaaggtggtatcaagcactcatgctcttggtggaaacataaattagtacaaacgttttagaggactataaatgttcatttccattggctaagaaacttcacttctagggactactccacacaagtttataaaggtacatgtacaaatgttctttgcagcattgcttgtaattgcaaaaacatggagtattctaaatatccaacaataggaaattgtttaaaaaatggcacatctaggccgggcacggtggctcacgcctgtaatcccagcactttgggaggctgaggtgggcggatcacgaggtcaggagattgagatcatcctggctaacacaggtgaaaccccgtctctactaaaaatataaaaaattagccgggcgtggtggcgagcacctgtagtcccagctactcgggaggctgaggcaggacaatggcgggaggaacccgggaggccgagcttgctgtgagccgagatcgtgctactgcactccagcctgggcaacagagcgagactccgtctcacaaaaaaaaaaaaaaaaaaaaggcacatctatatgatgaaatactgctaagctatcaaaatggtagacttagctaacaaattaggtgtatctgtatatgctcatatgaaaagatactcaaattgcattattgagaaccatattactcaacagtatttaaaaaagagggtcacaaatttggattctaaggacaggtaatataaatgagtgaaatgggctatgttgtgggggccaatgaactggtgagcatgtatcccatctaggagtcagtcactatttagctcagttgttgccatggaattgaattaccaaagggagaaatggagaatagtttttactttagacttgtttgtacttaggtatttgaattttttagtgagcacatagtacttttgaaattaagagaaatttccgtttttggaaggatgaataaatcaaatgacctccaaaattctgacttgggcaacaggtggtgccattgactaatatgggaaatacaggaagagtggtttggagaaaagatagcagagttcaacttgctatgttgtattggggtgggacatctaagtgaagacttttaataggtagttagctgtgtacaggtccaaagctcagaagaatttttttttttttttttttttttttttttgagacagaatcttgctctgtcgcccaggctggagtgcagtggtgcgatctcagcccatggcaaccttcgccgcccaggttcaagtgatttgcctatctcagcccatggcaaccttcgccgcccaggttcaagtgatttgcctgcctcagcctcccaagtagctgggattacaggcacatgtcaccacacccagctaatttttgtatttttagcagagacggggtttcaccgtgttggccaggctggtctcaaactcctgacctcaaatgctccacctccctcggcttctcaaagtgctgggattataggcgtgagcttttgcacctggcctcagaagagaatttatactataaatatggttacttttcagattatcagcatataaaaatataagtagatgagctcaaatagggagtagggtacattccttgaaccctctgatgttgtatgtaaaatatgattgtatattttactgagtagaaagaccatagattttatcagattgtcaaagtgtgtgaccccaaaaaacataagagtcactgtttagaggatgtgggataagaatagacctgacaaattccaatatttaagataacaggtgaggcctgggatggtggctcacgcctgtaatcccagcactttgggaggccgaggctggtggatcatgaggtcaagagatcgagaccatcctggccaacatagtgaaacgctgcctctattaaaaatacaaaaaattagctgggcatggtggcatgcaccggtagtcccagctactccggaggctgaggcaggagaatcacttgaatccgggaggtggaggttgcagtgagccgagattgcactgctgtactccagtctggtgacagagtgagactccgtctcaaaaaaaaaaaaaaaaaatatgaaggagtggccagaatgaaagaagaaaaactaggagagaataatatactgcaaaccaagagaagaggacttcaaagagggaaaattaccaacaggtcaggtgttagagagaagaccaaagaggatggttattagaagttattagaggatggttattgaagtggtaggataaaaagccagactgtaggggttgtgaatgaatgggaagtaagaaagtagagattgagagttgattgtgaagggaggaaggaagtagacaatatgttgaggggatgaaggcagttgggcagaggagaacttcgtataggtcaaagagaagaaaattaaggatatgaaatgcctatggaggtgggaagatagacattgagaaagttttaacatcttatttctctgtaaagtaggaaacagcatatttttttgctgagattaaagtgggagaaggaatttgaagaaaaatatcaataagcgaattatttttgtgggaaattggaaaaggagctgattagggacatttcagaagaacgctgttgagcaacttttgaaggtccagctgaagatggagacttttttttttttttggcagtatcagttggcacagttctgtaatttttgtcagtgctcatcaaatcaagttaggaaactgagaaggcaggtgataaaattgattcaggattgagattttgttttgtggatgtgctggaaagattgggaattgagggtattagcaaaaaaaaaaattattgaagttcgggcatctcaaaccttgtcactctttagtgacgctttattgcagaggattgtgactatatagtctccagtttgggggaatatctcagagcagctccacaaaagtttgaaatttctttggcaatttgtgttttatcttaaaaatgtgtgcaaattttccgttaggcttatctgtactttaacttgcttcaaatttcttaccaaattactttatatcccctctccaatcttcaagtaaaattgctgattcaggaagttatacaacaatgatcccatagcttagtttggtatatccttctgcattacctagtttttaaaacatggggctgattatacattaaagtaatgccaggagaggcttaatatgttgagagatagaaattaatgggcctggcagttttcttgaagtaaaagaaagagaatgaaaaaactggacagatacaaggctgtgataagaaagtagaatatttggagttgaaagttccagaggtgaagcagttttcagtagatagcattctgggtatagccatggatgtgtttggctggagcaaaggtgcaaactattggcacaaagatttgcagggatttggataggttgtacatgtgaacaataaggtaactcactatgatgggaaagatttggagccgagagaatgattgtgccaggtgcataagtctttgtgaatgagaatcagttaataatggtgactaaaggtgaagaacacagatttcaaactcaagtgtcctgcaggggccaggcaagtaatgtaaatgactaaggtgggctaggtgggattgtgctaaactagaaaagtgcatattccatctaaagcagcatgtccttcttctgattgttgtcctaaggaaatgagtatccagtgttgctagataactgaatttttcaagagaagctgaaaatctggactttttatgtgatttctcaaatttttacgtatttgcaaagagtttaaatatttttttactcctttggccaaataaaaacatctatctgcaggccaaatctggctccaagtcttcaacctctggcatagtaaaaaacaggccttagagtaggagagatttttttttttctccccaagaagaagtaaataatgtctgggtagtagcagtggacagcctagaaggctgactttcccccctccttaaccagtggatgagagaataggaaacttctgaatagggttataagggttagtggtgccatgtgatatgaaatggtgacatctagaaagacaccataaagacattgaggagtgaaaggcacatgaaatatttcctactatcaggcgatatacacgaaataatatttctgtttaaaacgttgttggttcagccatataatatgatcctgcctctgtttttaattaatagtaacaaagtccaggctgggtgcagcggctcactcctgtaatcctaatgctttgggaggccaaggcaggaggatctcttgaggccagaagttcaagatcagccccggcaagagaccctgtctctaaaaaaattttttaaattagctgggcatggcagtgtgtgcctgttgctgagcctgtctcaaaaaacaaaaaataaaaatagtaacaaagtccatgtggactttattctctactttaaaatttttattttgtaaaattttgttagtattaaagttaatctaaattagtagaatgatatctctagttaacattattttgactctgcatattcagatccttcacacataatatactgcatatgagcatatttctataacattttacactgacttctttgacttaccctttattagtcacatatttagcccgtgaactatattgtatatagccagaatacttagcactaagattagggtcattaggcaaaaaccagaagataagtaacactccatataaaacacatctggacataaacggcatgtatcagaggaattagtcttgtccttaagtgatgacagtggactgtacgctaattatagagttatgccattgtaccttccagctgccacgtaagtactagatcagtctcagaacctctgttcatgtttaaatagcatttgaaaagaacattaataatcaggaaagcccacaactttaagtggttggagttatttgcaccagtcccaaaaggaccgcaacagttaaaggagagagtcatacagataagtcccttctgaaaaatacaacccaaactttttgccagacttaacaaaattggcagaggccttactacttaatgtttagttaaatttgaaatgagctacacaatctgtggctatatcaccctaaatgtgcctgatctcatttgaaatgagctacatagtctgaaccaataggtgatgctgagctagtcatgatgagattcctctttcccaaagatttcatagcaagtttctcctctagtgctcttaaaaccaaaatcaactccagtaagaagccatctttgggatggacataggtagaacatgtgtcatgaaacctgagagcccgaagttttagaatgctcagttggaccccacaatctagatataaatttacaaagaaaaacagaaatctccccttgtccccaacttttgagtatctcccaaccttttgtgggctctgatagttgttcaggttataggacctttgcctgacattctggagtctcatcctatgcctgtgcagcttagtagttattcagccaaagactaaagggaacccttgcagatcttgttatttttctatggagcaccctcttctccagttgtgccttgcaatttccagctgtcttaacctcctcagactccagtatgtctccagagctcaggaagactgctataattggcttgccttcagcagaaagccagggacaattgtagggctcacttcatttccctttccttcttacaaggatcatacaatcttatactactagttgctcagtgtctgaaaacagttgtttcatttgtttttttctagttttctggttatagtaggaggactaatccaatagcatttattctatcatgcccagaaagtcttttaatgtttagttttatggtatttctgacatacggaaacttcatatgcatacatttgtatttatcagtcttttcctatatgattcttatttttggtattataactgttcaaaagatcttccctacccccaagatagcaaaccatattttcttctaatacatacaatattttaaatatctaaatgtttatctactttttagaataaaatctgaagtagaaggtaaatatttaactttctttcccaaatgactagccaaagtgcccaagtcccatttatggaacagtctaacctttcctactaattgaaatgctacctcctttttttttttttttttttttttttttgaaacaaggtcttgctctgttgcccaggctggagtacagtagtgtgatcatgggtcattgcagcctccacctcctgggctcaagctgtcctcccacctcagcctcccaagaagctgggactacaggcacacatctccaagcccggctaatttttttttttttttttttgagacagagtcttgctctgtcacccaggctggagtgcagtggcgcgatctcggctcactgcaagctccacctcccagtttcatgccattctcctgcctcagcctcccaagtagctgggactacaggtgaccgccacaacgcccggctaattttttatatttttagtagagacggggtttcaccatgttagccaggatggtctctatctcctgacctcgtgatccgcctgcctcggcctcccaaagtgtttacaggcatgagccaccgcgcctggcctaatttttgtgtttttttgtagagatggggtttcaccatgttgcccaggctggtctcggactcctgggctcaaatggtccacctgcctcagcctccttaagtgctgggattacaggcataagccaatgcacctggccaaaatgctacctttataatatactaaattcttatatattcttgaacctatttgagagctttctattctgcttcattgatctatttgtctagtctggtgctattatcaccagataattgttttatcacaaaggctttaaaattttaaattccttgactgtgcttgcctaattatcctaaataaactctaaggtcatttttgttagattctaccttgtcctcgaataaataaacatgattgagaccttatttaatttatagattaatttggagaaactgtatatctttataattctccatttttcctcctgggagcttatgtttcttcatttattcacattttcttttatgtcccccaataatggcttctagttttcttcatacagtttctaggcatgttttgtttaatttatttaatttgatagtttttgttgcttttgaatttctcattgtcgagtttattcctaggtaatttaaaagtttttattttgtttatttatttttcattgtcgatattcaatataaaatttaaaagctttgctgccattgtgcttgtactctttttttcctaactggttattaagtctaaaggtttcaatttgaagaatatgaatagatgattcagtattgttcataggttaaatataatgcttaaagtatttccataatactagtttctaagtctttgttatgagggtactactctgtaagtttggccactcatgaataataagggtcttttttttccatcagtgattgggacccaaggtataagtatttctgaccaggcttggtggctcacaacagtaatcccagcactttgggaggctgaggcgggtggatcacttgaggccaggagttcaagaccagcctggccaacatggtgaaaccccatctctactaaaaatacaaaaattagccgggactggtgctggtgacatgcacctggagctgagatcgtgccactgtaccccagcctgggcgacagaatgagactctgtctccaaaaaaaaaaaaaagaaaaagagaaatatttccatatgaaagttaagtccttcatgtcattgaagagaagaaaaacttcccccgatcctgcttgggtctcttgctgccatcttgtctctttctctttccatacagacttttttattatggaaaatatacataatataaaaatttgtcattttaactttttttttttttttttttgagacggagtctcattctgtttcctaggctggagtgcagtggcgcgatcttggcttactgcaacctccgcttcctggattcaaacgtttctcctgcctcagcctccagagtagctgggattacaggcgtgcaccaccacgcccgggtaatttttgtatttttagtagagacggggtttcaccaagttggccaggttggtctcaaactcctgacctcaggtgatccacctcccctcagccttccaaagtgctgggattacaggtatgagccatcatgcccagccgtcattttaactatttttaagtgtacaaatcagtggcattaagttcaatcacagtgtagtgcaaccattaccactgtgtatttccagaactttcttattattccaaacagaaactctataccccttacatggtaactccccttcttcccagctcctggtaacctctattctagtttctatctctatgaaattgcctattctaggtatgtcatataagtaaatcatacattatatacaatattcttccttttgtgtctggtttgttttacttaccatgttttcaaggttcatccatgttgtagcatgtatcagagtttcattcttttttatgacagccagacttcttttatgaatatgtaacgtctctcactattttctttgtcttccagtaatgcctcgcttagctttaagctggcttccaccctgtccagtctaccaagtaaacaggatcacataattatcagatatagtgggcacttttctgtccttatcttgacctcaccctagtatttgacatcattgaccattctttcctcacaacagtattgtgattggcttccatgacaatttttagctctggccgggggaggccgagatgggtggatcacctgaggtcaggagttcgagagcagcctggccaacatggtgaaaccccgtcttcactaaaaatacaaaaaaattagccaggcgtggtggcacgtggtatgagaatgcactcagcgttcttgggaggctgaggcaggagaatcacttgaacctgggaggcagaggttgcagtgagccaagatcatgacacggcacttcagcctgggtgacagagcaagactccaaaaataaaaaagcccttattttcctcccacctcttaaactattcctttttaatctcctttgctgaatgttctgcccactcctgtaacttcagttgccacctcttttcctgatgactctattgtagacaaagccacttgccaaacatttcctcttggatgtctcaatggaacttaaaacatacctcaagctgaatgtattattgtttcctcctatccttccttattccaactttctccctctctccttctttacttgaatcactcatttacaatttccaatctgggtttaatggggcattaacattacccagtagctacgtctaggaaactctttttttttaattcttcactttgaataagttccaacatccagtatgtcactaaagttcacattacattttgcctagtcgcctggtgaatgtcccagcctttacatttatctccttctaacctatcatctacatttctgtcaggtagaccttttaaaaaacaaaaaagcaaaatctcttataaaaagatcaaataatctagaaatacataaaattaaaagttaaagcctctgcctgccctcccactcctgtctcccatattttcatttccccagagataacagcttggtctatagtcttaggtacttttttctatgcttagacaaaacgtgtttacttattacgctgctctcagcacactgcctatagggtagccctgttccgcaagagcagtcaaaaagaaaattacatgtaggttttcaagtttttgttttattctgtaatttgctcttttttgctcatgaatgtattctgatcctttttattttgagataattatagattcaggaagttgcaagaaatggtacagagtcctgtgggcttctcactcagcttccttcaatggcaatatcttacatagctgtacttcagtatcaaaaccaggaaatttatattggtacattacttttaaataaattacaaaacttagttttcaccattttaaaaatctattcatttgtgcataagtgtgtgcaatttcgtgccatatatatgttcctgtaaccaccaccacaatcaagacttagaactgttaccataaaggaactccctgttctttgtatctgcaccccccacacacacatgcccaccaccacacccaccactgttcctgttccacttatccgttctccatctctatagttttgacatttgagcatgttatataaatggaatagtataatatgtaaccatttgagattgacttttttcgcaaagcataattcccttgaggtccatctaaattgttgtatcagtagttcattttttaaattgttgagtgttccattgtgtggttgtaccagcgtttgttcaaacatttactcattgaaggacattcagattttcactattttgccattgtgagtaaagctgctgtgagcaatcatagacagggttttggatgagtttaatttttcatttctttgggataaatgcccaagaatagaatggtatatgtttagttttacaagacacggcactatttcattttttttttttccacatcagatgtggaaaaaaaatgtactggcattgtaataaggcttgagggaggcacatctcacacatgaacgtgaaaacccaatgtcgtcacacttacgtcatcataagcttatgaactacaaaaagattgtgccacacttttggagtgtctgtaccattttacattcccaccagcaatgtatgtgatccagtttctctgcagcattcactgttaccactttttaaaattttagctgttcttctattgtgattttacttggcatttttctttttttaaattaaaaacattttcttgctctcggtcttaaaattatttcctcaaatacattgtgtttttctaatggctaatgatgttgggcatcttttcatgtgccatctgtgtcttctcctcctcccttcttctttctccttctttctcccttcttccttctttcttcttcttcttgttatctttgctcactgcaacctccccttcctgggttcaagcaattcttgtgcctcagcctcctgagtagcagggattacaggcacgcaacatcatgcccggctaatttttgtatttttaatagagacagggtttcatgatgttggccaggttggtctcgaactcctggcttcaagtgatcctcccacctcagcctcccaaagccatggtgccaagccccatctgtatattttctttggtgaagtgactgttcatttctttggcccagttttttttttattttttatttttattgtttggaattcagtgcaaattttattagactacaaaaacatatcatagttattttagatatatttatatgaagtcataaaagctatgatttttgaaaaacagcataagaaatttttttaatttcttatataaattaactttagtgtcttaaggattcaatgatacagtttttaaattttttaaattgatagcaattgtacatattcttgagggcacataattatatttccatacatataatttatagttatcagatcagggtaattagcacgtccaccatctcaaatgtttatcatttttttgtgttgagaatgtgcaacatccttctagctatttgaaactatatattgtattattattaactatagtcattctacggcgctatagaacactagaactgatttctcctatctagctataattttgtatcttttttttttctagggtacatgtgcacaacgtgcaggtttgttaaatatatatacatgtgccatgttggtgtgctgcatccattaacttgtcatttacattagatatttctcctaatgctatccctcccccagccccccaccccacaacaggccccagtatgtgatgttccccaccttgtgtccaggtgttctcattgatcaattcccacctatgagtgagaacatgcagtgtttggttttctgtccttgtgatagtttgctcagaatgatggtttccagcttcatccatgtccctacaaaggacatgaactcatccttttttatggctgcatagtattccatggtgtatatgtgccacattttcttaatccagtctatcatcgatggacatttgggttggttccaagtctttgctattgtgaatagtgccgcaataaacatgtgtgcatgtgtctttatagcagcatgatttataatcctttgagtatatacccagtaatgggatggctaggtcaaatggtatttctagttctagatccttgaggaatcaccacactgtcttccacaatgattgaactggtttacattcccaccaacagtgtaaaagtgttcctatttctccacatcctttccagcacctgttgtttcctgacttcttaacgattgccattctaactggtatgagatagtatctcattgtggttttgatttgcatttctctgatggccagtgatgatgagcattttttcatgtgtctgttggctgcatgaatttcttcttttgaaagtgtctgttcatatcatttgcccactttttgatggggttgtttgattttttcttgtaaatgtaagttttttgtagattctggatattagctctttgtcagatgggtagattgcaaaaattttctcccattctgtaggttgcctgttcactctgatggtagtttcttttgctgtgcagaagctcttaagtttaattagatctcatttgtcaattttggcttttgttgccattggttttggtgttttagtcatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatacggctagacagttttcccagcaccatttattaaattagggaatcctttccccatttcttgtttttgttaggtttgtcaaaggtcaaatggttgtagatgtgtggtattatttctgaggcctctgttctgttccattggtctgtatctgttttggtaccagtaccatgctgttttggttactgtagccttgtattatagtttgaggtcaggtggcatgatgcctccagctttgttctcttggcttaggattgtcttggcaatgtgggctcttttttggttccatatgaacttcgaagtagttttttccaattctgtgaagaaagtcattagtagcttgatggggatggcattgaatctgtaaattaccttgggcactatggccattttcacgatattgattcttcctatccatgagcatggaatcttcttccatttgtttgtgtcctcttttatttcgttgagcagtggtttgtagttctccttgaagaggtccttcacatcgcttgtaagttggattcctaggtattttattatctttgtagtaattgtgaatgggagttcactcatgatttggctctctgttggtctgttattggtgtataggaatgcttgtgatttttgcacattgatttttatatcctgagactttgctgaagttgcttatcagcttaaggagattttgggctgagatgatggggttttctagatatacaatcatgtcatctgcaaacaggaacaatttgacttcctcttttcctaattgaatatcctttatttctttctctggcctgagtgccctgtctttggcctagttttaattgtgtgtttttttgtttgttttgttttgttttgtttttgagacagagtctcacactgtcacccaggctgagcgcgatctcagctcactgcagtctctgcctcccaggttcaagtgattctcctgctgcggcctcctgagaatctgggattataggcgtccgccccaatgcccggctaatttttttgtatttttagtagagacggggtttcaccatgttggccaggctggtttcgaatgcctgaattccagtgatctgcctgcctcagcctcccaaagtgttgagattacaggccatgacccaccacgcccagcctgtgttttctttttgagacggagtcttgctctgtcgcccaggctggagtacagtggcgcaatctcggctcactgtaaccttcgcctcccgggtttgagtgattttcctgcctcagcctcccaagtagccgggattacaggtgcctgctattacgcctggctaatttttgtgtttttagtagagacggggttttgccatgttggccagactggtctcgaacttctgacctcaagtgatctgccttcctcagcctcccaaagtgttaggactacagtcgtgagccacctcgctcggcctgttttcttaatgggttttgagggttgtttatgtattctaggtataagacctttattacatatatgatttgcagagattttctccccagtctgtgccttactttttcagtcccttaatagtatctttcaggctaggcacagtggctcacacctgtaatcccagtgctttcagaggccaaggtgggaagactgcttgaacccagcagtttgagaccagcctacgcaatatagtgagatcccatctctacaaaaaatttctaaaatttgtgtttgggtgtgcatgcccgtagtcccagctacttgggaggctgagatgggaggattgcttgagcccgggaggtcaaggctttggtcaaggctgacccaggaggtcaaggcgaagtcctgggattacaggtgtttgagtccccaggtgtggccagtgtttgtatctctctctctttttttttctttttttgagacaaggagtctccgctctgtcgcccaggctggaacagctcactgccagctccgcctcccgagttcatgccattctcctgcctcagcctcctgagtagctgggactacagttgcccgccaccacacccggctaattttttctatttttagtagagatgggatcaccatagccaggatggtctcaatctcctgacctcgtgatctgcccgcctcagcctcccaatgtgctgggattacaggcatgagccactgcgcccagcccagtgtttgtatctctttaagaagttggcagaacgagacgggtgggttgcttcaggtcaggagtttgagaccagcctggtcaacatggtgaaacccgtctctactaaaaatacaaaaaaaaaattaggtgggtgtggtggtgcacatttgtaatcctagctactcaggaggctgaggcacgagaattggttgaacctgggaggtggaggttgcagtgagttgagatcacgccactgcactccaacctggacgacagagtgagactcatctcaaaaaaaaaaaaaaaaaaaagtctttcccagttcagatcacaaaggttttctcttatgttttttcctaaaattttacagttgtagccttttacacttaagtccatgatccgttgttaattactttttgtgcacagtttgaagtataggttgaagtactttttttgcctatggatgtccagtttttcgtcatttattgaaaaaactgtccttcctccattgaattgccctgtatgtacacctttatcaaaaatcagttgagtgtgttggcttatttctagaagtcttactatcaggtagagtgattcctctcactctttttcaaaactgttttattttctagttcttttaccattccactaaatttagaaggggcttgtctatatgtacaaaaacatcttactgggatttgggttcttgtgttaaaacccatagatcaatttggagagaattgacatatttactgattctcttttcatgttagtacatatagatttctacattcttttaaacttatttcttagcatggatgtatgtatcataatttatttaaccattctcctattgataggcatttaaagtatttccataatgctggcttgcagacagttgttcactattttttttttttttttggagaccaagtctgtgtcacccaggttggagtgtagtggcatgatctcggctcactgtaacctctgcctcccggattgaagcaattcttgtgcctcagcctcccaagtaactgggattacaggtgtgcgtcaccatgcctggccaatttttgtatttttagtagagatggggtttccccatgtttcccaggctggtcccgaactcctgacctcaggtgacccacctgcctcaggctcccaaagtgctgggattacaggtgtgagccactgtgcccggcctagttgttcactattttatattttattgatgtgtgcttgtgcaaaatttctgtaggaaatcttgatattttgaaattgtgttccaaaaggctatacctgtttgtagtcaaaataacagtgaaggaaaatatctgtttccctacaacctctttaacgctgggaataatcaatgctttaaaaattattcctgtaaaattagagtatataacttaaaattttataaaaattacatacatgttcattgaagaaatgaaacagcatagaattgtataaagtgaaaaggaaaaatcttgttcttcccttcctaccatcccattagtagccagtattagatttggtgtgaagtattataaattttactatataggaaaaggtgttttgaagtgtttatttttctagttgtagagataatgaggatatatttttagccaaagctatctgttcatttatatatttttaagttgctaaatggaatggtgtttcatttttgagaaaaaataaaaacattttcagggtctttgggcttttcatcaaataggcccttgaccagtgagatttattaccccagttccctctggatggtttctgccttcttgaatttctagtttagattctgagtgagattatgttactctggtttaagagactgaacctcttaatcttggaaactaaacatcctaatttacatttgatcctcattctacataaggtaaggagcctagctatattgtgaaagattagattcacttctctttaattttcacttgttttggatctagtttgaagataaatatctaagaattgcaaagtcagagctcatctctttgggatctggactatgtgtagttgcatttagtaattctaatttctttaggaatttagtatgcagatttttctttttatatctggcactgatctttttttttaaactttctacttctactgagcttttattttttaattttaatggttcacattggaacaaatgcatatcctcacaccatccactgtcaagataataatttatgctgttttgacagagtactcattttcttagggaggaattatttttagtatttgtggaagagttctcaagggaaacatgagcctaggagtgatcacaaatcccctcttctccttggtgcccaggggtgcttgccaacttgactggtgtttttctctgaatcttttcagaaagttagcagcaataggttgggcgtggtggctcacgcctgtaatcccagcactttgggaggccgaggcaggtagatcactggaggtcaggagttcgagaccagcctggccaacatcgtgaaactctgtctctgctaaaaaattagatgggtgtggtggtgcacacctgtaattccagctacttggggaggctgaggcaggagaagtacttgaacctgggagacgggggttgcaatgagcagagatcgcgccactgtactccagcctgggtgacagagcgagacactgtgtcaaaaaaaaaaaaaaaatagcaataatgcttgctttccccccttactggaaccatgaagcttgtgacttgcgtttcttctcacatcaccatacagaaggaaattaacttataaaccagaaaaggaattttcttggtggaatatcaactttccaaagctgtcattggcattatctctatttaaggacatttgaattcgaattgtatgtgattctgtagaccctaccgctccttatttggtatgaggcaaagtataaataaataacgtttctccaacgtgacatgtagagttgcttcagccatgatttaacaagaagagaaaaagcaaaatatactcagaaaaaacattccttttcgtgagtgggtagcttattcttatagtgacaagtcacagattatctttcattcattttggtgtcattctagaaattctttataactgaattctggttttctgtgtagtaaccctttagggactgggaattggagttcaattctgtttaatcttcttcccagcccccctacagtagcttcagcaactttactattcctgtagaggctctattgtctttgtctctttacttggattcctcatttcttcctaagctacaaaacctatagctgatcatcctacttttagtaagctcctgattgctccagaatgtagaacgatatttttagatttttggagatggttatggatctctgtgaaaatccgatgaaaaactaaggctgttctgctctcaaaaatgtatattacatacagaattttgtttatagttctaagggattcatagctctgtctctcataagaactcctggtataggtagggataagaaaacatcacagtggatatttttatccacaatttaacagtggtttgccagttccaccagcatatttcattagaaagacttaaatgctcctttgcttataatagtgtaatagagtctaatagctgaagctcttgtaactattgagaacatggactgtctaaaactgacacaaacagctaatatcaaacacataagtgtatcagctatgcaagtaagtgtgggttttttttttaaatattctagaggtattagtggatatttcttttgttttctttttctttttctttttctttttttttttttttgagacggagtttcgctcttgttgcccaggctagagtacaatggtgtgatctcggctcaccacaacctctgcctcctgggttcaagtgattctcctgcctcagcctcccgagtagctgggactacaggcatgtgccaccacgcctggctaatttgtatttttatttatttttttgttttgttttgagagctcttgttgcccaggctggagttcaatggcgcgatctcggctcaccgcaacctctgcctcccgggttcaagcaattctcctgcctcagcctcccgagtagctgggattacaggcatgtgccaccacgcctggctaattttgtacttttagcagagacggggtttctccatgttggtcaggctggtctcgaactcccaatcaggtgatccgtccacctgggcctcccaaagtgctggaattacaggcgtgagccaccgtgcccggcctaattttgtatttttagtagagacggggtttctccatgttggtcaggctggtctcaaactcctgacctcaggtgattgcctgcctcagcctcccaaaatgctgggattacaggcatgagccactgcacccagccattagtggatatttcttagagtgatgtgttgcaaagaaaatgggtaaggaagaggtcccattttcaaaatggattaaagtaagagagaaacttcacgaatgtataaaactaatttttccttgtattataaagtgagggaattgagatattgagaggttggttcatgtttaagtttcgaaactaaagtagaataaaggctgaattcctaatttataggctggggttttagccatgaggcaggtccctataggtagaagagcctatactgtaaggaactaccgttgtacaggcttggtgaaggaggcctgtaacctgtatgcagcctattttctccagcaacatttctgttttctttttttgtttttttgagatgaagtcttgctgtgtcactgaggctggagtgcagtggcgtgatcatggctcactgcagcctcaacctcctgggctcaaccgatcccctcgcctcagtctcctgagtagctgggactacaggtgcacaccacaacgcccagctaatttttacgttatttgtatagacagagtttcgccatattgcccaggctggtcttgaactactgagctcaagtgatcatcctgcccagcctcccaaagtgctgggattacaggcgtgagccaccacacccggctctaaatatcttgacaattgacttttcttttttgtttgtgtttggcacaggcagtttctgtgaggatacaactttattttacatattttaaagaataaatgacctatacttgtaagacgttttacctggaagagacttttttttttttttgagacagagtcttgctctgtcacccaggctggagtgcagtggcatgatcttgcctcactgcaacctctgcctcccgggttcaagtgattctcatgcctcagccacccgagtagctgggattacaggtatgcaccaccatgcccagctaatttttatattattagtagagacggggttttgccatgctggccaggctggtctcaaacttctggcctcaaatgatctccccacctcggcctcccaaagtactgagattacaggcttgagccactgcgcctggcctgtggtatattttttatcctttatatcctgataaaacagtaggttcaatttagggatcacctcttgtgaaggctttcttaattcctcttcccctcttacctcccagaatcagccacttccttctttgtgccactatttttccattgcattgtattgccctatttgtttacagtctatttcactgtactagactataaacttcttgaggatatgacctatatctcactcatttctatcatctccaatgcctggcacacaaaaagtattaagaaaatgtcttatgaataaataagtgaatgatcagtatattaaaagaacattttaagtatttaaggcagggattgaaaactcaaatgccttcagtgtctaggcagaagataagcagacttgggagggactttgataacctggagaacacatactttatctaagaggaacagctgctactaagccccagcccattggtgccttgtgggaaagctgactctgtcttggccacatctttaaattttctaaaagaagccagacaatttaggtttttatgtgaaatctcccatctgttaaatgttatcaactaagtttttttcaaaaaagccttctattgaaatataacttagatacagaaaagtgttttatgtattatgggtatatagctcaatccatttttacaaactgaactaattttttatgtgagccaaacaaactacaagccaccagtttgcaacttgtaactaaggccatatggggacccatatagttaagaatcatcttataggtaaaaatgtcttaaggagacacatcagccagatacaatgtatggacctttcttgggttatgattcaaagaaataaatgtaaaagagtgtttataaagtaatttgggaaatttgactcttggccggctatttgataatattaaataattattgttcattattttagatgtgatatagttggtttgtttttattttttatttttttttcctttttttttttttattgatcattcttgggtgtttctcgtagagggggatttggcagggtcataggacaatggtggagggaaggtcagcagagaagtgaacaaaggtctctggttttcctaggcagaggaccctgcggccttccgcagtgtttgtgtccctgggtacttgagattagggagtggtgatgactcttaaggagcatgctgccttcaagcgtctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttcttactacacagacacagcaaccatccgatttctcaatcttttccccacctttcccctttttctattccacaaaactgccattgtcatcatggcccgttctcaatgagctgttgggtacacctcccagacggggtggtggccgggcagaggggctcctcacttcccagtaggggcggccgggcagaggcacccctcacctcccggacggggcggctggccgggcggggggctgacccccccccccacctccctcccagacggggcggctggccgggcggggggctgacccccccacctccctcctggacggggtggctgccaggcggagatgctcctcacttcccagacggggcggctgccgggcggaggggctcctcacttctcagacggggcggctgccgggcggaggggctcctcacttctcagacggggcggttgccgggcggagggtctcctcacttctcagacggggcagccgggcagagacgctcctcacctcccagactgggtcgcggccgggcagaggtgctcctcacatcccagacggggtggcggggcagaggcgctctccacatctcagacgatgggcggctgggcagagacgctcctcacttcctagatgggatggcggccgggaagaagcgctcctcacttcctaggtgggatggcggccgggtagagacgctcctcactttccagtctgggcagccaggcagaggggctcctcagatcccagacgatgggcggccaggcagagatgctcctcacttcccagacgaggtggcggccgggcagaggctgcaatcttggcactttggggggccaaggcaggcagctgggaggtggaggttgtagcgagccgagatcacgccactgcactccagcctgggcaccattgagcactgagttaacgaggctccgtctgcaatcccggcacctcgtgaggccgaggctggcggatcactcgcggttaggagctggagaccagcccggccaacacagcgaaacccggtctccaccaaaaaaatacgaaaaccagtcaggcgtggtggcgcgcgcctgcaatcgcaggcactcggcaggctgaggcaggagaatcaggcaggcaggttgcagtgagccgagatggcagcagcacagtccagcttcggctcggcatcagagggagaccgtggaaagagagggagagggagaccgtggggagacgggagagagagagggagaggagggagagggagagggagagggagaggaggaattctgtcttactccagaccagttggtttgtttttagagcagctttagttcatggcaaaattgagcagaagttacagagagttcccatatactccctgccctcacatacatacagcctccccagttatcaacatcttgcaccaggctgggcgttgtggctcacgcctgtaatcccagcactttgggaagccaaggtaagaggatctctttaggccaggagttcaagaccagcctgtgcaacatagtgagaccccccccccacccccaatctctacaaacaaagaaaaatgggcatggtggtgcatgcctgcacccaggagttcagggctgcagtgagccatgatcatgtcactgcattccagcctgggtgacggagcgaaactctgtctcaaaataaaaacaacagcctgcaccagagtgttatattaattgtgttagttggtgaacctacaatgacatatcattatcaccccaagtccatggttcattcttggtggtggtatacattgtatgggttttgaaaaatgtataatgacatgtatccaccattatattatcagacataattgtttgttaaaagcatccttaggatgggcacagtggctcatgtctgtaatcccagcacttggggaggctgaggggggcggatcacttaaggccaggagttcaagagtagcctggccaacatggtgaaacctagcaacacatactgaacaatttttagaggaaaattgttatgatgctggaatttgcttcaaaacaatttgagaagagtctgaaaattgaagtaaatgaaacaagattgactgtgtgttaatcattgaatctggctagtgagtacatgggagtccattatgttagtgttgtattgcatatgtttggaattttctgcctctgaaagtagaacaagagtccaagttaaagctgaggcatggtttttctaggtctaggataatgggacacactgctgatgacagaatgtaaaattctggaacaagtctgcaaagataatggcactttcttattttatttataggacctgagagtcagtatactaagactgcccaggagattgtgaacgtctgttaccagacattgactgaggtaggtggtaaagatggaggtcctaagcctgggcaacataaggagaccccatctttacaaaaaaagatttaaaaattagtggggtctggtggtacacagctgggacgtgtggtcccagctactcgtctgaggtaggagaatcatttgagcctgggaggtcaaggctgcagtgagtcatgaccatatctctgcattccagcctgggcaacagcaaaaccctgtctcaaaaaataaaagaggtctccttgggatctagctttttgaaatcctgttcccttgaatgaggagctttccctgattatcctattttaaaatgtagtattccctaccccccaactccgcatcccctgtttccttccctgcttaatttattttgattattatctgtgtcctgccactagaatataagctccatgaagatagatatttttgtcttttgtttacttttgtatccccagtacttaaaatacatgttgaatgaatttattttctttgtttctcagtatgatgaacatttgactcaacttgagaaggatatttgtactgctaaagaagcagctttggaggaagcagaattagaaagcctggacccaatgaccccagggccctacacgcctcaggtgagtctgaggactaagtacttcctcatatagttttcttattggtttgggaaattgggagcatgttaacaaatccgtttactgagataccattcttctctgtccttcctcttcatatgcctttcgtgtgctttcttgtcttctcaaaggctaaggtgagtgagggccatgggtcttggtggccttgaatccagaaaaggcagctgtgggatgaatgaatggggtggggccttagttgtttaggcagtgtttgggaatatcagatccctgacccagccatcctctgggtctcgggaattttcttgtccatgaattttgggactctagaacatccctagagtgtagacttctcagttacagacatgggccatattgttcctgtgccttacagacacttgattactcattccctcagagatatctcagtgtagctcagaagtcacccattttcctggattgactcctagtaaatgaagaaaggtagtattaataatgttcttaaatgttcatgtcaaaagaatgagagagcaggataaataagaaatttttagtcttcctggtctaactgaacccttgaaatacactaagagtatatttcctccatactgtactcttagagggttggcatatttgaagaataggacttaacagaatatcactggtgcttggtttctgtattggaggcactatggtagggtggaaagtacataagaattgacataaagcaggcctgggtttgagtcttagttctcctgctgtctagctttgtaatcttggaaagttaacctctctcacttagtttccttttctctgaaatcttttcaagattgttgtaaacattaaatgaattaatttaatttgcctgacacatctttatctgttctctgagaccctttcaaatttaatcaaatattttaatgcagaactctgccaattcccacaggaaaattttttttcattctatccaggtttccctctgaactgataatgcaacctatgtgacctctgttggattattgctgtctctatatctcgttcatgcactatccctatctatcttttactctctctttcatctcacaacctaggttactgaggggccaggtataaaagaaccctcagatacttcttcaaggtccagaacaaggaaaggctcttggagtgtgtgggcagattgggtcaagggggcttgggtgagtgatgttgcccaggaaggccctatttgctaataggcccacagcttccacaaggtactttctggtaagttaaagcctgggtattagccatcattccccaggagagtctagccattgaatggcacatggtttgctcatttctaggacagcctaagcctagtcctttggtgagtcaaagccttagaccccaaagtcaccttcctttcttcactacgtctcccagactacctcaaatggctaaggacaacctgttagctatttctctcttgagcattagctgtcatttggtgcagttagagggtttcctatgaagagtaggattagatagtactgcttcattattccagttcaccttttcatcattcccttcactcacaaacagtttaagatagtaaccaactcattatctcttaacctgaggaaggtgtacatgagtgactgtccttactttacttacattactactgtcaaactcaaatgttattagagtgtgtttgcaaaagtgtaacctgccttaatacaatgttggttgtaagaagcatgatagtaatcatacctttcaacttctaaatggtggtggtcaataatgtattttctttttttttttttttttttttttttttttttttttttttttttgagaccgagttttgctcttgtcacccaggctggagtgcaatggcgcaatctcggctcactgcaaccttcgcctcccgggttcaagtgattctcctgcctcagcctcccgagtagctggttttacaggcatgggccattacgcctggctaattttgtatttttagtagagacagggtttctccatgttggtcaggctggtctcgtactcccgacctcaggcccacctcggcctcccaaagtgctgggattacaggcgtgagccaccgcgcccggcccaataatgtattttcactcaactgtttccacctaacttggattgcatcatctgttcagcttaacaccttatctaaaactgttgactttgcagttttctgcactgtgccgtagggttttgcagaaatttcatccccttatttttcctttcttctgttccacattgatttacctgctctgtaatgctttgaattttgttttgcctctgtttctccaaaaccctcttctgaatcagttttgtttccttttttaaaaaacacaatgtaacacatatctgttctatctgttgataaaagtaacatgtttgttagagaaaactggaaaataaaaacaagaaataagttacctcttgtaatcacttccaccactcagaagcaacatcagccagtgtgaatatttttatttctttcatatctgtagcgtatgtatttgtgtttatagacacacttttaaaatgaaattgatcaatatggttttgtgtcttaactcttttcactttacattattttgtgagcactttatctagtccttcttgccctcctgtcacagaatagtccatttgctgaatccctgttctttccagggcagaaaacagggaagggatctataatatattgagtaccaggcatgggtaaggaacttacacatctcttaattctcacaacaaccctgtgaggtagacattatcatccatgttttatagttgagttaatcaaggcttagagatgttaagtaatttgttactcactagcaagtgttggggccaggactcaaacccaggacattttactccaaggcctatgatttttcaccatgccattttgcttcgtagcatcctctgatgggctcataaactatcaaagcattctatgctcttgttggaattgaaattcctttatctcatttcctctgtctccaaatcaagcaatcaaaatagcactgatatgaagccttgggcctaaaaaccgaaagacaaggcttagaaaaaaactaggttattgaccagaaaggctgttaggacataaaattgtcccatagctttggtgcatttctgcttcaggcttctgattacgtgcatcaggcacctgtctactagaataggcaacatttataagagtcccaaaaacttgtctgtaaagctgtgtcaaactatgtttctctttaactgaattgctctgcatgatctttttctccagtaaatgccttaaaggggagttatctgtatttattttccctttcctagatagaagctaagttgtatgttttgtgccacagcctcctgatttgtatgataccaacacatccctcagtatgtctcgagatgcctctgtatttcaagatgagagcaatatgtctgtcttggatattcccagtgccactccagaaaagcaggtaacacaggtaggatgttctttttctctttataagattgttattgtgcctgcaagtggggctaggggaatggtgatggtgatggtgatatgtgacatatgtcaagaatgactgggccctttggccctgggaatgaaagcttagaaatgggatttcaagttgggatggcagcaggtcgtgtgactggtgttatattctctctgtccccatgggtagagtcaggcacagcagaacttcagggaagacacaagtatgaaaaaagggtgtgaagcatcagagtagcctgacgggtgactagagcgaccaactgcactcagacagttcaaaataattggcctactttatgtgtattataatttaaattaaaattatttataaaattaaattttaaaaattggccttttctagaggtatcagaaatatctacagcttttctacagctattctcagtcagggttccactggaaagtgtaaaacccaggagggtttttctatcccaaagagttcaacacaagctataaggaaagtttgggttagaaaggaagagtctctttgtaataatacagtaagagtagactaagagcctttcctgttctttgggttttttactccggctgtgatttccaaagaatgggggaaaatgcgcatgccttgagctgtctaaacagcccccactagcagtgggattggctgggatatcagggaggagcatccaccctgggtgagagcccttggttaactcctcctacaggcacgtccctcaatgatgtgctatttgtgttccttactcagatgcgccagggccgaggtaggctgggcgaggaagactctgatgtagatattgaagggtatgatgatgaggaggaggatgggaaacctaagactccagccccagtgagtatgcttatagaaagcttatggttacgttatgcccttatatgataggagccccatcagtacaggccaggccaaatcctaagatgatatcagggggtctccttagtgagccccaatctgactttaatccttgggaccaactaaacagtctatccaccaaaaataattacttaacttcttgtgaggcagcaagtggagggatgggcggggcggggagggggggtgtgcctggtggtggcttctggtctcttatgtggtcagttgataggactttgacccccaactggtctcattcaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctggtaggcctcaaccattgcttctattcctttataactcactacagcaccctcagaactggactggataggcgctcttggccacatatgcttttattggaagctgcctcttttattgaattcctattaatagacctgagagtactgagcactcaggcgtaggatgatcatattcattagcaggaggtacaaaagacaacagtggaaaagacagtgcctaagtaacagctttgatctggatacttgttaaaggctgggcacagtggctcatgcctgtaatcccagcactttgggaagccaaggtaggaggaacacttgagaccaggagtttgagaccagcctaggcaacatagcgagaccctgtctctacaaaaagtaaataaataaaaattagctgggtgtggtggcgagtgcttgtagttctagttaggaggctgaggcaggaggatcgcttgagcccaggacttcaaggctgtagtgagccatgatcataccattgcactacagcttaggcaacatagtgagactctgtctccaaagaaaaagaaaaaaagatgagaacagaatgatcaagtgttatatgtggcaacagggaaggaaaattaagaaaaatcctgtttggggatattttgtggattaatggcaatggccgaggaaaagtatgggagtagatggtagaaaaaatacagataggttggcatgagatggaaaaggaaattgttatttggattcagattctaaactacaaaccttgctgctgttgaccctaggcagttataagaggcatttgaggagaggcgtataggcaagatacctgtgtagatgtgtgagagttactagtttgggaagatcaagccaaagatcaagttaaatctgtcaagcttaactcttgatgacccagaatctgtctctttttacagctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcaggtaatcgacagcaacatgctacagggctgtggcatcagtgcccagctatgatgttgaggggcccaacatcagattacttttcatccatcaaacatttcctgggcacctactagggccaggcactgtgctaggctctggggatacacagaggagcaaaacatatcctgcccttgaggagcccacagcctagtggaaaagactgacacaaacaaatcattacaaatacaatgtgataagtgctatagcgtaagtaagacaaagtgccaaagcaccactgagaagggagtgtctcagtctgcttggagttatcagggaaagtttcacagacaagggaacatttgaattgggccttaaaagattaataggagtttactaagtaggtactatggcagggggtggggagaactttataggtggaacaatgtgttcaaagacacagaagtagaacacaaagtatgttccagagcaaatggaagttgttggggagttgaggctccagaagtgtagcaagggggattatattgtgaaggactttaaaaggcatgctaagacctttggaccttaacctgcgggtaataggagtcatcagtttaaggaaaaggaagtaacatcaaatttgtataacttaggacaatgtgggacacatgatgaggatatcaacagggacttgtcaggagtggggaaaataaagggacataaagaggtaaggaggttagatgaataatgaatggagatgtctggtagaggaaagaggaagaatacatattagatggggcaggaaaggaggaaaaaatggatttggatttggctttggacaagttaaatttaatgtatctatgatacatctaaccagcaagcagataatatgcaataacattgtaaacaaattaattttttacttcagcaaatatttatcataagtacaaaaacaactaagatatggtcccttccttcaaggagatcagtctagtaggaaacctaaaacaggtaaaacaggcaatcatagtgtaatatgaaaagtgctatgctaggcaaccgcagggtttttctaggacttgggtagaggtggggagggaggagagctggctagagaaggaaattgagcctaatatgaataggaattagctaaacgaataagaaagcaatgggcattccagagactaggaagagcctatatgaagacacaggcatgaaacacttcacaggcatgaaacgctttcagagaacacacgtagctcagtgtgactggagattttttgattgatccatgtaagatctataattcatgtgatagaaatgacttaaagaggtaggtaaataccaaatcatgaagggcctgaaagttctgggcggtcattgaatgagaatagtatgaccagatttacattttagaaagattgtcctgtgccccaaaagaaaaatgggcaaaggcatgaactaatttacaaaagaaatgtaaatggccaatatatcatatgaaaaaataacttccagccgggcgcggtggctcatgcctaaaatcccagcactttgggaggccgaggcaggcagatcacaaggtcaagagatctagaccatcctggccaacatggtgaaaccctgtctctactaaaaatacaaaaattagctgggcctggtcacacctgtagtcccagctactcaggaggctgaggcaggagaatcgcttgaacccaggaggcagaggttgcagtgagccgagatcgtgccactgtactccagcctggtgacagagcaagactcagtctcaaaatgataataaaaataataacaacaataatagtaactcccctaataaacgcagtaaaaccacgaagtgcaatttttttacctatcatattggtgattaaagtgaatgataatgcctagtgtttggaaaggctatgaggaaaaagacattctcaaactactggtggtaatgtcgattgatagaaatggggtggtttggagagaggcttatttatttatcatcataaataaaaacatttaaaaacgtgcatcccctttggcccaaaaaatccacatctaggaaattattttatgggaataattaacacaccatcaagatgtttgtgtaaggatgttttatgacagcattgtttctaatagtggaataattggagacagcttaaatgtcctagtgagagactgttaagtcatgttacagccatgtgtggaataccatgtagctattaaaattatgctatagacgttatgtttattgacatggaaagatgttcattataatcattagtgaagagggcagatttcctggagagtatgtagagtatcccaattttgtaaattaaaaaaaatgtttaagcatctaaagttcacaaaaaattttggaaggtaatataccaaaagattatctctggatgatggagttattgatttttttaaatttttttctggtgtatattctaatttttttaaccagtgaacgtgcattacttgtgtgatttttttttcaagtaaaattaagaataaacaaacaaacaaaaaaataaagagcactctggcagaagtgtgaagaagtaattggaggagagcaagactggcggcatgacgacttatttcagtagtgcaggccagagataacaaaggactaagccaaggtaggcagagtagggatggaaaggaggggatagagacaagatatattgaagagagaatcttcaggactattgactaattggatactgtaagtggtagatgaaaccatgaggctgtcagagcatttatggtcatgtaagatggcagtgtgttgttcaggtgtaagggagtttcttccattcaggttcttgtgtatatgacgttggcaagttgatgtttttgaacagggtcatttttctctcagggacatgtagaatagtccagaaccagtcactttagtgtccaggggaggtgagatgggctgatcctttggtggcactgagaatgggaatggtcaggtagaggatggtgtccgagcttgagagatgacatgtttctcttctcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccagcagtagtgtggagaatggtttggatggatctagttcaagtaagagagaatggagcccaaactggtgctatggcattgggatggggaggagggggatggatttgagagatctttagggagtaggacttggcatttgtgggtagagaaggaggaatggaaggtggcttccagaattttggttggggggattgggtgagtacatggtattcattggttcattttaacatttatcatgccacctatttttgttttgtttttttagatggagtctccctctgttgcccaggctagagtgcagtggtgtgatc

SEQ ID NO: 13026 - DNA, 9558 bp, Human
tggacagggctcgctggagctaggtgcttggggacttgccttctgagcttttcttttactcttctctgttgttgttgttgttgttttgttctgtttttgtttttgtttttgagacatggtcttgctctgttgcccagactggagtgcagtggctcactgcagccttgacctcctgggcccaggtgatcttcccacctcagcctctagagtagctgccatcacaagtgcgcaccaccacgctggctcatttttgtagagacgggattttgctatgttgcccaggctggtctccagctcctgggctcaagcattcctcctgcttcggcctcccaaagtgctgaggttacaggtatgagccaccgcactggccgcctcctgggactggtgttaggggaacttagagggcgatgtctgggggctgatagctggggactttgatgctgaaccctgcagagtctgggtctccaatgggggtctggggtctcctaggtcctaggactgagtatcctggcatgccgttctttgggctatacagggtgtgtgtcgtgtgtgttggggcgggaggagtggagtggtctggacggccaacgactggaccagaaggcagaaaatgctaaagcaccaggataaacatctgtgggcgtcatcgaggttcccgggtggaggcgggaggaggggcggggcagggctttccgcctacccgagaccaaatacgggcacacacaatacacaccacacacgcgcgcacacgcacacgggcacacacgcgcgcacgggatcctgctccgctccgcggctcccccgccccggagagctccgcgatcagcacccgggacagcgccaccgcccacgtgcagggggtggggtccgggcggggctggcgcctcggcgtctcccgggagtgtcccgtccagccgccgagcaggtaggagctgctgggacccccgccctcagcccatccgcatccgcatccctagaggaaaggggtgtgcgagtgggggctggggcactggggagacaaccagagggagggcagcagcctgaagcggagagacagggatctggggacgcgagacaggtatggagaagacaaagagccgagggcggggagtggggcgcaggcggaggggagagggagagaccctggagacagaggccaggcgatagggaagagagacaggcgggttggggaggcagacacagggaagacgcctatgtggggtcaagaggcagcgtggagaccgaggcggtcacgagagcagcacggatgcgtggagagaccaacaggccaagaaggatgagggggctcagcacaggcaccgggcagcccccgacccgccctccagcaaaattggggagagggaagagggaacctgcgtctcagctcccaggaccaggtgcggagggagcagtcggctgtgggcgctcggaccacaggctgcccgctccccacctcgcgggacctcaggatcccagtcgggctattggggggttcccaggcaccggtgggccccggagcgagcctgccccgccgggactccgcgtctgtgcgtcagccccgcccgttgtcctggcaacaacccgttgcccgggcaaccagctttgctctcaccccgcttgagaggagcccggctgttgctctgggcaacgcggtctgctggttcccacgtctgccttcgcccgcttccggttcagaccctgcggaggggcgaggacgaggcagaagtcagcgggatgcctgtggggccgtggaggaagagggtatccctttaggatggaactaggtcctggacaccccctctcaagtgcggggaggctgatactacaactcccagcatgactcgcggtggctgtccggtttctgcgcggctgttcgcgcaaaggcctcatgggagttggagttctttgttgtgcgtggggctcaaaggacgtctggggtgggaatgggggactagggtgcttgagtgtctctgcagaaaagactccaggaccccgccaccatgttcccggagcccccaaccccggggcctccatcgcccgacacgcctcccgactccagtcgcatcagccacggcccaggtgagcaagacccgggggtggggggccgagcagagagaaagcctggccaggattccgaggggcgggattcggacgggtgtactcgggcaggcgggctggaaaatccggctgggatcccgggtcgtcatcctggactggaatgcgaacgaaatggggtaaaaggaaggaacagatttgcaaaaaaaaaaaaaaaaaaaaaaaaaaaaaaatcgaaaccggatcaaggggtgttgcatggaatgggatcttagaattggaaggtccacctagctcttcttttacagataaggaaacaggcccgatgaggagcagggcttcttgtaaaagcatcaggagttgagcagaaatggggggcggggtcgggtaaggaaaggcagaactaacaagcaagcaaatccagatggtgtcagcctgggttggggcatcgaatctctctataggccacattaggtggaagaaaaacacaggaagaaatgcaatgaaaatggctggagggaaaaggaggccagcattccagcttccacgtgtaatcaggactgaatcagcctgcgtgctgcccaggcctcaatgtgtgttgtctccacccctctgcagtgcccccctgggccctggccaccatcgtgctggtctcaggcctcctcatcttcagctgctgtttctgtctctaccggaagagctgtcggaggcggacaggcaagaagagccaggcccaagcccaggtccaccttcaggaagtgaaggggctgggccagagttacatagacaaggtgtggcccagcccagcccctccacctggccccttcccgcaccctgctcctctcaatggcccagctggtcccagtccctgctcccttctgtcctataggaacccaccttactggctcatcctccctgtgtgtctagccctcaactggactctggggacccagagatggaacagaactagttgctattcccaagaacttcccagtctggtgggagagtcaggcactgacacagacactcaccacacagggtaatatgtgccatactacagggtctcataggagcacagaaaaggcatcccactgtatagaaacctacagaaacatataaatatttggctctgggccgggtgcggtggctcacgcctgtaatcctagcacttgggaggctgaggtggacagattgcctgaggtcatgaattcaagactagcctgggcaacatgatgaaaccctgtctctactaaaaatacaaaagccagccatggtggtgtggtataatcccagctactcgagaggctgaggcactgaaaccgggaggtggaggctgcagtgagctgtgatcgcgccactgcactccagcctgggtgacagagcgagactctgtctccaataaatagataaataaataaatggctctgaaagctgaaaaccagctttgtgccagaatactttaaaatatgctgatttttttcagaaaatgggacatatttacagtaggaaaaagtttaaaacagagggtcagacagaggaggcttcgtggtggaggtgacttctgcactgagacctgagggacagagttaactgagaccagagagaaggacattctagtccaagttggagcatgtgttgaggccccatatccagattcaggccccatatccagattctgaggcttatttggggaacaaagagtcatttctcacaatagctgcactctggagtgaagtgtctggagaactcagcagtatccatgtcatgaaggtgatgaaggctacaaatatgttttgagcatgagagggacagggtcagatggtgttaggatgactcctctggaaccctgtgtaggacagatctgcggcgagggatccagggacgaggccagtgcagcagcagcctggagaggataaaagacatttgcattggatgaggccgttggaatggaaagtggtcactgcagggtctgaaaattaagtctctcagtgcagagtgcagtggttgcctgggagccagacagccctaggtttccaaccaagaaggaccatttcctggttgtgtgaccttggagaactcactgtccctctctgagcctcaagtctgtggtcactaacttggtatttcccctccttccttctcaataaggagctgttcaattagcatccgtaaaggatgctatttagggtcctggtgtccagccccatccctgtcccttaaaccagtgatgttcaaagaccgtctgcagcagaatcacactgggtacttgttgaaatgcaaattctggcactagcacctgacctatcaagtcagaatccctgaagaggtgacctcagacattttgccacaggattcaggggaattcaggttcacattgaattttaagaattgctggcctaggttaaggagacaccttctgctttttcattcaactttagaatggcaagtacacagtaaatatgccatttctcctccatgttttgctgtgctaagatcacaagtaaacatggcagtttggactagcaccccagtacatccattagcatgtgaaataaaacctgcattattcctgtgggcaatgggacactatcagcacttgttttaatctaagcatgacaagcacatgtctagttcctgcccatagcagacaccactaatcaaaccttcacaaacatactgcatctgtgttaccacgtctatttcctgcctgtggcagacagcactagtcaaatactgaatctgcttagcctgtgagagctcaggtatagcccaagggacctgtgagcctcccttggcttctgagcctgatggatactgctatcaggggaagacttcacccacccttacccctggctccttaaggtgcagccagaagtagaggagctggagccagcaccatccgggccagggcagcaggtggcagacaagcatgagctaggacgactgcagtactccctggattatgacttccagagtggccaggtgggtgtggaggaaggggaagctttggagggaggatcccgggggttccaaccccttctgaaaggagccatggaagggaggctaagactagtgttccccacctcccccactgtgcctgggccctgcagctgctggtgggcattctgcaagcaatgggattggcagccttggatcttggtggctcctcggacccctatgtgcgggtctacctgctgccggacaaacggaggcggtacgagaccaaggtgcatcggcagacgctgaaccctcactttggggagaccttcgccttcaaggtgagctcctgccttcaggccccgtgttccatagcctgtgcccagtccctggaacactagggaccgaccccttccgcttttcctggaggcggccacagctcaggtggcagctaccagctctggggctattccactggaccctgggcactactgactcctgggctgtagcctggtccttgggcggtacgatttgggttccactgacccgtgatttttttccgcatggatccctggactttcccatttgagttcccccaactgttcgcttcgaccctcgctgcctcactccatgccttccttctggttgtgctgtgcctcaccctatctctgacttcctgctctctactgcggattctctgtgcactccaggtcccctacgtggagctggggggcagggtgctggtcatggcggtgtacgacttcgaccgcttctctcgcaatgacgccatcggggaggtgcgggtccctatgagctccgtggacctggggcggccagtgcaggcctggcgggagctgcaggcggctccgcgggaggaggtgagcatgcgcggtcgcgccccgagccacgcccccaggcccagtcccgcccacaacatcctgagccaatcagatcataggctttccagaccctcagggcggcgtggattgtacccctgaggaggcatggatgtggagccggggctctggtgatgggcccctctcctttcagcaggagaagcttggggacatctgcttctccctccgctatgtccccacggccgggaagctcaccgtcatcgtcctggaggctaaaaacctgaagaagatggacgtaggaggactgtcaggtgtgtgggaagcaagggagtggggtgtgtggggatggcgtggggtgggttctcgttctgacagtttctgagcctcgagggtttcttcggggacagggaggacctggctgctgtggaaggcatggattttggcatagagctagggagacccgaagggtgtaggcagtgtttctatgttggtccaacaacccagcagtggggagctataagactcctccttcctctccccagatccatacgtcaaggtccacctgctgcagggcggcaaaaaggtgcggaagaagaaaaccaccatcaagaagaacactctgaacccctattacaacgaagctttcagcttcgaggtgccctgtgaccaagtccaggtgagctcaaacctgcccttctccaagagcccagacctttagtaatcgccattgctaggcggagggagactttttagcatctccctagaaaccaggtgagggggtctgaggttatgctctcagtctgtttcctcctatgaggaccaggaagcctcttccactccaggaagagactccttaaaattgggtgtgggtgtcctatctgctctaagcgggaccgggatgtcccacccctaagcagtaccagatgctccaccctaagcaggatcagtatgccccgccccaccaagcggaaccaggatgctccgcccccaagcaggaccaggatgccccgcccccaagcaggaccaggatgccccgcccccaagcgggaccaggatgccccactcctaagcgggaccagattccccaccctaagcaggaccaggatgccccgccctcctcaggaacgtggttctaagaaaaagagacctcccctcacttctttagggacggcgcctaccctagcccggcccctgttaaagttctgcagctttgcggctcttaggaggctgctcccccaggaggcgccgaacacacccgctccgcaaccgagtcctgagggttcatttccttagaaacctggctgcgcaggaagaaaggcgccagagcctcctcctcgccgcaggctccgtccctctcgtctcccaccccctcccccgtcccgagctccggggccccgagccctcgggtggcagcgagaggtaccctcagccgtgaaaacggacaccgccccttccggggcctcctcccctcacgctcctctctcctcttcctcccgcgcccaccccagaaggtgcaggtggagctgaccgtgctggactacgacaagctgggcaagaacgaggccatcgggagggtggccgtgggggcggccgccggcggggctggcctgcggcactgggcggacatgctggccaacccgcggcggcccattgcccagtggcactcgctgcggcccccggaccgagtgaggctgctgcctgcgccctgactcccaccccaagcccccggccaagcctggactctagcccctgaccccagactcccgagaccggccaaagccaagccagccccacccttaagcttcctctgacggttaccctccccccaccttccaccccaaccatctgaaccattcctgtcttctcacccccaacgatgccaatcacgacaactttccagcacactcccccgaccctcgcggacacacccagatgccccagggaccccgggaagggaaggcagcctggtttctcctgcccccgggtcctgccccctgctttgacaatcagccatcctcgtctgctctcctctctcttccaacacagcccatccctgcactgctcctggggccaaataaatattcagcagctccggtggcctgggcccatgctccttgatgggggtgggcaagggctgggacccaagaggaaacctcgtttccaggaatgggcgctcgcagggcggtgtgagtgctgttcgtcctgaaagcctctgagagactggcctgaccccatggactccctcacactctcacccgttcattcctcactcaccactctgagcctgggtttcctcctctggagaatgttgggataataataattcctgccacacgctggctgtgaggagtccgcgagaactcccttgcttgtccatgaatttatccactcgcttgctcacccatgactcacatcgattttcatacccatttctgcatccctccctccctctcttttttttcttccttccattccatattccctgaggtcttctgttgagtgctggggccccagaatatccaaacacagacctgaccccccaagcgacttactgccatcaaaacaaaggagaggcgcggagccagggaatacaatctccagagcctgcgagagaggttggagttcagcaaggaaagccaatgatttcaacttcacctctttcttttttcttttcttttttcctttttgttttctttctgtctttccttttctttctttttctcttgttttttttttgtttgtttgtttttttgtttttgtttttgtttttttgagatgaagtctcactttgtcgcccaggctggagtgcagtggcacgatttcggctcactgcaagctcctcctcccgggttcacgccattctcctgcctcagcctcccgagcagctgggactacaggcgcccgccaccacacccggctaatttttttgtatttttagtagagacggcatttcaccgtgttagccaggatgatctcgatctcctgacctcgtgatccgcccgcctcggcctcccaatgtgctaggattacaggcgtgagccaccgcgcccggcccttcttcttttcttttcttttctatttcttttcttctcttcttcttttttttaattttgagacggagtttcgctgttgttgcccagaatggagggcaatggtgcaatctcggctcaccgcaacccctgcctcccgggttcaagcgattcttctgcctcagcctcttctttcttctttttttgacagggtttctctgtgtaccctggctggagtgcggtggggcaatcatagctcactgcagcctcaacctcctgggctcaggggatcctcctgcctcagactcctgagtagctgggaccacaggcacatgcaaccatgcctagctaattttttcttttcttttcttttcttttttagagatggggtcttgctatgttgcacaggctggtttcaaactcctgcaatcctcctgtgtgagtagctgggactgtagacatgagccgccgcatctgacctcattgttctttcaacgaatgctgcctcctactctgtttctagcaaagatgatagttccattggcttctaccttatctcatcccatacagaattttgggtggtgaacaaagacctataagatttggccagagaactctctgagcagcagattaagtggagaatgaggcaaaaattacccccacgtaccaaaaaaggaggc

SEQ ID NO: 13027 - DNA, 45138 bp, Human
  misc_feature (1)...(45138): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcggaggttgcagtgagccaagattgcgccactgcacttcagcctgggcgaaagagcaagcctctcctggaaataaaaaaacagtgtataaacaaaagcaaaatatgcttttgatgaagaaagttagaaacattttgtctactttgaaattatttaaaggttgtttcaaattgaaaatataaaaataatgtagattaaaatacaacataaaaatttaaaaaatggccaggcacgatggctcacgcctgtaatcccagtaatttgggaggctgaggcgggtggattacctgaggccaagagttcgtgaccagcctggcaacatagtgaaaccccgtctctactaaaaatgcaaaaaattagccaggtttggtgatgcacgcctgtaatcccagctactcgggaggctgaggcaggagaatcgcttgaacccaggaggcagaggttgcagttagccaagatggcgccactgtactccagcttgggcgacagagctagacttcgtctagacaaaaaataaaaaataaaaaaaagtataagagatcataaaatatgtataaaaatctagaatggtcaaaaagacaaatttgatggactttatttttgttattttattttattttttgagacaaagtctcgctctgtcgcccaggctagggtgcagtggcaggatcttgactcactgcaacctcagccccccgggttcaaggaattctgctgcctcagccacccgagaagctggggttataggcgtgcgccaccatgcccagctaatttttttttcttttatttttttgagacggaattttactcttgttgtccaggctggagtgtaatgacgcgatccacgctcactgcagcctccacctcccaggttcaagcagttctcctgcctcagcctcccgagaagctggtattacaggcacgtgccactacgcccagctaattttgtatttttagtagagatgaggtttcaccatgatagtcaggctggtctcgaacacatgacctaatgtgatccgcccgccttggccatcgaaagtgctgggattacaggcgtgagccaccgcgcccagctgatggatttacttataacggtttatcaaattagctttagtgctgataatacattattactaaagtaaaagttgattttctcttgaacaaaaattatatgtattattaatatacataaaatatgtttgttcacattttgaatacattgaaaaagagagagagcaaaaaagatatagaattttcccatgctctggggtgggcctggctcagctcagggaggaagccctgcccgataaggctgcagcttaggctgtcactctttcttcagcctagggtgtgatcacatcttctatcactcagggtctgagtaggcggggccttaaacgttatccaactagggacgttgggctgggaactgtccaatcaggcacacagctggactggacaaagcggcttccgggatatggcggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatggtgagaatgccagtccgacatcccgagagaggggagggggctggttggaactggtgggaagcggctgtggcgggactcaggcctccccccagtcagctccacaatctgcgcccagctcgacctcagtccccttcagaaataagatggcggctgcgctgacagccagacccccaggagtcctgtttcttccctgcgcagtgactgtgccctgtcctggagccctctctgggcagctgtggacccgcagccccgcgtctctcccagattgttcagggacccggggagggtcgtcaggggagaatcctgactcgggttgcgggttcatgaacgggaagagctttggtctgtggggttcccaggccctcttttttcccattaaaaatttatgggcgtcactgcaaaaatattaaatactttaataaaagaatgattcaaaaattgtaccacacccagctgtggtttgtacttttgtggtccatggaaggggcctgaagaaaagattgttacaaggttcatgataaagaaaaccaaattcaataattggctaggtacagcaatctaggttgtcgttttttttttttttttttcttttttttgagacagagtctcacttttttgctcaggctggagtgcagtggtgtgatctcgactcactgcaacctccgcctcttgggttcaagcgattctcctgcctcagcctccctagtagctgggactacaggcgcccgccaccacaatttttttatttttagtagagacggggttttaccatgttggccaggctggtctccaactcctgacctcaggtgatccacccaccttggcctccgaaagtgctaggattacaggcgtgagccaccgtgcccagcctcgtttcttaatttttacatttaaggtgggaatatcctggttatgtaatcagagcttaattgtcagcttattcttggttaagcaagaattttgtttccgctaatgtagtaatttaccaaaaaatgctcttgagtttagattttttttttagaagtagaaatccggggactagagccacctcaatctaattgcctgccacttaattattttcacactccacaggggactgcttttttcctgaaattttcacatgtatcccaagcagggcctcaagtccacccctcatcccctattcctccagcctaactctggcttgcaggaaaatactaaatttcccgttttgtctgacattcccaaatgccaatgtcccctccctaattcactttatcatctatttgtcctttagggtagattttgatacctgttttaatttttatttatttatttattttaatttttgagacagaggcttgctcggtcaccccggatggagtgcagtggtgcagtggtgtgatttaggctcactgcaacctctgccttatgggatcaaatgattctcttgtctcagtcgcccaagtagctggaattataggcgcccgcccccacgcctggctaatttttgtatttttagtagagaccgggcttcactatgttgtccaggctggtttcaaactcctagcctcaagcgatccgcctgcatcagcctccccaagagctggtattacagacgtgagccatctcgcctggccaattaatcttttttttttttttttgagacagagtttcactcttgttgcccaggctggagtgcaatggcacgatctcggctcaccgcaacctccgcctcccaggtttaagcgattctcctgcctcagcctccctagtaactgggattataggcatgtgccaccatgcctggctaattttgtgtttttagtaaagacagggtttctccatgttggtcaggctggtctcaaactcccgacctcgggtgatacgcccgccttggcctccgaaagtgctgggattacaggcgtgagccactgcacccggccaattaatcattttttgacaaagcatttgatggcacatttaaaaaggtttgttttctttttgtaaatatttcctatgagaagaaagcaaagaataatctcctgacactgtattgtaaaatatctctgcgtttttttttcttctatcttccctagtcacagatatcttatcagaatgtttttgggtcaagttttccttttggaaactatagtgtgatgtgtcttcagtcaccattcggttttcttggacctgggtttcagtactgtattgggataaacgaagatacccaccatggctatgtctgcttagagtgtctagtaaatatcagcttctgggtcatattctctcataggaaaatctgaggtattgagtgtagcgtcccaagtgcgcaggtggatgccctgagtctaaaaggcatttcctagtgcacttttttttttaaagctaattttatgagacattaatattgtcttcacccaacccagctttcatttcttaaagacacattgctggtcagtcaatcagataccagtattgaggagaaaacaaataatttctgcctcctggtttcctttagagaacagaaaaatagtaaaaaatttctagaaaacaaaacaaaacaaaacaaaaacgagggccaggcatggtggctcatgcctgtaatccctacactttgggaggccaaggagggtggatcacgaagtcaggagttcgagaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgacagagtgagactccatttcaaaaacaaaaacaaaccgcaaaaaactgaccccagtgagatggtgtaagaacttgcagagtaaaatgcgcctgagacactcactggggcatagttcagagtctcctgagagggggttattgagcactttagtgagtaggatggggtgggacagtctctcaagtaattggatggcctgacttgacacatgattaagacatatctgtgtcttgaaaaggttttttcacttattttgacctaaggcttgttttcgttgtcttgagacagtttccctctgtcacccaggctggagcgcagtggtaccatctcggtccactgcaacctccagatcttgagttcaggtgattctcatgcctcagcctcccaagtagctgggactacaggtgtgcaccaccacactcagctagtttctgtagttttagtagagacagagtttcaccatgttagctaggctgttctcaaacttctggcctcaagtgactcacctgcctgagccttccaaagtgctgagattacaggcgtgagccattgtgcccagctcacctcggttttttaactgtgtattgcattttattagtagagcttgaaaggtaagaaaatatttgcaaagggcataaaagaggtgagtttcaaaaacattaatatctaataatatattttatttgttgaacattttcatttacctttttctttctcagagtgagtttaggaagtttctcggacatgtttttttttatggaggagtgatttttttttttttttttttttttgagacagagtctcactctgtcgcccaggctggagtgcagtggcgccactttggctcactgcaacttctgcctcccgggttcgagcaattctcctgcctcagcctcctgcgtagctgggatttcaggcacacaccaccacacctagctaatttttgtatttttagtagagacagggtttcaccatgttaggctggtcttgaactcctgacctcgggtgatccgcccgcctgggcctcccaaagtgctgggattacaggcatcaaccaccgtgcttggcctatggctgagtgatttcaaacagaattccatctagcttttagaatggtagctaccaaggaaaaaaataaagaaaaaaaaaaaaaaatctctcttcaatttcagctgtagacaatgaatacatttccacaaaacaatgtgatagataattgatgagttaaatagattcctgaaaacttcaattcctttttttagcagggtaaatccttggtagtgaacatctttgttctatatcctgtgtttttttgtgtgtttgattgttttttgagataaagagttgcactgcgacacccaggctggagtgcaatggtgcaatcttagctcactgcaacctccaattcccaggttcaagtgattctccttcctcagcctccggagtagctgagactgcaggcctgtgccaccacacctggctagtttttgtatttttagtagagatggggtttcaccatgttggccaggctggtctcgaactcctgacctcaagtgatctgcccacctcagcctcccatagtgctgggattacaggtgtgagccactgcgcccagccctatatcctgttattttgatttttgagtttaatgctaaattttatgtgatgaaacttggtacctcctagaagtgttcctatgtgattaattttttttttttttttgagatggagtctcgctctgttggccaagctggagtgcagaggcgcaatctcagctcactgcaagctctgtctcccgggttcacgccgttctcagcctctcgagcagctggaactacaggtgcccgctaccacgcccagctaattttttgtatttttagtagaaacaggatttcaccatgttggccaggatggtctcgatctcttgacctcgtgatccacccacctcggcctcccaaagtgctgggattacaggcatgagccactgtgcctggccttttttttttttttaaatggaattttgatgttgttgccctgagtggagtgcagtgggcgatctcggctcacctcaacctacacctcctgggttcaagcaattctcctgcttcagcctctcgaatagctgggattacaggcacccaccaccaccatgcccagctaatttttgtatttttagtagagatggggttttatcatgttggccaggctggtcttgaactcctgacctcaggtgatccaccctcccccccggcctcccaaagtgctgggattacaggtgtgagccatcacgctgggccaagcaatcctcttgtacctcagccttccacgtacctgggactacaggcatgcaccaccatacctaggtaatttttgtttttgtatttttttagagatgggatttttccatgttgctcaggctggtctcaaactcctgagctcaggcaatccacctgccttggcctctcagagtgctgggattacaggcatgagccattgtgcctgatcataccatattttctttattcagtctaccattgataggcattcaagtcgattccatgtctttgctattgtgaatagtgctgtagtgaacacccttgtgcatgtgtgtttatgacagaataatttatatttctttgggtatatacccaattattaggttgcttgatgaaatggtaattctgtttttagttctgtgagaaattgccacactgctttttacaatggttgaattaatgtacactttaacagcagtgtataagcgttcccttttctctgcaaccttgacatcatctatttttttgctttttaatagccgttctcactggcatgagattgtatctcgtggtttttctttgcatttctccaataattattgataggcattttattatatgtgtgttagccacatgtttgtcttcttttgaaaagcatctttttcaagttttttgtctgctttttagtgaggtcttttttttcttgtaaacttaagatttttatgaattctggacattagacctttgttagaagcatagtttgcaaatatttcctattattctgttggttctctgttttctgtgttgatagtttcctttgctgtgaagaagctctttagtttaattaggtccaatttgtcaatttttggtttttttgcagttgctttttgtatcttcaattatgaattctctgctagattctatgtctagaatgacatttcctaagttatcttccagggttttttataatgttaaaataaacatttcagtctttaatcttgagttgatttttgtatatggtgtaataaaggggtccagtttcaatcttctacatagtgcttgctagttattccaccaccatttattacatagggaattggttccacatttctattgtcacctttgttaaagatcagatggttgtaggtgagtgacattatttctggactgtctattctgttgcattggtctatgagtttgtttttgtaccagttccatgttgctttgtttactgcagctctgtagtataatttgaagacaggtaatgtaatgccttcagctttgctgtttttgcttgtgattaccttggctattcagactctttggttttatatgaattttacaataatttttttttttagttcttttaaaaatattttggtcatttgattagaatagcattaaatctgtaaattttggggggcagtatgatcatttttaggatattgatcttttctatttatgagcataaagttgttttccatttgtgccatttctgacttctttaagcattgttttgcaattcttatagagatctttcaccttcctggtattcgtagatattttattctttttgtggcagttgtgaagggattgtgtttatgattcgtatttggcttggatgttgttgatttacagggacgctactaatttttgtacacttactttgtatcctgaaatgatactgcagttgtttgtaagttaaagagcttttctatgaagactatatggttttccagatggagaattatgttgtctgcaaacagggatagtttgacttcctctcttcctgtttaaatgccttttatttatttttatttttatttttttgagatggagtcttgctcttcgcccaggctggagtgaagtggcagtcttggctcaccgcaaactccacctcccaggttcaagtgattctcttgcctcagcctcctgagtagctgggattacaggcatccgccactgcgcctggttaatttttgtatttttagtagaggtggggtttcaccatgttggccaggctggtctcgaacttctgatctcgtgagccacccaccttggcctcccaaagtgctgggattacaggcgtgagtcaccttacctggccaaatgccttttatttttatcttttgcctaattactctgacaagtacttccaattttatgttgaatagtagtgttgagagaaggcatctttgccttgtgccagtttccaaagaagaatgcttcgggttttttttttcttttctttttgagatagagtctcactttgtctcccaggctggagtgcagtggcacaatctcggcgctctgcagcctccaccttctgggttcaagtgattctctttgctcagcctctcaagtagctgggattacaggcacctgccatcacacctggctaatttttatatttttagtggagacagggttttgccatgttagccaggttgatctcaaaatcctgacctcaggggatccacctgccttggcctcccaagttgctggaattacaggcatgagccactgcacccgtccacttccaggttttgtccattcagtatgttggctgatggtttgtcatatagataacttattattttaaagtatgtaccttcaatggctaggttgttgagggtttttaacatgaaagatgttaaattttatcaaaagctttttctgcatctattgtggtaatcttgtggtttctgtctagttttgtttatatgatgaatcacatttattgatttgtgtatgttgaaccaaccttacattcccagaataaattctacttgatcatactgggttagctttttgatatgctgctggatttggtttgtcagtattttgttgaagatttttgcatcaatgttcaaaggtattggcctgaatttttttttgtttgttttatctttgccaggttttggtatcagaatagtgctgttcttatataatgagttgaaaacaagttactttttcttaattgcttaaaatagtttctgtagaaataataatcagcacttttttgtacatctgatagaattcagctgtgaatctgtctggtccttggctttgtttggttggtaggctatttattactaattcaatttttgagcttcttattcatctatttaggggtttcatttcttttttgttaattcttggaaggatgtatttgttcaatacctttttcattttttctagattgtcttgtttgtgtgcacagaggtgttcatagtacatttcaagatatttttgtggggtcagtggtaatgtctcttttgttatttctaattgtgtttatttgggtccttcttccttatctagttagtggtttatttattttttcatagatttaattcctggattttttgatattttgtaaagtttttatgtctaaatctcagtttagttctgattttggttatttcttgtctgctgctagcttagggattgattttctcttgcttctttcattcttttattgattatatcaggttgtaaaatgaagatctttctaactttttaatttgagcattaaatgctataaatttccctttaacattatcttagctatattgcagagattctgatgtgttgttttttagttcttttttttttttttttttaagatggagttttactcttgttgtccaggctgaatgcaatggcacagtctcaactcacagcaacctccgcctcttgggttcaagcattctccttcctcagcctttcaagtagttgggattacaggcatgtgccaccatgcctgcctaatttttgtaattttagtagagacaggatttcaccatgttggccaggctggtctcaaactcctgacctcatgtgatctgcctgcctcagcctcccaaagtgctgggattacaggtatgagccaccatgcctggcctgttttttttgttcttatttgtttaaaataacttcttggtttctgccttaatttcattatttaccaaaaagttattcaagtgcaggttgtttaatttttatgtaattgtatcagttgttttatttttattgaactatatttctgttcagctgtggtctatgtgtttgttctgtataattttgagttttttgaatttgctgaggattattctatttctgattgtgtggtcagtttttgagtatgtgccacatggtgatgagaacaatgtatgttatgttatttttagatgaagacttctgtagatgtctattaggactatttggtcaagtgtagactttaggtcctaatgttttgttaattggcttcttcagttatctgtttgttagtgcctgtgggatgttgtagtctcccactgttattgtgtcataatttaaaactcttatagatctctaagaacttgctttattcatgtgaacccatgaattttatacaacacctttctctcttctgctttttctcccataagcattcttacgtgtgcacacagtgtgcaaaattcagatgtccaagagttcaagcacatgtgatggacctgtctgttgtaaaacaaaatataaattaaaaataagaggcttggtccacattaagataagagaaaatatcttactaaaatctcttttcttaaaacatttagattgtgtgtagatttttatccctgtttttttgagatatatgtaaatcatattaacagcaaaataaaacttttgtcattttttttgactcaggattgtctttatctgggacctgagattaattgctctttttttgctttggcaagagattattcttatgatagtcttttaaagttgacacagatttgttcagagtaaagctcatccaagagcacacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttttcccttctctcgctaaaagctcacaattgcaggtaacaactgctgctactccacccatccgggtacctaaatctgcagctctgaattctaaatctaggtcttgaaatttgaaaaaaaaaaaaaaaaaatccaaaacttttatttgaggaatgaaagtctttttacttataaaactcagagagacattaaaataaaagcacaattacatctttctcccttccttcaactatgtattcatctcttgacattgttcactattgccacaggtaggtgtaagttaaactaataatgtcacactggacactatattctatacccttacccttaatgtacagtcaatcaataattaaagttatttatttaaacaagaatttctgacaaagaagtttgtatgtctctctctctttttttttttttgccttcacaaatccacttgtaactgctgctaatcaaagtgcaaattccaggcatcttgaatatttcttctcaagttacaatacttaagcttggcccaaataaactgtctacttatattcatgttgtgtcagcttttttttttttttttttaaatgtggttttgctcttgttgctcaggctggagtgcaatggcttgatcttggctcactgcaacctccgcctcccaagttcaagtgattctcctgcctcagctttctgagtagctgggattacaggcatgggccaccatgcccggctaattttgtatttttagtagagatagggtttcttcatgttggtcaggctggtctcgaactcccaacctcaggtgatccttcgacctcaggggatccgcctgccttggactcccaaagtgctggaattacaggcatgagccatggcacccagcccgtatcaagccttttttttaggtaaaatattatttagaattttctagagcagcctctatgagtagatcttttgattgtactctacttgctgtaacagccagaaatgcagaatgatgtttatctagaatctgcaaataaggtctggcctctgcctggaatttataaaacagggtcctactttagattgagaatgtacagaaaaccaataggaggcattttctgcattgtgagatgtcaacatagacattttagatccctcctttgagagtgtggctctttgaccttttcacatcttgtgttttcacctgctacagttatgtgagaggctccaggtgtaaatagaatctgatggcagaatctcttaagtgtaaagaagcatcttaggagtgagagatcaaggccacaaagtagccagagctctgagcacaagtatacttacctggaaaatatgatattagagtattcttgcacttctacataccaaaaagctagctaatcaggacaggtgatccaggttctgcagctccaccagggtacttccattttctatttagaatcagcctgagtctctcctgctggcttgctattgaaccatcagtccagggtcactggaaatgctctcacaatcacctaggtgtctttgagacatttgagaatctccagaacagaattgtgtcaggctgacaagagtgggcaattttgcttctgtcttagtgtaaatgaaatgagtcatcctgtgattgttcctcccctcatgcaagagctgtcttcggttggtacccagatgagagtttctccagttccctggtacttgggtaaaaacaaggaggaggtctgcagactcaaagagataaactaattgcttctatttcatatagtcattagaaaaatagatgacgcagtcatggtccctaccatgcaggaacttttagtctagactagcaactggataaatgatttaattatgcatcatatggtgggtacaataaatagatgtgtgcaaaaatatgggctttatttgggccattttctttatattgtgacttcagatgtctatacctgaacatatattaataaacaaaatttgtttttttttttttttgccttgctaagtaaacttatttatcttctaaattattctagaaaaccttaagggatttgtttaaattgcttattagtatgtgatatgaaattagagggcaatggggctaaaaaagattaaaattacacaaactctgagatttaagttttttttttttcttttaggtaagcttaaaaaaagaaacataaaaaaaaaatactccccagtggtgtaaagaacagaattttacatcaactctacaccctgcttcagccctgtttagattcaccctttttgaaggccttatttaagtcttgccctaccctggagttttgcctcacagaactaactagaagagatcagagttttgggtgatgaatcctgttgcctttttagagttggtgctcacacttttctgaaacccaatagcagataaatggaaaaataacatgtattatagggtcttaatttaataattttatattaaaaccagtgtttacagagacattccatttagcaacttgttttctgttcctgcagatatagtagttgattcacaagtcacaaaatagcaaatataaatacaataaaaattcatctacatttcattaaactctatctgtgtccttctcatctgtctgtatttagattttattccatgcattttaaaaaactcaatgataaacagaagaggaaataaaaatgctgggtctttattctaaatccttggatttattggacacttagtatcaactcacagggtattattagaatcaaataatgtgctatcacagtgctctgtaacatcctgttgatcacatagtacctgcttaataaacattgcattaatacatgtgcacatgttgttttccaaatgcagacttactcagaaaattgctgctttctgttttctctgtaaactttaaagagccagaaaataatatgatactttaagatagagaatggttgtcttcatttgcatcagaagtatttgtgtttttacaaaagtgctgagtgtaaggggctctgtgctgtacctcatttttctaactaatgctaacaatgagcccagagagagtgacaccagcattgacagaagacttgtttagaacacccatttatggaccatttccaaacctgcagaatcgcattacatagagtggggccaattttacaaagcgattcataagctcattaaagcttgagtgataatgcttaggtaagtggttataagatcaggcttctaattagaatcacatggccaatatgcagaactctctttacttgtgcccttttcacagtttctgttctgggtgaaagcgtctatttgttttaattaagtgcctcatgtgactctcaggtgccagcatcaaatatgaggagttcaagatacattcattgagttaagttccacttttgcactaaagaatgttctaggaatctgttctgtttgagtttggtaaggataggacagtgtggccaatatttctttccttttctttttctttctttttttttttgagatggagtctcgctctgtcatccaggctggagtcaatggcacaatctcggctcactgcaacctctgcctcccgggttcaagtgattctcctgcctcagcctcctgagtagctgcgattacaggtgcctgccaccattcccagctaagttttgtatgttaggtagaggtggggtttcactctgttggccaggctgatcttgaactcctgacttcaggtgatccacctgccttggcctcccaaagtgttgggatcacaggcgtgagacaccacacccagccaacttttgtatttttagtagagatggggtttcaccatgttggccaggctgctgttgaactccagacttcgtgatccacctgccttggcctcccaaagtgctgggattcgatatttctattactgtagcagaaattcctggtgtttgtaacaggggagggcgcctggggacaaaaagaagagaaacttatatttttctctctgtggagcagctcattgttcctgaatcttttttgttgtaaaggacagaaatgggtagagtttttgtgtcttgagccttctgactttgagtgtggtggtaacaggtgaacatgtgctcaaatttttaaaggcatattgtcaagatgcaggtgtaattagtccagaatatctcatctgagaaagaattctagaggaggaggagagagaaaaagtgactttttttttcagctaaacgtgtcccagatcaagagctgtgtctactctgctttctggaatgccttgcatttagtacttgcaaatcttcacttctatacctgtgttttttctccctaataagtttttcttaactacttttaaaaatgcttatgatagtcgagggtgtctgaaaaatttttctatatacaagaatcttctctacatcatggctttttatatgccatgtaagattctcaccatgaatttgtgatctgcaatattaaaaatgttctccttgtggctgatgaacatggagaggggtggatactcaatatttctgtggggaaaacctggggttcttagtaaagacatagaatatgtaatgttgaggttctatctgtgttctttattatctgtatgcattacacaattaagaaaatactcatttaaacaggatggcatttattacccagaaagctctgaaaaaattatcaagagatacctccttattagggtgctatagaaagactacttaaaatcactattacaaattacagaacatgaaagatatctgtatcttgaacttcccataaaactgatgttttcttatgattaaattcagactgtaatttagtgggtacaatatctcagtagtaatgtcgtgtccttctgggtgcatcagcacactataaaaacctgtcctagtgcagttgatgttgatgctaataactcaataagctctcttacagattttttcactatagaattatttttctcttcatcattagatatctttatggagctgatgtgcataaaccatcacgtttaatctggctgccttttgttttttgtctttttcttttttttaggttttctttacatttatttttctttggtaaatgaaagctctcatctttgtttacaggctagaaaaactaaaaaaaaaaacaaaaaacaaaaacaacaggctcttccacttactggatgtttgacaaaatagtcttttggggccaaaacattggcattactggtgagcttggtagagattcattaactcagactttatttcagatctccccaaaaaataatctgcattaacaagatgtccagtttattgtacacgttaaaatttgagtggtaccttctaactcaagatgtctattttgtctgaaaaatataaacaactatgtctttttcatctgaaaaatatacataactcattctgcattatgtaaacgtagcactcaaaaatgtatgttagtgtttatgccttcaattttacatgttatcttccagacaagtatcacatatacactgatgtggatattttgccactctattttctcagagttagagaatacattagaaaatgttcatgtgttgacaattattttattggataatttcaatcactcttataagtcagaaccagttctatttactctaattttaccttgagtcaaatgaaaaattctgccgatagccactttgtaaatatgtgtgtttgtgtgtgttttccagggactgttgacatttagggatgtggccatagaattctctctggaggagtggcaacacctggacattgcacagcagaatttatatagaaatgtgatgttagagaactacagaaacctggccttcctgggtgaggataactttaatacaaaattcctcacataaactaaagcttttatttttctttagaatgttttctggtaatttacgcattcagatttctgttttcaagaaaatactggggatttgtctgttgagaaaggaatttcttcaagatgtttcatcttgacctgaactttccacattcctgagctaatctgtgtcctgcactttagattaaggctaatttcagaagtttagtggcataaaatattgttacatcttaaaatccatttggcatcaccaatttttgattcagtagtaccaggcagtgaaattaagaacctaaaaaattaaaatatttcctaaatatttaaaaatttctgttataaattagtgtattagaataactttgttagcatattctattatatcctccttactgagcacattactaagttggtaattggagaatataagcaagattcatttagttatttttaataaaacaggtattgctgtctctaagccagacctgatcacctgtctggaacaagggaaagagccctggaatatgaagcgacatgagatggtggatgaacccccaggtaggtgagagtgaatacaacagatgacatggatgagaggtccaaagtcaagaagaaagccactctttaaagtgatttaagaagctgtgatccaaaggaaatagtttctgggaagcctaaattttttttttaaattatactctcacataggggcatcttctgcttatgcctataaaatctaagaattctactttcccttcaatgatcttcctccaagtttacagtgacagccgaagtactgttcatggcatacaaaagagtgtacaatctgacttcttttttcttgttttgtggacagacagatctgtctccataattttgagatactgtatgttaaactgttttttaagttctctttttgcatcatgtctgaaatgtgtgagagtagtagtttctgttatattgggttttttctttttggtttatttttctgcacatttcatcctgttttcattactgtagtcttgaaatatagtttgaaagtacaaagtaggatgtccttctgctttgttctttttcctcaagattgctttgactattcaaagtttattgtagtttcatgtccattttaggattggatttttcattactgtgaagaaaaacactggaattttgataaggagttctttaaatctacaggtcactttggataatatggcagtttcataatacttattctttcaatagaaataaaacattttaaaatttattagtgtcctctctaatttttttcattgatatatctttcacttgaaagatttatgagctccttgtttaaatttgttctaaaattgagtatttcattgatattgtacataagtttttttttcctctattttatcagatagtttaagtgtatggaaccatatcttgtatattaattttatattttgctaattaactgagtgtattcattaatttaaacaggttttaatgtactctctctatatacatatatatatgattacatgatctacaaacagcaacattttacttattggtcttcaatttcaatgactttaaatttttcttttgactattttgtcttccacatgctttcagtgctatgttaaaatagaagctagttttgcattagtgtctgtaaatttgaaggagcaaacacctcttcaagtttctataaactggtttcagaaagtaaaaatgtgtttttgttgggcccccagagtgatagaatgtcctctgggtttgtagtgaagaggggttgtagcttggccttaaggctgctgggtttgcacaagggtccaccttcagttgtcttcttaaaaggagcttggatagttgtaattctcatttaatttttggacagattgaatatccttcaggactttgctgtgcagggcagacccaagggcaggtttctgcactcaggcctgcatatggtgagttttatatcaggatgtggatgagcatggctttcactgagtacaggagaggattttccgaggtaactttgggtttctacataggcaaaaccggccatgaactatggctcagggagctggaactgagtcatggaactgcttcagggaccacagtaaaggtcaaggtctgcaggcctgccagcatggctctaaatgggtgtatttctccaggcctctggaaaggcaggacccccccagactgtgactgggaagagtttgggatgtttacagagtaagtttaaaattctcaggggaaccaagttaggtggaacaatttcttgtctttagccaaaaacagtagttctgtagtttgccacctgaatgaggacctgccttctgaaaagggttaccttcagtcttgggctttagcagagtttcacaactcctttcctggatctcagagttcttttaaaggcatttatttttgatctggggtattgtaacataacccaggcaggtcttaatattttgatcaaaagcaattctccaactttcatgtaccatgtagctgtcattacaggtgtgaaccatgatgcctggttctctcataaaggcatttttgtcagcaatggctgacaaattttcttgctgacagaggataagcaaataaggcacctttaattttttatcttattaatgccactctccatataaattttaactgttttctacttcaaatttgtctgtaattttagattcagacatttagggcaatataatagaatatacatgtcgtgcctgaattaaattagataattagtatgcaggcaggcaaaaaggaattatagagccaggcgcggtggctcacgcctctaatccctgcactttgggaggctgaggtgtgtggatcacgagatcaggagattgagaccatcctggctaacacgatgaaaccccgtccctactaaaagtacaaaaaattagccgggcatggcggcatgcgcctgtagtctgagctactagggagactgaggcaggagaatcgcttgaacctgggaggtgggggttgcagtgagccaaaatcatgccactttgcttctaaacttggattacagtagttttattttgtgtaaaataacatgtatttaaaacataaaaattgagactagtttcttttaaatgcttatctattaaaagtttctcattagcatctcctaattatgattttactgcatttactctgaaattttattgctacataatagatgccattaatttaaaacacctgccttccttgaatgcacagttacagtcaaacattgcagttatctagacaaattgtttgttaatgtacattaatgttgccaactagattttatgagtaaacatttctttcattattatcttccagttctatattagtgtgttttttaagtgcaggtttcttaatatcagtttattgtgtctattgatttcgtgcattataattttagacaatcggcaattctgtttgtatactttaagtcagtgtctggtttaattaaaagataaatgagccatatgtctgtcatagtcagattatctatatgtgtgtgtttatgtctacaaatatgacccaaatttggttatagtttacttgtatatattctttcttagctaattttctttttcttttttcttttttcttttcttttcttttttttttttttgagacagagttttgctcttgttgctgagtctggagtacagtgcatgtgatctcggctcactgcaacttcctccacctctcgggtttaagtgattctctagccttagcctcctgagtagctgggattacaggcatgtgccaccatcccaggctaattttgtattttttttttttttagtagagacggggtttgccatgttggtcaggcaggtctcaaactcctgaccttgggtgatctgcttgccttggtctcccaaagtgctgggattacaggcatgagccaccgtacccggcctcttaactcattttcagtgttggttttatcttgtctaagtgagtagccttggaaatagtcttattttcaccatgtgtttaatgataaatatgtattttctttgtgtgagaaaaacacttttgtgatttgaaggtaatttttaaaaagatgtataattctgtattttttccagtttttaaaaattattgttgtaaaaacacttagcatataatttaccttcttaaatctatttaaatgtacatgtcagggccaggcatggtggtggctcatatctttaaaaccaggattttgagaggccaggacaggaggattgcttgagcccaaaagtttgatacaagcctgggcaaaatatggagacaccctctctacaaacattttttttctaagaaatagccaggcatggtggtgtacacctgtggtcccagctacttgagagactgaggggcaggattagttgagcctgggattgtgaggctgcagtgagccataattgtgccattgcgtgcaagcttgggtgacagattgagaccctgtttcaaaaaaaaaaaagtgtatatttcaggcatgttaactatattcacatcgttatgcaaaagacttctagaaattttacatcttgtaaaactaaaactcaatatcccttaaataacatttacctattttatgctctctacaacccttggcaaacacccttccaccttctgtttttatgagtgtaattactttaaatatttatataagtaaaatcataacatccatcatttcattactggtttatttcagtggacataatattctcaaagtgtatctttaaaagtgacaagatttttttttttcactgttaaatattcttctttattttccatttcagtaaaacaatagcttaagatgcagggtgaatctatatttccttttttaattttatattttaatattattatactacaagttttagggtacatgtgcacaatgtgcaggttagttacatatgtatacatgtgccatgctggtgtgctgcacccattagctcgtcatttaccattaggtatatctcctaatgctatcccttccccctccccccaccccacaacagtccacagagtgtgatgttccccttcctgtgttcatgtgttctcattgttcaattcccacctatgagtgagaatatgcagtgtttggttttttgttcttgcgatagtttactaagaatgatgatttccagtttcatccatgtccctacaaaggacatgaactcatcattattgatggctgcatagtattccatggtgtatatgtgccacattttcttaatccagtgtatcattgttggacatttgggttggttccaagtctttgctattgtgaatactgccacaataaacatacttgtgcatgtgtctttatagcagcatgatttatagtcctttgggtatctacccagtaatgggatggctgggtcaaatggtatttctagttctagatccctgaggaatcgccacactgacttccacaatggttgaactagttgacagtcccaccaacagtgtaaaagtgttcctatttctccacatcttctccagcacctgttgtttcctgactttttaatgatcgccattctaactggtgtgaaatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttttttcttgtaaatttgtttgagttcattgtagattctggatattagccctttgtcagatgagtaggttgcgaaaattttctcccattttgtaggttgcctgttgactctgatggtagtttcttttgctgtgcagaagctctttagtttaattagatcccatttctcaattttggcttttgttcccattgcttttggtgttttagacatgaagtccttgcccatgcctatgtccggaatggtaatgcctaggttttcttctagggtttttatggttttaggtctaacgtttaagtctttaatccatcttgaattgatttttgtacaaggtgtaaggaagggatccagtttcagctttctacatacggctagccagttttcccagcaccatttattaaatagggaatccttgccccattgcttgtttttctcaggtttgtcaaagatcagatagttgtagatatgtggtgttctttctgagggctctgttctgttccattgatctatatctctgttttcgtaccagtaccatgctgttttggttactgtagccttgtagtatagtttgaagtcaggtagcatgatgcctccagctttgttcttttggcttaggagtgacttggtgatgcgggctcttttttggttccatatgaactttaaagtagttttttccaattctctgaagaaaatcattggtagcttgatggggatggcattgaatctataaattaccttgggcagtatggccattttcatgatattgattcttcctacccatgagcatggaatgttcttccatttgtttgtatcctcttttatttcattgagcagtggtttgtagttctccttgaagaggtcctccacatcccttgtaagttggattcctaggtattttattctctttgaagcaattatgaatgggagttcactcatgatttggctggttttttgaaaggatcaacaaaattgatagaccactagcaagactaataaagaaaaaaacatagaagaatcaaatagatgcaataaaaaatgataaagggaatatcaccactgatcccacagaaattacaaagtaccatcagagaatactacaaacacctctatgcaaataaactagaaaatctagatgaaatggacaaattccttgacacatacactctcccaagagtaaaccaggaagaagctgaatctctgaagagaccaataaaaggagctgaaattgtggcaataatcaagagcttaccaatgaaaaagagtcctggatcagatggattcacagccaaattctaccagaggtgcaaggaggaactgataccattccttctgaaactattccaatcaatagaaaaagagggaatcctccctaactcattttatgaggccagcatcatcctgttaccaaagccgggcagagacacaaccaaaaaagagaattttagaccaatatccttgatgaacatcgatgcaaaaatcctcaataaaatactggcaaactgaatccagcagcacatcaaaaagcttatccaccatgatcaagtgggcttcatccctgggatgcagggctggttcaatatatgccaattaatcaataaatgtaatccagcatataaacagaaccaaagacaaaaaccacatgattatataatagatgcagaaaaggcctttgacaaaattcaatgacacttcatgctaaaaactctcaataaattaggtattgatgtgacgtatctcaaaataataagagctatctatgccaaacccacagccaatatcatactgaatgggcaaaaactggaagcattccctttgaaaactggcacaagacagggatgccctctctcaacactcctattcaacatagtgttggatgttctggccagggcaattaggcaggagaaggaaataaagggtattcaattaggaaaagaggaagtcaaattgtccctgtttgcagatgacatgattgtatacctagaaaaccccattgtctcaacccaaaatctccttaagctgataagcaacttcagcaatgtctcaggatacaaaatcaatgtacaacaatcacaagcattcttatacaccaataacagagagccaaatcatgagtgaactcccattcataattgcttcgaagagaataaaatacctaggaatccaacttacaagggatgtggaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgattttcttcagagaattggaaaaaactactttaaagttcacatggaaccaaaaaagagcccgcatcgccaagtcactcctaagccaaaagaacaaagctggaggcatcatgctacctgacttcaaactatactacaaggctacagtaaccaaaacagcatggtactggtacgaaaacagagatatagatcaatggaacagaacagagccctcagaaagaacaccacatatctacaactatctgatctttgacaaacctgagaaaaacaagcaatggggcaaggattccctatttaataaatggtgctgggaaaactggctagccgtatgtagaaagctgaaactggatcccttccttacaccttgtacaaaaatcaattcaagatggattaaagacttaaacgttagacctaaaaccataaaaaccctagaagaaaacctaggcattaccattccggacataggcatgggcaaggacttcatgtctaaaacaccaaaagcaatgggaacaaaagccaaaattgagaaatgggatctaattaaactaaagagcttctgcacagcgaaagaaactaccatcagagtcaacaggcaacctacaaaatgggagaaaattttcgcaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacagtgagttaccatttcacaccagttagaatggcaatcattaaaaagtcaggaaacaacaggtgctggagaggatgtggagaaataggaacacttttacactgttggtgggactgtcaactagttcaaccattgtggaagtcagtgtggcgattcctcagggatctagaactagaaataccatttgacccacccaacccattactgggtagatacccaaaggactataaatcatgctgctataaagacacatgcacaagtatgtttattgtggcagttttcacaatagcaaagacttggaaccaacccaaatgtccaacaatgatagactggattaagaaaatgtggcacatatacaccatggaatactatgcagccatcaataatgatgagttcatgtcctttgtagggacatggatgaaattggaaatcatcattctcagtaaactatcgcaagaacaaaaaaccaaacaccgcatattcccactcatggggggaattgaacaatgagaacacatggacacaggaaggggaaaatcacactctggggattgatgtgggatggggggatgggggagggatagcattgggagatatacctagtgctagatgacgagttaatgggtgcagcacaccagcatggcacatgtatacatatgtaactaacctgcacattgtgcacatgtaccgtaaaacttaaagtataataataataaaaaaagaaaaataaataaagttaatattgttatgtgtgaatttgatcctgtcgttaggatgctggctggttattttgctcgttagttgatgcagtgtctttctagcctcgacggtttctacaatttggcatgattttgcagtggctggtaccggttgttcctttctgtgtttagtacttccttcaggagctcttttagggcaggcctggtggtgacaaagtctctcagcatttgcttgtctgtaaagtattttatttctccttcacttatgaagcttagtttggctggatatgaaattctgtgttgaaaattcttttctttaagaatgttgaatattggcccccactctcttctggcttgtagagtttctgccgagaggtccactcttagtccgatgggcttccctttgtgggtagtccgacctttctctctggctgcccttaacattttttccttcgtttcaactttggtcaatatgacaattatgtgtcttggagttgctcttctcgagaagtatctttgtggcgttctctgtatttcctgaatctgaatgttggcctgccttgctagattagggaagttctcctggataatatcctgcagagtgttttccaacttggttccattctctccgtcactttcaggtacaccaatcagatgtggatttggtcttttcacatagtcccatatttcttggaggcttttttcaattctttttattcttttttctctaaacttcccttctcgcttcatttcattcatttcatcttctgtcactgataccctttcttccaggtgattgcatcagctcctgaggcttctgcattcttcatgtagttctcaagccttggctttcagctccatcagctcctttaagcacttctctatattggttattctaggtatacatttgtctaaatttttttcaaagtttttaacttctttgcctttggtttgaatttcctcctgtagctgggagtagtttgatcatctgaaggcttcttctctcaactcgtcaaagtcattctccacccagctttgttccattgatggtgaggaactgcgttcctttggaggaagagaggtgctctgctttttagagtttccagtttttctgctgttttttccccatctttgtggttttatctacttttggtctttgacgatggtgatgtacagatgggtttttggtgtggatgtcctttctgtttgttagttttccttctaacagacaggaccctcagctgcaggtctgttggagtttgctagatgtccactccagaccctatttgcttgggtgtcagcagcagtggctgcagaacagctgattttcgtgaaccgcgaatactgctgtctgatcattcttctggaagttttgtctcagaggagtacccagccatgtgaggtgtcagtctgcccctagtggggggtgcctcccagttaggctgctcatggttcaggggtccgggacccacttgaggagtctgtctgcctgttctcagatctccagctgtgtgttgggagaaccactgctctcttcaaagctgtcagacagggatatttaagtctgcagaggttactgctgtcttgtttgtctgtgccctgcccccagaggtggagcctacagaggcaggcaggcctccttgagctgtggtgggctccacccagtttgagcttcccggctgctttgtttacctaaggaagcctgggcaatggcgggtgcccctcccccagcctcgctgctgccttgcagtttgatctcagactgctgtgctagcaatcagcgagactctgtgggcgtaggaccctccgagccaggtgcaggatataatctgctgttgtgcggttatttaagcccgtcggaaaagcgcagtattagggtgggagtgacccgactttccagatgccgtctgtcacccctttctttgactaggaaagggaactccctgaccccttgcacttcctgagtgaggtaatgcctagccctgcttcggctcttccacgctttgctgcccccactgtcctgcgcccactgtctgtcactccctagtgagatgaacccggtacctcggatggaaatgcagaaatcacccgtcttctgcatcactcacgctgggagctgtagaccggagctgttcgtatttggccatcttggctgctcaagattttttttttaaaactgaatcatattccattctatcatacatgtcttcaaggtcttttgttgcatattttatatatagattcataaatgtaattgctgtatttgataattttatttttagttatttgaagtacatttataacataataaaatagtatgtgcatccttgttttccaccaacgatgcacatgggtttcttttttttcttttctttttttttttttgaaatggagtctccctttgtcacccaggctggagctcagtggcacaatcttgactcactgcaacctccgcctcccgggtttcaagcgattctcctgtctcagcctccttagtaactgggattacaggcacgtgccaccacatctggctaatttttgtatttttagtacagatggggtttcaccatgttgatcaggctggtcttgaactcctgacctcaaaatccgcccgcatcagcctcccaaagtgctgggattacaggcgtgagccacctcacttggccaagggttttactgcatcatcaacagattaggtgtttttaaaaaattgatagtggtcatttaaatggatgtgatggattttctttttcgttgtgatttttatgcatttctctataaattagaaattttttgtgtcctttcaaattttttgtttgtgtttttcgatgaaaatgtatttcaattattttcctatttgtaaataaattcattcaaatttatttagttttaaaagtcgtttctattttttgaatattgactcctatcacatgtgatttgtaaatattttcacccattttctaggaggccttatccctctattaaatgtttacttacatatgcagaaatttggaagtgtagtatagttaaatttttgcttttttccttgttgcttatgcatttaatgttgtagctaagaaaatggcgccaagattattgtcatgtgtttcccctatatatttttaaatgatgaagaagttatctggcctggaatggcacctcacacctataatcctagcactttggggggctgagtggggtggatcatgaggtcagaagtttgagaccagcctgaccaatatggtgaaacctcatttctactaaaaatacaaaaaattagccaggcgtggtggtgggtgcgtgtaaacccaggctactcgggaggctgaggaaggagaataacttaaatccaggagacagagattggagtgattggagagcatgccaccacattccatcctgggcaacagaatgagactctgacttcaaaaacaaaaaaagttatcttcttatgtctaattaaaagatttttccacatatggtttaaggaaataaactttattattgtattttttattttttttgagatgaagtctcactctgtcacccaggccagagtgcagtgacacaatctcggctcactgcaacctctgcctcctaggttcaagcgattctcctgtctcagcctcccaagcagctgggactacaggtgtgtgcgaccatgcctggcgaatttttgcatttttagtagagaaggggtttcaccatattggctaggctgatctcaaaaccctgacctcaggtgatccacctgcctaagcctcccagagtgctgggattacatgtgtgagccaccattcctggccttatttgtttgttcttgagatagggtctcactctctcaaccaggctggtttgcagtgttgtgatcatggctcactgcagcctcaacctcccaaacttagaagattctctgattgcagcctctcaggtagctgggttacaagtgtgtagcttcatgtcctcccagtttttttgtatttttggttgagacaaggttttgccgcattgctgaggttggtctcaaacttctgagatccagtgaacaccccactttaacctcccaaagtcctgagattacatttctttttattaagtagtttaattaatttatatttaaaattatttcttaaaatgaaattactagttttattgctattgttttatgtgtttgagtggtatgttttttcttatttactgttttattgccttattttaattgtgtagtgacatgcttcaattattttttaaattttgttttgcatactttctataaatattatcttcataatcctcttgtatattagtctgttttcatgctgctgataaagacatacctgagactgggcaatttacaaaagaaagaggtttattggtcacagtttcatgtgactgaggagtcatcacaatcatggtggaaagtgaaaggcatgtctcacatggtggcagacaaaagaaagagcttgcgcaggaaaactgccttataaagccttctgctttcatgagacttattctctatcatgagaacagcacagaaaacatctgcccccatgattcaattacctcctactgcatccctcccacaacatatgggaattaaagatgagacttgggttgggacatggccaaaccacatcatcttaaaaatggaatttacataaaacatctaaaacttaaaaatatattttaatctcatgacaacttcagttgaatataaaaattatacctctgtatttttcagtttattaatataaaaattattttgtgtattaacatttatgcagatttttattgttttaaatattctacagaagagctttaagggttttatgcatcatcattatgatagtaaagatttctacatttgtatatttacattcaatagagagctttatttttatatatggttttatgatgctgtccagtattattttatttttaaataaaattgactcattttagcatttctttgttgttgttgttgttgttgttgttgagatggagtcttgctctgtcacccaggctggagtgcagcgggacaatctcagctccctgcaagctctgcctcccgggttcacgccattttcctgcctcagcctcctgagtacctggaactatacgcggctgccaccatgcctggctaattttgttttttttgtgtatttttaatagagacggggtttctccatgttaaccaggatggtctcaatctcctgacctcccgtttcttttttttatatgcaaactctcgctgtattattcaggctgatctgaatctcctggtctttagtgttgtgacagctttggcctcttaaaactgcaggattacaggcatgagccacagtgcctggccatcatgtagcatttttttgtagaactgtgctagtggtgatgaactccctcaacttttattttggagatttttagttttcatcctatttttaaagggaaataaatttaaatcaaatattcttggttacaatttttgtttgtttgttttactacatcaaaatttgggaaattctcaccttttatcttcaagtaaccactgtattgtttttttttccccatattcttcttctaagattaccttaatgaatatattgatctacttgatggtgtctaataagttttacattccatgttttaattttgttttgcaattttatatttttgtgttatatattctagcatatgccaccatacatctgatatttgtgttttgattttttagtatatatcataattgtgcatgacaatatttaactttgtacaatttaagaccctgtggagcaaaatcaaatatgaatcagccatatgtctttttccagtagaattatatctgtttgtttgcctgtataaatgttatcttttttaaattttttttttgagacagagttttgctcttcttgaccaggctggagtgcagtggcacgatcttggctcactgcaacctccgccttccaggttcaagtgattttcctgcctcagcctcccaattagctgggattacaggcgcccactaccaagcctggataattattgtatttttagtagagacagagtttaccatgttggccgggctggtcttgaactcctgacctcatgatccaccctcttcagcctcccaaagtgctgggattacaggtgtgagccaccacaccaggctacccttggtttttttttgtttgttttttgtatatttgttgtataggtttgttgtgaatggttttctaatcctttgtagatgagtagttataaaattcttgtaatttcaacatcctatttatgaatctatatgatttttgtgtgggagaaacacttttggatttgaatataatttaaaactcccataactctgtatctcttttgggtattattatttttacttgtcaaaaaaataacaaatttaccacaaaatatttttaaatattcagttaagtcacactaattatcttgacattgtcatgcaacatattgctagaatgtttttatcttgcaaagctaaatcttaatacatactgactaccacttttttcttgttttttttcttttttgaggtggagtcttgctctgtcacccaggctgaagtgcagtggcaccatctcagctcagtgcaacctccacctcctaggttcaattgattctcatgcctcagcctccttagtagctcagattacaggtgaccgccatcatgcctggctaatttttgtatttttattagagatggggtttcaccatcttggccaggctggttttaaactcctgaccttaggtgatccacccgcttgggtctctcaaagtgctcagattacaggtgtgaaccaccatgcctggccccaattttttctgttttatggcactttgcaaacgccagtctgttctttgtttctaagagtgtaactccttcatatatttcatacaatctgtcgttttgtggctggctcatttcattttacataatgccatcaacatttatctttatagttcgtacaatatttcctgctttttgaagactgagtgatatttcagaatttttatatttcaaattatatctactgaatgatttggtgaaagaaatctgccttgcttttacctattggcttacagtaacaatgctgcaataattatcactatgtaaatgactccttatatgaccatgtatgtgaaagtttatatatgtgctgcattctattttattagtctactttttcacctttatactcataccaaattgttttaattctgtagctttgtagtgtgatttaatcaagaactttaatgcctccagcattgttccttttattttttgaagattgttgggtactttattgtctcttgagattctatatacttttggggttgctgttcctgtttcttcaaaaatgcagtgagaaatttgaaaaacattcattaagtctgtctgttgcattgagctggatggaccttttcagaatattaattatttcaacctttgtttaaaagcacactcaagggtgtgttgtttaatttctatgtatttgtaaatttttcagtttttctgtcttattgttttatactcgtactccattttactcatagaaagtagttcatagaagtttacttttaaaaagtttggtaagacttcctttttggcttaagatgtggtttatcaagtaaaatgtatgagctattgagaaagaggtgtattctgatgttgtcgaggagtgttctccataactctgtttggaataattgttttatactgcctttaagtagtctgttcccttattaacattctttcttgttttatttttattacagaaagtgtggtattaaaatatcttgctataattgtattgctttgtatgtgtttcttccattctgtcaatatttgctttatatatttggaaccctaatgtgagacacacacacacacacctgcgtgcgtgcacaaacacatacacacacacacacaaatatacacaaatttttcataggttcccagtgaatgaatctattattttttgatgtcctttgtttctttggagtttaaatttaaagtacattttataaaatattataatttttgacttaagatgtagcttgtgtaagattattttgactgtttctgctctcatttgattaatatttgcatggaatgtctactttcttcctgcctcttccagtctttttttatcattagatttcaactgactcttgtagaaaggcaagatgaatctcagtttttaaaatattttaataaaactatttattgaaaatatgtctcaatttaaaagttaattttatatatattgaaataattttctgaaatagaaagacttactgttattttattaagtattttatttgattcttgcatctttgtcttttattctctttccatctttctttgtgtctttttgatatttgtattgataggctttgacttattttgttttgtgtatttatacaaatatttttgtggtacattggggattacatataacctctaaaagatacaacaacatattttaatctggtaaataaacttaagttgcgtacaaaaatttgttcttattataccttccctcaaatttgtcattgatgttgttaattatatctttttatattgtatattcattaatgaatatttaaaatgttttctatgcttttatccttcaaatttcagagaataattaaaaatgttttctgcaccactagggtaatgctaagaaatttgacttttgtgtatttgcatatttttcccagaaaatcatgtatttttatatgattctgtgtttttattggaatcatgttattttcagtagaaggaactcttttcagcaccttttatatgtagggcatatgcatttccaatatacttttttagaatttggttactttggaaggtttttactttttttatttggcaggacagatttgctgatggtattattctcaattaattaaaccttttttttttccacaatttttgtcatgactacatcacacagttcccttatggcctgcaaaatttttgttaacagttcactgactatctcataagattatgtttgtaaatggcacatcactttttttctttttcttttttttttttggaaacaagagtctcactgtatcctccagccaggcttgagtgtagtggtgtgacctgagctcactgcaagctccacttcctgggttcaagtggttccccttcctgggttcagcctcagcctcctgagtagctgggattacaggcatgcaccaccatgcctggctaatttttatagttttagtagagacggggttttgccatgttggtcaggttggtcttgaactcctgacctcaggtgatcggcccaccttggcctcccaaagtgcctggattacaggtgtgagccactgtgcctgacctggcacatcagttttatctggcagcttcaaaggtaatctttttgtctgtgacttttgaaattgtgcttatgtatgtgtttgttataaatatctttttgttattctagtttgtttgttgagcttttttatttttacatctttttttttttttttacttttaggatctgtcagtttttttgtgtatattttatctccacaatttgttttttgatatcttaactattttttattcttgtcctcatttttctgattttccatagttgtttctgttcccattttaatcagtattattcagtttattaccaattattaaaattaatgtatacatcttttttatgatttctttcagaaaattttgtgatatttttggtgggattgtattgccctattttgtatatattataatccttgattaagatttagacattaaaaaaagctacttgtcaaaatcttataatgtagctttgtcatggcatattctgaaaacaattgtctttgctggtgattatgagagtttcttaaacatattcttaggatatgtgttgtctgaaattttatttttattatttaattaggagagattactcgttaatttgtagcgtcatcacttgctacaccttttccatttctgtggtactgcagtctctctgctgctgtaacatttttctttggtctcagcagactcaaactctcattccaaaatataccaccatttctttcagtactttatgtcatgagagacagaaaccagtgtcaggaaaaaaccctaaaagccagaaatggcaatgattgtgccggtattttacctttcttttaaaacagaaaccaagagttggcaatttacttgtaaagacactatggtatagtgggaaacaggaaaagatgtattgagtaaatttaacagacttttctttttcttctttgtgtttttttgcattgtgctcacctgggacactgcacacacttaaatcatttatgaattttccacagatgtattttggtctgaatgtttttgttacatttatgtctatgaaagaattagagcctgtggtattttgcaatgctatcttgtctatgtagtttgtataattttataggtaagatttttaaactatattcatgtgagtctagtaagtggagtaatttatttatttttatttttttttcaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggtgaagcttttaatcgatcctcaaatcttactacacataagataattcatactggagagaaaccttacaagtgtgaagaatgtggcaaagcatttatctggtcctcaacccttactgagcataagaaaattcatactagaaagaaaccctacaagtgtgaagaatgtggcaaagcatttatatggtcctcaacactaactagacataagaggatgcacactggagagaaaccctacaaatgtgaagaatgtggcaaagcttttagccagtcctcaacccttactacacataagataattcatactggagagaaacgctacaaatgcttagaatgtggcaaagcttttaagcaactctcaactcttactacacataaaataattcatgttggagagaaactctacaaatgtgaagaatgcggcaaaggttttaatcgatcttcaaatcttactacacataagataattcatactggagagaaaccttacaagtgtgaagaatgtggcaaagcatttatctggtcctcaacccttactaaacataagagaattcatactagagagaaaccctacaaatgtgaagaatgtggcaaggcatttatatggtcctcaaccctaactagacataagaggatgcacactggagagaaaccctacaaatgtgaagaatgtggcaaatcttttagccaatcctcaacccttactacacataagataattcatactggagagaaaccctacaaatgtgaagaatgtggcaaagcctttaactggtcctcaactcttactaaacataagataattcatactgaagagaaaccctacaaatgtgaaaaatgtggcaaagcctttaagcagtcttcaatccttactaaccataagagaattcatactggagagaaaccctataaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaatatatttttctttgaatatgtgacctttgcctgcaagcacatatggactcttagaattgatttacataaaattaaatatatacttctattaaagataaaccttaggtgtaaataaattatggagtaagtatgtttgtgtgagtataagtttgaaactatttttagcagcaaaaagaaatactcgaacaaaataaattattttaataaggtgtctaatttactagaaaacaaaaattttcaaaaatgctgaaaccaaatctatgctatttgctttgtattgaatttattactgtacagtctttgtgcttatgattcagaatctccgcatgcaaattctgtgttttaacttgactgatactcatgctagactcataactttctttgtttgttaattgtttgtttatttatttatttttgagacggagtcctgctctgtcacccaggctgaagttcaatagtgtgatcttggctcactgtaacctctgccttttaggttcaagcaattctcctgcctcagcctcccaagttgct

SEQ ID NO: 13028 - DNA, 15546 bp, Human; identical to SEQ ID NO: 12696

SEQ ID NO: 13029 - DNA, 105189 bp, Human
  misc_feature (1)...(105189): n = A,T,C or G
tttgtaatgtagaatctctgtcaatgtaatagaattagttaagattgaatgttcactagattttgtgtttttttttctagaggtatgggataattaatgaagaatctatttttaaggattagattaatgattaacaaggataggtaattattattattctttagggcaagaatataaggttacatttgtttggagagcatgtatgagggagtttatatgcatatgtggatgtatccacaggacatgcaaatgtataatatacaaatatgaattataaatttaaaataaaacatagcatatgtcagctatgatcattctcgtctttctccagggctatgcgtatgtattttctatatcttaaaattgacaaatgcctgctccatggatgcctcagagaccatgcatcttgtcagtagcattcttagaagcttagcaaccaacttggcagaggtatagggaatgatgcagcacatataatttgaaataacatagacttctgccttgcttgctcaaatcacaatttctaacattaatacaagttctgttatctttttagaggaaacaagatggatatgaacctactgatttattagcaatattttaatggaaaatgggagcttaaataactaggaagaaaagaaaatctgtaatttatcaattaaattatgatttaactctttcttttgatgtccttttgtttaatctatgaagatcttttatttgtaggcataagagtttatattaaattagaattttatgccagagtctaaactgttttaattttcatagatgcatgttcagtgtatctctctctctcctctctctctctgtctctctttctccctccccctctcctccccactcccctctacctacccacctctttctttttcatggaagtcttttaaagaatgtattctgttcctcctggagatccattgaatatcaatatgcagccctgcatacaatttatgttcaacttacctaagataccacatatatttttccagaatttttaggaattttaaaacattttaaaatatatttataatgtataaaatatattataataataatgtcaactttcatggtaatattttacctgaaaaaattttaacgtaaagaattttctactaaaaaagaatattgttaatataccagcttcagagttgttaaaaaatattgttagatatccgggggatctttattttaaatttgccttgtttttctttttgtttttttctctcctttgtaaagtaattgcaattatagaaaagttttaagacttaaagatatcagaaggtttaggttagagctttaataggccaaatgccatctgtttctacaatttgtaacattttattattaacaactccagaagaaggaggcggtctatttcggttgtgaggacagatttctgtccatctgtgcccgtattgccgcatgtcacttgtattttagatctacatagctctgagccagtgtagatgccatggcaaggtcaagaggtggagaagcctgtcagtacattctgtctctgaggctgtgacaaccacaaatgggtgcttctagcaccgccctgaggcagtcattctgttagaccttggagctggactttctgtaatatcatttcaagggaaaatgttaactttaaacatttaaaaatatcagacaaagaactgaatctatgatgtgtctttggttaatgtcagaatccttattagggtggctcattcctcaacatttaaaaatgttgaaagtcctacggtgattgttcttctttttatcagtttctttgtaactacagtgatgttagggacagcagcatctatatggatttttcattttattgcgaaatagctgaaaagagtataccaggttaagactaactttaaatactttgaaatgtggtgtgttaatagtcaaccccttaaaaaaaatcttagtatcttaaacctctaaatatgtgtgtatatatatgtgtgttctttttttcttttccccaaagtgcttatcagattgttgtggaagaactgcacccacaccgaaccaagagagaagccggagccatggaatgctaccaggttcctgtcacataccaaaatgccatgagtgggggtgcaccgtattactttgctgcagaactccccccgggaaacctacctgagcctgccccgttcactgtgggtgacaatcggacctaccaaggcttttggaaccctcctttggctccgcgcaaaggatacaacatctatttccaggcgatgagcagtgtggagaaggtgagcttcctccaggatttgctttttccctgctttgaagaaaagctgaagtcaaattttatgaatactcagtagcatccgtcaagaaaaaaaaaaagaaaaagaaaatttgcatgtagggggttctgttctcaacagtgtgcgcagttttggggctacagtagggctgaggccgcacgccagttccatttcacagggttcctgtttcctagtaactgcttctactcgagccttcctcaggaaagcccacaatagcaattgagagtaaaatgatttgaaaacgtgggtgtgctgctgctgggactccaccctcagtaacgatcaggcattgttctgtcttccttgctcagtggtggcacacttcaagagattaaatttactgcaggataaacagaatgcgtgttccacagcaggctaataaaaccttataaacttttcagggttttcaagccaaatagtaaataacatgtaacaatcctctgattacaaagtaatagggcgcctgtggtatatctgactgaacctaaacaaaaggcagcctggcgatgactggctgctgagccattacagaaggctgctctctgtttccctggttgcccctccttttcccattttggacacagttgtttttgaacactgctgctgatcccaaatgaatattgaagaggaaaacacaacaggacattagaaacgaccggcagttccgtatgtgagaaaacaacctggcctttcatgcctcatgctgttctctttggaagattttctttcctaaaacttatttttatttatttatttatttatttatttatttatttattggcagacagagatagagggaagacaaatgttgaggatagaaattttcacaatttaaaatccaatagaatgatgacattttaatagacttgaagccgtataggaaattgctgggtttatgtaattgagtccctaaggtgagcacctgggagtgatacatgatatacaattacatcagtcatattatatcttagaagagtttaattggaagacataacaatccttttgcatttctgcaggggccgtgagagctttgggtattgattggctgcttttgaatcaaagctttgttgtttgcttgcctgtatgcttggcttgtaggtagcaaagaaaaaggccacagcatcttctaagatgtgctccagagtcagaggctgctcatggttgaagatgctcttctcgtttacctttaaagaactgaggtctttagagagtagtccagtgtccactttctgcctacatatcattccataccactgttacaactgggctactataaaaacagaacactatggaagttattagtccattctgggtataatatagcattgagtaggaagcatagttttgtgtgagggttttgatctttagagaggttccaaattaactttggttatttggtctattataccagaggagtgttaatgaatgtctgttacttataaaggattttctctgcattctttaaagctttttgatatgaattttctcttccaattgttaatatatctgcactgtggtttaatcaaagtacagaatagcaacaatatatttcacagttatcttggcaaagagttttaaagttgatgtgacttctacaagtagagattggtaatgccattagaaagttaaacagcaattgcttttaagaaatgaaaatcctttggggcctttatgggaatgtgaaataatctcttgcaggttaccatgaaggtctcaggccacaagtaatagaagtgcaacattttatttttaattactaattcccccctcactgctttattttaatttaaaaataaaaaaataaaaaatgcttaagtggaaattgtaaactcttttataaattatcaacatatagaactactcaagatagagttataaatgcatcttgcaaacagatcgcctctggtttgttcactggctttgataccttttctcacctcttgtgtattcagggatgtacgctgactcaattaagtcctagaggaggaagagtggggccaaaagtagctggcagggacatgtgtctcctactgccacctgacagcgttaaaaataatcatattttttcttgtcctttcctactgcttctactttgtatacccgctctgtctagcaagaggaggaaaattatgtatgctgagaaacatttaactcctaatagctaaattaaaagaaagaaagaacagataaattacaccataactatgatgtaatgttttgatgatctttctaactgctatcatttagctttttagtcatgctaggatccagatgaaagtatgtaatgttcagctttggtctcagtctacagttctcagatgaaaattaaatttatatttggaactgtttttattagctttgcaagtacatttttctgatagtttacgaagcactatacatgaaaatagaatgctatactacttgtcacaaactaacctgtttcattgcaaggtaaaaacaaatatttacatctctataaaaactaaaatatttttcaaagttcttactttagatttttaagtatccctaggggggcatattttttaaagttttcttaatattaaaattctgttgtttataatccctttttatgaccccagatggatcttcataataattatagtttacgaaacaggaaacattatctgtacattgactcttttttttttcatttttactctatcaggaaactaaaacccagtgcgtacgcattgctacaaaaggtaagaggtttgctttttttgcttgttttaactactctcaccccctttctaaaatggaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgttatagttagttctgtgactcatgtgggtgtctttaacaactaatggggtgctacttcccatcctctagtacttgactgaaggaatcttgttatgataacaggaaagatctagaaaaccttagaagggcttatttctgccatttagtgtctgaaaaatcttgtgctgctgatcaaccaatatcttaggaaagcgtcagcaatagcagatgaaaatagcaagttgcttgtttaaaaacctctattactttccattgtagacaatcaaacataaaaagaaccaagctaattcatgtttacataagattatagggatagagattagtccatatcttcatcagtagtgcagttagcttgaagatcatttactttttttaaaacttattctgagaaaccagatctgtgatggctagctcataaccagggcaattcctgctgacctggcatattatggcttagctgcctagtttctttgacaagagaaaacatttgcatctttgaatgagtatttagagttccaagtgggggaaagtctcctacattctctgtgtttttaattcttcatttaagagttacttgattgtgccaacaaagaataaattgctacttggtgtattctagcaagagaaacatgaaaaagctgtctgcatgcagacgtgggcctcctcaaagggttggttcttggggtggtttgctgccggaattagtagcagacccacatttgtgtccagtagttgattcatttggggtaaaaatgaatggccatattctgtttgtactggcatctttcctttcatcagttttctccatctaatcatcagtctgctcaatcagcatttgtgctttactcctgatttgtaaggcaataaagaaagactttctctttgacgcttgtgaataataaagaagctttatggaagagaaaaaaatatactttttcaattcacttatgaagattccttttggtagtttttatttaaaaaagcaattcttaaagagaaaatatacacagatacatacgatgtataaggattttattttaaaaatttagcttactgatcaggaacgagagttgaaatttttaaaagataatagaagaaagcatttaggtctatatcacctgtgtttttccagatttaaagtagaaccaaaattgtaaaagtgtcccacattgacctctgaagttctttagatatgtcatgctatgtttctgtaactgagaaatggtagctatatattaccctaacataacttttttattcagttatttcattatttgctcttgcctgagatgtttgtgtccttttatcgctctctcgatacaaatttaaaaaaatgacaaatatcacatgatatttaaactataggaggattgagatcctggaaacagtcttaccatgtggcatagaataattgacagaaactttgaagtggtaaaaaatagtccattatttgtctaataatccagctctgctacacttctggatctcaggaatgcagtgtggtgtggtgtagtgagtaagagaaaggactctggccttacactatctgagttcaaatattgactgtgtcccttaggaattttttagtattgagaaacttatgtaaaccctcattccaaaaattaaataatagagtacctacaccttcttattgttgtgaggattaaaataacatatataggccagacacggtggctcctggcactttgcaacgccaaagtgggaggatagcttgaggccaagagtttgatatcagcttgggcaaaatagcaagaccctgtttctactgaaaatttaaaaaaaaaaaaaatgttagccaggcttgatggagctcacctgtggtcccaggtacttgggaggctgaagcgagagcatcgcttaagcccagaagttccagtttacgttgagctatgatcgtgccactgtactcctgggtgacagagtgagaccctgtctctaaaataataaaataaaatatatatgaagtgcttaaatagtgcttaacatattataaacagtacatgtgttaactatcttatcattatgctaataattttgtacttaagagggacataacttatgttagacagttatgaatgaaatatgtataaaaacaaatctaaattttcgtgatcgagattgctaggacaggggagaaactaagggttttttgttcgcttgttttttaatgtttctgccctggtctaatatattttcttctctgaacctttagcattttttccacatatgaaaagctaaccctgtttctacaaaaactaaaaaaaatgagccaggcatggtgacttgtgcctgtagctccagctacttggaagatgggaagattgcttcagcctaggaatttgaggctgcagtgagctatgattgtaccactgcactccagcctgggtgacagagtgagactatgtctcaaaaggaaaaaaaaaagaaaagaaaagaaatgaaaaagaaaaactaccacatttgttaaagtaacatcaacttattgcctgactacattttaaactaacatgcaagtatggtcagctttggtgtgaaatttttcaatatgaaaataaaaagttttctgacagggcgttttgaagaaacatttaatagtcaaaatggcataatcatatgactgggaagaggcatgaaggaaccttctggtgaaggagtggttcagtatttcacaggtgcatatgtaggtaaaaatctgtccaactgtacatttaaaatgtgtgcactttactcttataaatttgtgtgtggatatataggtagataggtaaagtatttcccaatataaaaaaatgaattatacattaaaaattgcatggccagagttagaaacagcactgagaatattatagaggagtctctggagtttgaaaggctcaccttgctagcttcagtgaaggtttccttctatcagacgaggtgcatcttcagtacataagccactttcagtgagaaggacaaccctgcccaggaatccctgggctgaatgaaaagggtctagaaaggacctttcttggtcctggatgactcctatgggcaagtcttgtgtttcagctgccctacagtcagaccctcccctgcctcccaacccccaccccctttccagtgtcagttgtgagtactgaagagctagaaccttgctagaaccttgctttcctaatatcctttgtatttagatcaattttgctgaaaagaacttagttctctggaaaatctggtgtccctccataagacattccagtttgcagtgtgtccttttaccacacaaattttctgttcaggccatatgcaacagtctgttgctttttttctcatttttttgaaaacttaaaacattccaaatgtagtctgggacaaagtaccttgaacaaagtgtgtgtttctctcactcactctctctctggaaattattttcacatcccctttattttagaaaaagttgtattttgtatggagaagccagagttcattgttacatgttagtatcatatttataatagaaaataaaacattttactaaaacaaaaaaaaattatttagccaaatttgaagctctgatttaatagtcttatacatcactatatgccagggacaaatacagagtgagagtcatattagatacaataaatatttgttgagttggtaattgaatttgaacaaaacgtaaggtagatgcttctgctttcacgtttaatcaaacaggttacagtactgtctgcaattatgaaaagtatcagagcaatatgtgagttaagacaaatttattaaataactagagttgtttttatttctttaactgtgcatttatattgtgatatatatttcatattctaatatagaatacttttgccaaagctaagactttattttagtaacaaagcagtcagttaaaaatataatctataaactaatgtgaattaaattaaatttaatcctagtctgtgtctatatcagttttattcaaatgagttttcttcagctgaattctgtgataggaagacagtttagctcaaattgtcttttcattgtaatcactgctattcttatgaccatattctatagcttctttgctttcctggtactcacatttcaatgtgaaggacctattcaaatgaattaaccagaatgaatgagttgatatattagagcacagagtccaaagagaatctagctattattacttcttataataagtcttaaattcgggatacaggacattataatgagagattaaaattctatcaagtgtcttaaggatggacataactaagtagcataagaatgtaccatgttttgctaatgagaaactctgacttcattggtggatgtctttaaattttacagtcaaagtagaaataatagctctgaatatttttatagttctcaagcataagatcagaactagaaattaaaaaggagtaacacatacaattttcaacattcatcttttcccagcattttgaattattcttaaagttggcgacagttcaccattactactgtatatctggaataccctgtgtctaactgatttcatcttaattcacttcacattggaccccggaacctctctctctgctctcattgctagtataagtagactcttctccaccatgttcctagagaaatagccaagtcaccgaaacagaaaagatatgagttgaggaccttcaagggtgcatgatcactgttttcatcccaaccccaagttagatggaagttaaatatttctttgctttaaaagtaacaaactattattgtttgcatatggagtattactagtctaataatttttgacagaatgataactgggatgctaggatatagagagaaatggaaaaaaatagaacggacctgaagatgattcaagcattttgcttttatggaaattaaactgttttatgagaagatttctgacctattaccctctctttcctgaggagcctgttgcaggtaccttacatttatggccacgtctacgggagagaagtgatgacattcattcataaactgatcaaactgtcagtgttaactgtggaaaggatagagtttctaacctaatttgtaatgctgtaatcacatacttagaagagactggaaaaacataaattggtacaacctaagggaactaacttataatccatttcagcaaaaaattcaaaaggtaggtggttatatcatcaatattcaaaaatcaatagtgtagcagcaacaaaacagtattttaagatgttgtcatttataatgtatctctaaaaattagtgtaggaatatatctggtgaaagatagattacatctctacactgaacactacaaaatcttattgagagaaattaaacaatacctaaattaatgggatggcacaccatgttcatggattagaagattcaatattggtgaaatgtcagtgctcctacattaatgtgtagatttaaagcaatcaaaatcccaattttgttaaaaaaattaacaatctgattctaaagacaaaatggaaatgcaaaagaataagaatatgcaaggctactcttaaaatacagttcctggatgttatcaaggccaatataaagttagagtaattaagacagtgtggtaatagcacaagaataaaaattatgaccagtgaaagagaaactccagtaatagatgcacacacacgttcaccattttttatgacaaaggtaaaactgtagggaagaggggaaaaggtacccttttcaataaatgacagtttttccatatctatatggaagacattatatcttgacccctaactcacactatataaaaaaatacagctacatataagagttataacagtatagtttttagaagaatatagaacatattttatgatgttacaatagtcaaagattgactccaccatcctccaccagaaaaaaaaaatttaaacaattttttaaaaaaataataggcaaggattttttagacaggagatagaaatatgctaaacaaaaaggaataaatgataaattctacttaagacctctttcctgtcaaaagatgccattatgagagtaaaatagaatttacagaggagaaaagatacttgtaataaatatatctgaaataaggcatatcaaaaacatatttaaaaactattaaaactagtgaggagacaagagacaatccattagaaaatggagaaaacacttgagcacttaagagagaaggaaatacaaaatgatcaattaacctatgaaatggtgctcaacaggaaaatacaaattgaaaccacaatgtgattccactacacctataccaaaattagtaaaatgaaaaagtgtagaaaataccaagtcttaagaaggatgtaaaataactggaaatctcctaccatcctgctggtgggggtataaatttgcacaaccactttggaaaactgtctagcaacatggactgaaagtaaacccatgtcccaacaattccattcctgggatactcaccaaagaaatatgtatgttaatacacccaaaaacatgtagtacaaaatttatagcagcactgtttataaaagcaacaaactggaaataacccagcaacaaccagtagtagattggataagtaagttgggcatattcacataatgccatgctctaaagcaaagaatgcaaactatgactacacaaaataatatacataagtataaccaacattatttgagtaaaagccagacaacaaagaatatacactttattgtttaatttgtaaaaaagagataaaataactaataaaagttaaaaggtatgcagtacctatatagatgtattatgatttaaatattatattatctagatatgtatctgtctcaggggttcccgagactaccctcagattcggtgattcacaaggaggactcagtcatcctgtgagttgtcctgttctcatggctacgacttattacagtgaaaggatacaaagcagaataaggacagggagaagtcacatggacaaagttcagaggaagccaggtgcaagcttccaagagcctcttcctatggaatcacacaggacatgcttaatttctccaggatggaattgggacagcacatgtgaaatgctgtctatcaagaaagcttattagagactcagttcctaaggtttttagtgggaactggtcacatggaccccttcttgctatcatctgccaagattcccttctcccagaaggaaactagacttttagcataaagcacattatttgcacagtttaggcacaatgaaccactcttctcagggaatgatgggaaccctcccaaatccgagttcccggacatcagtccaaggtcaactttgcaagccgccctttccaagaatttcagtcttagtcctgctacgttaactcttttctgtacaatatctatatcaagtgtctcaagggctagttaaaagaatatttgaagaaattagagaaaattccaaaaattatacatacaattaaggaagtagaaaattggatgtagaaaaataattagaaaattaatcattattgacactaagagagaaatctgagggataatttaaggacttcctttagataatgagttatgacataagataaagtcacccatagcctgtatctcccccaaatccttccctaagtagagaatatgggcctactttatttgaaacacttctgaaaagtatttcttgaaaacactctttagaaccttctaagaaatgacagctcatttagtcatttgccattcagattgtataccagcttatataataccttgattcattaattatttgctgaacaatcctaaaaattatgtttatccattacccattcatacttttactatctttctacacccaatatgtatgcagttcaggttttcaaactcttacttgagtaaaaagggagaacaggtatttaaaagcatatttctagccaggcgccgtggctcacacctgtaatcccagcactttgggaggccgaggcaggtgtatcacaaggtcaggacttcgagaccagcctggccaacatagtgaaaccccatctctactaaaaatacaaaaaattagctgggtgtggtggcgggcacctgtaatcccagctacttgggaggctgagacaggagaagagcttgaacccgggaggcggaggttgcagtgggccaagatcacaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaagtttatgttggtattggacagcatcttgaattcaaactgcattgtaaaggcaacagcaaatcactgaaagtttttgaagtgaaagcaagttaatcccagctatatgtaacattttgggttaaaaaaaatctcaatagcatatatgttagattgatgcagttaaatagtagaggtgaagaaacaagctgaaagcctggtgtagctcttttttctcagccttttctcttttcttccctttttttccttaaaaattcatctcacaaccattggggtggggcagagcatggtaggacccacaccagtgagagatgaaagcagcagcagtggtcccacagaccttgtcagagcctgagtcggatggaggaggcagtctcacagagtatcagcctcgtgtggcatttcagaagtcagttagattcagaagcttgtcttcatggggacggtgggtggcacaaccccatgtgggaagtcagagcttgagcagggagtagagtgtccacatgtggaggtgaactgttggggttttggagcccaactagggtgagtagaacatcaacacagtaggcaatccaccttgggaaatcagagcccaagtgtggtgaaaaggggacttgtcagggacgcatagcatggtgtgaggtatcagaatccaaacaagatgaagagcttgggggtggggagtcagactctgagggaggttaagagggtgtccacgcaagagggtggcccatacagcatgtcagagccttatcagtctaggtgtgtgaacttccaggcagaggttgatcatgtgccggttgcctgagtctgcatggagtgaggagcacagccgcacagggaaggaggtgacagcagagatggcagagattacgtgtgtggcagggtgtgggggtgcagggagaaagttaaaaaacacaggtgaaactgtgtgtataggggtgtgtgtgtgtgtgtgtgtgtgtgtgtgtgttccatacacatagtccactgagacagcctgggagcaacaacatactgatggaaaatatgcctaatatccagatgttggtgtctaaataccattatccaataaaagtacctggggctctttggataaatggctcattccagggctggaacaaggaaagtacaacatgaaactagattattattattatttgccagaaagcgctaaaaaaataatgagggcatagcaagaggacacaattgccaacctcaagggggcccctcattggctgaactagaggcctattacttgagaatcaaaataaagatggtgattgattataacactgaataaaataggaaagcacaagtccttactgatataaatagagaaagatggatgagaaaccaggtatttacatagtttcaaagtagctcccaaaaacttaataattataaaagggtacagattaacctcacattggaagagcctagcagatgctttgaccaaatgatgaaggtgaacagtatccatgttgggaaagacattatggtttcccactaggatgcaagaaaagcacagcatcacttttgtgatattccaaccaaagatgtatatccttaatctaaacatttaaaatatcagacaaatccaaattgaggatattctacaacataactgagctataattttcaaaaacgtaaggccttgaaagtgaagggaaggctggactgcgcaggctgaaggggaccaaagagatatagcaactaaatataactaattagatcatttagatacaaagaacatcattaggacaattgggaattttgaatgggatctgaagtttagacagtagttaattttcttaagtttgaacgtcattttgtgatctataggaaaatgtccttgtttatgggaaatactaaagtattctggataatggaggcatcagggcagtcacttactcttcatgcttagtaaagtgaaaacaagggagtagtgtatttgcaaattttctgtaactttgtgtgtttttccaacatataagtgaattttaaagctgttatactaaaatatggggagcagatgagtgattacattaaagaataagaaataaggatatggaggatatgatggtggagtacaagttaacatgtcttggtgtgtatctgctgtgaacaaggaagctgaagacttaaatatgatgctgaacttctgtcctgagccaaccacactaggaagatgtgatgtcagtcacagagacagaaaacactagaaacaaaggctgagattaaaaaaaaaatgatttattccattttggaaaagccaagtgtagggtaccaaaaaatagctaacataaatgtaattggaaaaactagaaataaaagtgtggagaatgtctggaactagagaacttagaacttgggagtggtaaaaacatatgaacaagataatatagaaagatgaggagagctccttgcaggatacccatcttgagacagtaggaggaagaaagtgaggtaggagagaagctagaatagaagcaaccggatcgaaagatgcataaccagtggagtgccttgtcacaacactgacgaaaggaagatataccaagaaggggccttataaacgatagttaatattttaagcagcatggaaagctcaaataaaataggatgagaagaggcaactgggtttgcaaactgggatgtctatggttgagtttagaaaagggagcattcaattagagtgactgggcaaaaagatagcgaatagaagcaagactttagcatgaactggagctgagaaaataaagtggttggggagactttcttttccagaaatacattactgataaaaaggagattgctaggactttaatttaggaaagaattattaagcatggtagagactggagcatattttatttatcagaggaaacctaccaatggagcaaaaaatattgaatatatataagaaagaatacatttctagaggaagtaggcagtgatataattgaacaaatgcagaaacatatcttttaaaacaatagggaataattgaacctgtgagggcaaatggacaagtgacaccaacagaaaaaattgagaagtgtattagattatccatttaaacaaattaaatgaagtcctgtgcagagagtacaagtatcagatgtggaacaagagaccaggaaatttttaaaagtttgaaaattcttgaagaacaatgtgaaagaatttaaatctaagaacaattagcatacatactgaaataacatcattttgaaaatttttcagcgtgtaaaaatcattctaaaaaattcctagtatcggctgtatgccatgactcgtgcctgtaatcccaacactttgggaggcagaggaaggaggattgcttgagcccaggagttcaagatcagcctgggcaatataacaagacctatttctataaaaacttaaactaaaaattaaaaatgcttagtgtaatagtttgtttcctgccttgtatctctggtggcagccagcacataaagagaataaagaccttggcttgactattaaacatatgaattaaataatcagcatcataatgtttaaaataaatagtcatgtggttacatattatgatgcaagagaagagatatcctgggagttatgttcattgcagttgagacaaataaagtcactgagaagatatgcttcaagaatggagtggaagagtttatctcaattgtactagaaatcaagaaaggctttccatttataaaatagcctattnnnnnnnnnnnnnnnnnnnnttataaaatagcctattcaaaaccagaattgttctaaaatatgaaacggaatttggttagctgtatatttgaaagcaaaaaggagaatacgtctcaaggaaggtgtctgtgatacattaagaacatggagcaacactagagagtcacttgtacaatgagacaggatcattgtgcaacttgcatgctcactgtctttaggttcagttctctctactgaaaaaatactgtttgagattgtttgatattgatttgctctatctatttttttttttcttgaggcggaatttcactgttgttgcccaggctggagttcaatggcgtgatctccgctcaccacaacctccacctcctgggttcaagcaattctcctgcctcggcctctgaagtagctgggattacaggcatgcgccaccatgccctgctaattttgtatttttagtagagatggcgtttctccaggttggtcaggctggtcttgaactcccgacctcaggtgctccacccgctttggcctcccaaagtgctgggattacaggcgtgagccaccgcacctggcctatctttgtatatgtaatttataaagtgccctaattcattataccctcatgcacgcacacaagtatttgtaaattagcagctaagaattttgtgccatgatgccatcaagaatttatactgcgattatttgtttcttaaggaaactatcgtaacaagtaacatttttatggttagatttaaatgtgctgaatcatgcaaatatataaattatattaaaatttacttaaagaatctttaaaagtatttcactagaaatatgctttatccatattaaactaacaaaagaggcatttcaattgaatttttattttatattatttaataatatttagcatattatgtcatttaaaattttctcaatatgtaaatagttatttgtggaaccatgtacttgtttacataaaattattcttaaagtaaagcaagcgggcattgataagaaatcaagatgctgaataatccttagactaaaactaagaaacaaaaccaatggtatgggaaattgcaagtattgtaatctgtttatgtaagtagtttatattttgaaactactttggttgtatctaattttcccatcctgtgaacttctggattttttagaacaaaccttgttacttagcatttagttttggcagaagtttgtatgttagtcaaatctatttcttaaaaaacctgacatttccatagataaaagctatgaaatctgatagaatggaaaaatttctaatataggtaaatttatttgaacatagtatttatggtgaaagaggttttttttaatttaataatgtttcttgtctattcatgagccattttttgatttctgatttcatttggatatcaatatttctatagcaaatatttattttatgtccatagtataccagacagtgttgtaggccctggggatagaaaagtgaatagagtaaagcctttgcttttatggaacttaaattctagttgaaggaaatagaccaaacacaaacaaataagtacagtcattccttagtatccaaggaggactggtcccgggaccccgaggataccaaaatcagttatgctcaagtccctgatatgaaaaggcatagtgtttgcctgtaacctatgtacatccttctgtatacttaatctctagattacttataataccaaatacagtgtaagtctgtggttgtttgactcttcggatgcagaacccatgaatgcagagggctgactgtatgtggcatggcaaatggtgataaatcctttgaagaaaaataaagggtctggggataggaaatactggaagaatgtgtctagggcattactactttatatacagttatcagagaaagtctcgctggtgaggtaatgtttcagcagaaacctgaagggaatgagggcatcacccatgtagggcaggagcattagaggcaaagggaacatatgcggaaccttgaggagaatttttccttatctgctcagagaaggtgggtcaaatccaggggatgagctagaatgttctaaatcagctcttctcaaagttaagcttaagtcagaatcacttgggggcttgttaagcagattgctgggcctcaactccacagtttctaaatcactgggcctggaaagaggcccaagaatttgcatttctaatgagtttacccctgacactgctggtcaggtcaacaactggtctaagcaagtcccattcaccctctgccagtgattggtttagcgtcgtagatgtaatcctatcttggcatgagagatctaaggctacatcttcttagaacgtaggacttcaaagaaatgttttccttcctgatttataaacagagaggtgggaaggacaacccccaactcatcccttttacctaggggcattgttttatcaggatatggtgttcagaaagttgagccatattgtctaaacaaattagccaactcagagccctaacaaccatgaggttctcagatatccattgctggacttccttaattttagatatctgtatttgaaaaaaaaaaagtcattatggaaatcactactagtaggtaatctgttatttgcagcatatagtgtttgaactgatattaagtttttattttcccttaggaattttagtaaaaatagtggctagtttccaatatgtagtgtaaaggttcaggtatttcacaaatgattgcaagaaagcacttaaagttcatgtaacctaatcattaccatgatatttttaaaatagtgaatctctttcttggtgtcagtctaaaataccagaaaacactttgactgccttgccataggtactttggtggaacttatcttcactggcaccagatatagctggaaatcagtaacagacagtatccctagaagccatggaaagaaaaaaattccaaaagctaaggtatacatgtgggcattcatttttcatttgtttgataaacctaaagttgatgtataattactaaagattcatatagtctggagtttacctcttcattttgtatgtttatatcctgggaatgtctaagtcagattattatttactcagaatattacttatggtaagcaatgatgatataagtccttcctcactccctctaaaaatctttgacttcagtgctagcttgcactttaaacatgtattccaatattaagaaacaatcacttgttacaaaagagtagaagtacatgcaagattttatccaaaatccaaatacataagacataccagcactgatcatgttttgtctaatttctccattcttctttcttttgtggtctattcactaattacttgatgaagaatttgtttttttaaaagcattttcttcataatcttaattttgtctgatgctgcctttgtcaaatctttcattggtgcccttttctctgtgcagatggatgaaatgcttttgtaagtgacagacattcaaaaataacaaacatgagaagaaaaagaacagtttatctgtcaagaagttacagtaaaactgtggaagctccatttggttgtactccatgcgtttagaaactttttgactgaattcatttccattagagtcaccactggtgaacttgaacaactccacaatctccactcttaaattgcactcttgtgtttcatccctcacagaatttacaaaagtggagggtggtttaaaagcaagggtttaaaaaaatctatatttaaatgggcttcagggcctgaaatcctagtcttaatttcttaaattgtactaagatgttttatttttagtctgctgcacgttgaaggaaataggaaaacattagcaataaattttcagatacttttttaccacttttttttaaagggatggaagttaggatcaactgtggtagattcgcctagccattcagaaactttgggcagggatgtggcttttcttggtccctagggtggaattagcctggggaaagctgctagcccttctgaaaacttgtaatcagtgagcagaattttgtagtttttcctctgagtgcctgagcactcttgctgataatcacactcttttctcctgcaagggagcaagtgtgtatcattcttcctgcctgttggatctatgcacaagttgtcaaaaattaatctgatttaaggtttttcttttcctgaactcagaagggaggaaattacagaaaagtatattagtaatagagtaatagactatagcctgagggaaatgaaagcatatctaagcgaagccaagccaggaacaagtacaattttaatgaaaaatcaatgtttcatgacttagaactgacttttgttaggcactaatatttcctgcttttctgtcaacatccttatcattataaattcttttttgtttcaatataaaggtactaaaaaattaacagctaatagattattttcaacctgtttgcaaggctaaagtctctctttgcctttgaaaaactggagtagaataaaaatgttatattaccacaatggatttaaaggctaacgagtggtcaaattgttaattattcagaaatttcttattgaaatgaagaactgtctggatggactggactgtaaagttcatgagggtatgggtatcaacctccttataattgtgtgtgcctgatatttaaaagatatgtattaatctctttggaatggctgaattaattaatattgttattcagaatattatttagtacaataattcataattattcttttcaatgccctgaagatgtatcagtgttttttcctgctatattttaattttattgacataatttagaaacaatgtggagtggtcatttttcttttaatctaatacagaaaaagataaaatgtttatgaatagaagttctgcctttgcttttgctcctgtccccacataccctcttagaatggacaaaatacaggaagaaaacttttacctgagttcttaattttatttacatcttacattaattttcacctttttgtgagaaaaataggtttaaaaagtagttgattttttaaccttgcctccacctactagatggagagtattgtcattactgtaaatagaggaaagaaatgatatagaagcccatgacttcaagaagtttatggtccaactcatgacacataaacagatctgaaaaaagtaaagtctaggtaaaatacctcaaaaatgtgtgtgtgtaatataagtatgtatactatacgtaagtattctactaaagagataggaagttttcaagaacagcgatgatgacttgtggaaaatttctgagaagtcattaattctcatctacatcttaagaagtcagctgaactttcaactgggactgggtgtaagcagaggcagaaaagttgtaacagacaggctatatgaggattttccccaacaaatttattcatttattcaacaaaaaattttaaacactccctgtgtaccaggcatgattctagatgacagcattaaaatgnnnnnnnnnnnnnnnnnnnnnnnnctatatgtatactatatatatatacacacacacatatatacaaattaagtaatcaagatagttttgaagttttgatacataattcagtgaagaaaaaaagagcagtataatgtgattttgagtgagtttcctgagtaaaactaattttgaaaggatttcggataaatcctcactgagttgatgtttcagctgagacttaaatggaaaaaaaaaattagcctgtcttataagttgccagaagagcttaccaaggagaaggaacagcagatgcaaaggccttgatgttggaacaaactttagatattcaaggaatagaaaggatcatgaaggcctggtaaaccatggtagagaatttgtgttttaagtgtgaaggagagccactggagcatataaacagggaatcatgatttgatctgtgcttttaaggatcactctggatactccatggagaagagattgtaagctcctcagagtgtgtttagagcacatactgctgcaatggtggctaagactaagggagtggaagtggcatgagagagaaatgggtgtatttaatacttttagatacagatacatagtacttgttgatagattaaatgtaatgtaggaaggaaaataaaatgaagaatgataggtttttggcatgtgcgactaagtggatgagtttgctatttcatttggttttgtgacattgtgcaaaaaataagctctttgaaatctaagtaagttgaaatctatgacttctttcccagataggatgaggattgaaaatgttggatttgatatagtagaaaaatctattgttattagaaaatagaattatcaaattttccagtttgagttacttagcattatatattccaaatattttcctagtttcttttgtaggcattttagggatttcaaaagcatttgccctacttttgtaataaactatttttaaaattaaaaaacagtgcttaaatacacaaatctgtcatatacagaatactaaaaaatatggtcccttaaattttgccataaagtttctttattcctgaacagatgtaaaaaaaaaagttttcttctaattcttttatatgtataacttgaaattgcaatgttagttactgagatgatagtgtgtaataacattcagattctatatattgataacatgcaaacaaatagtacattaaatagtttctataatatcacatctatctttctcttttttttttgccccttcaagcaacaaaatgcattatttttaaccctatgcaaccatctttcttaacctttggtttcaaatttagaacacttcttttcactgattggctttatagtatgatattggtcataagtgaatttaaacttataaagttattaataaaatagttatactccatttcatatttctttttcaaaatgatttcatactaaaaagtttggaatccttgacctaagtcaatgccctcttcctatggatgagaagactgatgtttattgatgatttgattttctgaggcagtacagacagttgaaagtgtgggaacagaaatcaattccctctacttttttcaatgcaccacatttatttcacactgtccatgtagaatcatcagttaaaatgataatatatgttcaatccctattttcatatcaacaagaataatatgagtatataattaccagaggtctatcgtaataatttctctaatgtgtttaaagaacaagccagagatttttatttgatagagtatactgatagcatcaaactgaggatgccatttgtttattagggagaattttataatttagagtttttttcaaataatatcaacagtaaagtctaaattacttattgcctttaattctaggaatgtcgcattaagtgactaatgaaacggaaataactactgcccatgtaacttcataaatgcccttcatagacatttatgtcagagcaaagatggcaaaatacttgataatgacattatctccccctcacaacctttattttaatgctgtcaatcaaaactgagccagttaacatttctagagaataatattttatcaaatagataagttatttgtaatcatgataattcttggttggggcctctgtgataggctgaataatgtccccccacaaagatgtctacatctaatccccagatgctgtaaagatgttaatttccttggaaaaagagaatttgcagttgtgattaagttaaggatcttgagatggaaaagttattctgcattttccaggtagatcgagtgtaatcacaagagtgctgatacatgtgaggtagcagaatcaaaggcagagaagggatgtgatgacagaagcaaaagtgggaatggcctgctttgaagaagactggggccatgagccaaggaattcaggcagcctctagaaactggaaaaatcaagaaaacagattctctcccttgagtctgtagaaaaagaaagccctgccaacaccttgattttagtcccataagactcatttatgacttctgatctctcaaatatataaaatataaatttgtgttgttttaacccacaaatttgctataacttgttatagcacttatacctaatgaatacaaattctggcacctgcaagtgtggtcttactgtaattgatatctaaaaacatgaaaatgactttggaatcggacagtgggcagaagcttggaagaattttgaggcatatgatacacggcctaggttgccttcaacagactattagaaatacgaatgttaaagtgtgtgtggcaaaggtgcagaagaaaataaaggacatattggaaactggaggagaggggtttcttcttaggtggcagaaatttagctgaattgtgcagttctggggaaagccaaatttataagttatgaatttggatatgaggtaaggtgatttccaagcaatgttgaaggtgtagcctttccagacacacacacaaatgtatattatatatacacacttttataaaactatatatatagctatatatacacagacattaacacacaaatgtgtattacatatgtatacacttttataaaactatagatatataaaactgtatatctacacatacacagtcacacatatacacacatatatatacatatataatatataatttgttggtattatcatctatatgtagtggcagttcaaccttcactttgattatgaagtagcaaatgctacagaaaagtcttaagtatttttatacttagcaattaaaaacagacctttatattgaaactctacatgaaaaggattacattagttttattgcagtattatggtaatatgatttctgcctcttttttctatatttatccaattgcagggaaaaagtattaaaatccagtttggcctcattgaagcacatttgcagagtgttatagagcattggtttatgactattgccctattatagacaaacaaagtattctttatcctttatcagtgtagtgactgaaattatgaattccattcagtttttaatgaaatgtggattacttcaaagattatctatctgatttaataaatgcattagagtagaaagttaattggatctttcttgaatgaatggtgaccactatgtgtgattcataggagggaaagatagaatatgatattctttgagtttgttttatgtgtttaaaacttttaggttagaaaatcaatttttgtgtgatcggttttctcaaataaattatgtaacccctattgatcttacaaaaatcatggagaaattttaattcattttaaaataaaaatatcttaaattttgtaaaaatgggttattaaaaaatgccatatactgaaacacatgtgtagtttattgtgtttttagtttacaggcagagaaaatgaattttaccccaaacatctgcatagttctagatttgccacctcctgtttttgacacagatctcaactgagcttctaattttggaatcttgttccagttcttatatttcctattctgtattcaagagctcattctgtattaactggtaaagaggttatcatttctgcttggtttatgtagacactctatattcttcattgtttaacaaaatatagaaattcaggtgcttgcaaatatgatggtagaggtgacaaagtgatactcatcacattttgtatatcgttagtagtggcaggaagagccttacagtatgagtattactaacccttacgtacaaatacagattatcttttcgttaacaatgttactctttctgagagatgttcatgtgagagatgttccatattttcaattcaaacaatcttgtaattgctggctgctgctgttgttcacagcacttggctttgcatctgtgcctcttacaattccagtcttgccctttgtttgaggaaacttcctggttcttgtatacctcctgctttcttgatctatttgctgctgtttcccaggtgaaaacccaactgggctatgcatctgaggtagggatggtttcactgtcctagcacatctttcctctattcaccctgatcaccatcatcttggttttgactcttatttaaaaaaaataaaataaataaaactgctttgtattatgcagctattatttttctgacaagttcagccactgtggagacagtttgaagtaaatgtggctcattgttggtggtctaagaatgtctaaagactagagcaaataagaaaatgttaatagagagaaggaaaacagaggataaaaattgaagttcctaagaagtatgtagctaaaatttcgccttatctaattcaggcattttctcttggctttcccagcacagtacttcttagcgatgataacaacagcaaccactttattaatttgctttttttaaatttagaattcacatcatcatggtaacaacaaccatcccttgaatatgtctttgttagttgcttaatttgctacacctaactcttccaccaggcgctaaatattgggactattggccatccattcagaaagtattatgtgcttcctgtctgtaatgcactaaatcagacattgtgctccaaagaagagggttgtaggagggaaggcatcacacctgtatgcagttactatgcagagcaggcttgggataaaaatagacattggccacatctgtgttaaatcatgagctgtgacccttctcatgacagttccccagctctgctaagacacgttctttggaagaagttgcttcacttttcatttgggtagaatatttacagtccaagtaatagatttcctataatttagaatttactaatacttcctttaaacaagtatatgattatccaaaatgtatataggcttttttgattccagttttataaaacaaatcactaatccaatgttgtgttttaaatagaaactttgctgtatgtaatttcagttggcattcgttatatatttacttaatgtgggcatttcttttcagacttatttatgaacatagaccctatctgtatttctacgtctacctgagtatagaaaaatacactgttttttaaattgttatcctaaaatagtggtctgaagcttgcatttttgaacttaaaatagtgtcttggacttattttcaagtaagaaaatataagtattccatagcatgagtatatgtttaatccttcctatactgatgaccatttagtttattcagatttcttgggattacatgcaatgatgcaattaacatccttggttaagatctttacattctctgttataggataaattcctagaagcaatattgtcaggtcatataatatgtatacattttaaataattacagccaaatcaccctcagaataattatacaaatttacattccaaacaatatgttagaatacctatttctccatatccttatcactactaattagtgccagtctttaaaagtttcgcttatgtgatgggcagatatggttaacattttgtgatgtttcatcataacatgattcagttaatgataacactgcttgttgtaaaattgttgcatgaagaatgaagagacagttgtaaaattgttgcatgaagaatgaagagacaaacgcagttaactgttcaacttgtgtggtgcattttgttgcactttgaaaaatgaaaaaaatcaaacatttaaagtttttttattgatggctgctccttaagaaaagcctggaaatactttagtttgctttggaatgtctttaagtgcatagtggtcctgtcgcatttcctgagctgcagtagattctaaatcatcttgatttaagataggcttttttgtaatcactgacagtctctgatttcagaattctgcagacattgtcattgagtggagcagtatctctagaagttataagaactgtactttttgctcttaataaaaagtaaagtgtgtcaaaataatcaaagtggaagaaagcatatgtaacagccatacaaataaattgagattcattagataagctagttggtagaggcaaatgtgaagaatatttttaaattcactactaagataatttttttaaaaaatgttaacttaaagttgctatttttaaaatttgcataatgctttgaagaatgacagtaagacaaatgtcatcacaatcataaaaaatgtgtataaagtacattagtattttaaatttctcctagaaaaaaaaattgctgcatctcttccaagatatataaccaagttagaaaaaaaagttagataaatatgcgtattaccagttaagttcagtttgacttctgcttaccagatgttttgatagaagtctttttcagtgttcactatgatgcctgtttctcacattgctgtgaaacatctaagctatatatactgttttttgataaataacatatggttttgaaaatcagtgttaaaaccacatgaaaatttttaaagtgaaaaattcagttttactctcaatataataattgttttaaaaatctttaaaaaataatgttaaatttcaccatgatatgtacagctgtctaaggagtctattacagggacaaatagaagaatgttatacattgctcaactcaggattacttccttttttttagttttagaagaattcagttttagatttaaccaaataaccagtaatgtatacatctccctgatctgttgtcatgagcacaaaatttatttactgacatgatgctaagaggttttctgcagatactccaaatctgactgggttttgctccatttttctttcactaatcaagacttcagtgaaataaatacatagtaaaattctaataatgctagacttatttcccaaatgtcttgatgttaagtgaataataaactccagatctgattttgtaaatattattttaagatatgcattcttaaatcttgataggcagatgttctaggaggctccaagagagctcaattgggtaactctctcagaggactgacttgctccatatttgcatcatacttttgtgtggtttcattcacaggcacagttgcccatcgtgcaggatatcattaaatgacctaaattaacttttctgcaggaagtggaggaatctcaggataggagaatccagttttaaatacccctgagacttaaattgattcagtcttaatctgggatgactcaaatgacttagtatataatgtctcttgtttctctaaaagagagtctctcaatgacagaggcctaagtctggagatcaagtatgtagtcctgttgactgagaacaggcagaaaaatctgattaatccaaaggaaaaaggcgagggaggtggcagcacagtgaacagatttgcacccaagcacaactaaaagaatgagttagggagggcggggagcggcggcttgtggctgtaatcccagtactttgggaggccaaggcaggcaaatcacctgaggtcaggagttcaagagcattctggccaacgtggtgaaaccctatctgtactaaagatacaaaaattagctgggcatggtggtgcatgccagtaatcccagctactccagagactgaggcaggaaaatcaattcaacccgggaggcagaggttgcagccgagatcgcaccattgcactccagcctgggtgacaagagcgaagctccatcttaaaaaaaaaaaaaggagggaggagacggaaagaaatcagttcgtttattttcaaaatgatcaaggatgaatggtaggttcctttacaatttttgatgtatctatttttttaccaactctttattttctttatttatttcagtattttagtttattaagtacttgcagtgttattaaacatagactgaagaatggaaatatgagtaagatatgtgtattaattttaggacactcacatcgtagtacttgtccatgttcctttttttgcctttttccattgatgaaggttatcttctctcttgctcatggctaataattatcactttttctcttaacaaattattttattgttgttatcatttcttacctacaaagttactattctctgtacaactctgttgctagcaaccatcttacaatttggttatccataagaccaaattttgtctctaaaacatctcctgggtgtagctgctcccatgaagacaatatagctacaatggagtatgaatccatataaaactcagtagtcttattgggctcattctctcacagccctgggagaagccttggttgcctgtgtctctttctcatattttgaggcatgcttatggaacagaggtttcccaaccctattcagaccccaaatataacaactgtttgtaagaccctctgtactatgaaaaagaaaaatccattccattccatttaccaacatacgtaatttcaaaagataaccaaagttacctaactttaatattaaaaagagctaaaggaactaaaacatatgcttattgcctaaactgttgaacacaaccacattagaagacagaaagaatactctgatgtttgccactattctgagaatcaccaaatgcaactactaattatgcagactgtcctgtagatctcaggatgtctatcagccctgccctttcccactaaatattatagagtcttaatctaactgggagacccaagtgtccctacacatttcctagatgcctccagaaggcactatctgctatactgagaaccattgctatagaactttaccttcaatatcacttcttatttgtaatgtctgtccctggtggctctgtagaagattttgctctcaatcttccatgagcaaatagaaacttggaatttttttttctgtttcctaaaatagaatacagatatgtccacacttggaaatatgatatatttttatgagtatatcttcaagtggcagatcataaggtgaaatcccaacttgccttatattgtatcattaccatgttgtcgttttgtgtccagatgacattggcagtaagcagcgaaggattcagtaatgttttgataaaaagagcattaatgtaattatttatttatttatttattttgagacagagtttcactcttgtcacccaggctggagtgcagtggcacaatctcagctcactgcaacctctgcctcccagtttcaagcgattctcccacctcagcctcccaagtagctgagattacaggcacttgctacaacgcctggataattttgtattttttgtagagccgggatttcaacatgttggccaggctggtcttgaactcctgacctcaagtgatctgcctgcctcggcctctcaaagggctgccaggcttgagccaccgtgcccagccaatgtaattgtttttaatctgcatcatcttttgaataaaaagacattttaaatatcagaaaatgaccactgtctaaattttctttaaccagcataaatggatgtaaactaagtagtttgcaaattttcatgtctgtttcacttttatctttctccttggtaatatgttttctgacattgctgtgaaacatttcatattacttaaaatgtgtatctttaacagatttttcacttttcagtttaaacatttcacacaatccacacgtatttattaaggacttatatacttgacataacaccaattgatgtttcagtcatcaaatcttgaacacctacttctgattgtctaacccttctttttcaaattaacaacaaaacaaaccaaaacaactgtctcatacaactactccattctccaaagagaagttgtaaattataaaactttaacagtcttattttttctttgatggcctacttaataaatctaaagggactataggtttacaaccttggagtgttgcttttgatttttttccccctgtatcagtccctaaaccaaaacatttacagtactgtgtatatttaataattttgtactgactgcatgaagatataaatgtgtgaatgaatacagcttgttaaacatgcaagtatatttcttcaaagaagagtttacggattctttttccttagcaaagggaagttgtattaaacattgtggtggttgaaatgctgctaatcaaaaattggtcatcgatttgaatacatcttatagcttttctatcatgttgttggtttatttctgaaaacacaagggagaagttgattgggctgccttagctgcctttttctatggtgacaggtgtttagactttaatccctctaactgtgcacatagatgtttctggtgaaaagaatgtactgccctttgtataaaaaacataataatgataataatgtaagtttgagaacggtttagtctacacagttattgacaagaggtacagcttgtactggaggaccagtctggattcaagaagatggtcctaagtgtaccgaagtatatcttttcgtatgaagatataaagaatagaaatatgagtggtatttgaggtgtccgcatcctctttggcactcagaggactctaatcaaacccaatgttgtgtactgaactattcctgacttgtgaaattcatcttttatcccctactttaactttttttttttgagacaaggtctcattctgttacccaggctagagtgttatagctaactacagcttccacctgggcccaagaaatactcccccctcagtctctcaggtagctggaaccacagacacaagccatcacactcagctaattaaacaattttattttttgtagaaactagatctctctacgtagcccaggctgatctcaaactcctgggctcaagcaatcctctcaccctggcctctcaaagtgctgggatcacaggcatgcaccactgtgctcagctaccccaattttaccttttaaacacaaaagctttcattaaatgtaaagccaccatttcctttgactttcaaatccatgtatcagtaaaataaaacaaaaatttatttgaatgcaataatagcagacatatgctgttctaaaatcctcagaaatctggcagtggaaactgtgaagatagttatgatctcatgaagtttgaatatagtcctaaactctttggaatgagagatttgtcagctggattttcatgctctaaatctgacttcaataactttcactttctgccaagatgtatccattatacctcagtatctcctgatattctccaataaaatccactgtcaaattaaaagcttagttctgtcgtttgtgccaggccccaagtgctacccttatattccaaaatcagtagcgctttttccaagttattactcagggagtataaccaactagaaaaaaatttagaaatactagaagcatgttctcctagatttcctacatctatccctaccaacttcccaaagagccctgtagtatcttcacctaccttcctatcagctattcagacataaaaacagctgctttcttcctgggaagatcacgtaatttagaactggcttggggtgtacctctgggttaccaaaaatgattttttaaaaatatctgtcattcaagaaaataagatctggggtcaggtccaggcaatattgtcctgagggtgcttttcttcttctcgtggctgatattcccgcagtgacatatgatataatatgcactaagctgatactgcttcagtaaccatgtctgtgtctgtgacaggtgctactgactcctttcttcatgttattgatctaaaatattttttaaaatgtagaatctacaaaaccctggaggcctttcatccttggaagctggaattattgcatcttttcatccttcttaaagaggggaatgttttcacccttacagttaagttgacagttcatatgcgatgtttacttgactttttatatctggttacaataaatgtataggctgttaacacataataaataatgactcatatatttgatttaaaatttcctggattatctataatcagaatttagaatttctctcctagaagtgtggcgagctgaagctattagagctgtggcctttacaatcctttaacggaataacccatctcctgttgctgatctgaaccgcataactggctaaactagtgcaggcagcatgattcttcacacacaaccagatgccagaaagaagaaaaccacaaaggggctgaaaaacacagcatagagcccagaagcaagagggtaaggtggggcagaaaccaaccagcagtgattggaagggaagattaagtcaggaggcagggctcaaagggcatctgaaggtgagaggcagcagcccgaggatgcctcaggagtctgcgttgtacaagaagctggacattagagataggtcgcaggtcaaaatcagatagaattttgcgatcagagcagacacagcaaaccagaagcacttgaactgttcaaatagcaccttctttccacagcaagtccttgctgttgtgactgcgaatacactggtccactgaagcctgtgacacttgcaatttgggagcttatcacagccggaggaccctgacacagggtgagggtgcaggaaagacaggacatgagattgaggatgctgactcagacaggtcactggaccgttccagtgtttttcttacagggaaagagtgtaggaggcagtgcatctctttgtctttgtcacttaacttttggtgttctttaaactgttctaaattagttcaagatctacaaattgaaggctaaagaagggaggataaataaagcccagcccaagcagttttgattgtagaaacatttggaagtatttgggttgttaggggaaaggagcatagctgattttttttaaattgatttggagtttggttatttgtcatttactcattagttactttcctccccaacaataacaacaaaagataattaccatagtctgttcttacatgaaacactgagaaattttatgtagacattgaaattacttcatcagtttcttctgtgaatgattcatttcacatttcccagtcttatgtaaattactctgcagcatttatatagcattagtgtcatgcaatttgtatcattattgaacatttattttcttttcaaacaaagtgcaaagtgccagaggatgggaagtatatctttagctgcagtttgaaagaaaatgtaccaagcttggtgtcggatgacctgggttctacaaagcagtcgtgtacgtttagccaaatcacctgttcaaatctaggttgcccaaactataaatgcacttgaatgagtgatttttcaagaatgtggggcaaaatgaagtcagagcattcaaggctgtggtatcttatttctgtttcagctactgtgtctgtgctctcagtgtttcatatattgggtccctacgtatgattttattttttaaatttctactgctaataaaagtttcacagatgtgatagtgtccagtatttctttcaaatttgaagtttcatttgatttaatcattttatctatcatgtcatttagtgtaatttttgaacctagtaagtgtctaataaatatttgctggggaaaaaaatgaatgctatggttcaatcatgcaatactcagatgttcgtaaccatttccatgtgaaaagtttagtataggctgtagagaatgacattttagacttttgaggggaattatttttatgtcagcttgaaattcttcttgaacttgatttctgacttgggggaaaaaaagcaagcctgatgtgcacaagctttatacagagaatcaactgtttttaaaagaataatccagctgctatctgatcagccaggtaggagttgttctgtggaaatgaagaagccctccattttcagtcagagtcacgcatataaaggctttgataagattaaaataatccaagaatgcaatttcaagatgcacagctagaaacagcaactaagaaatatccatatcttacaggacacagctaagggaagagtcaggttttaaggaccgtctacagataatgtcaggatgtacagataaatatgagcaactgctgattgagctagaaacactgctggttaagttataaatcttatgatttttacccttcaaaatgcctctttccttgctgctttatatttttttaaagagcggagtatgttgtcacttggaggttgtgctgctttcctgtgactttagtcacctttggtgccctggccagatcccttttaccaagcctgtaaaatgcccagtttccgtcagtgttagctgctattggctcacagcccccacttctcttcagaatcacttgtagctgaaaaacatttactttgccaaaccttatgtgcccatctcccagcactatcagctcatatctgatgactaactgacatggggaatacaaaaagccagtgccctcacttcattaggtcaactctggggcaattcatgctctagtgctccccgtgacatcaggctgaagttagacttatgctaatgccacattctcacttagctgctttccctttcctaccctactttcctctctccttttcatctgacaacactcccttaataaatcatgtgcatccaaatccttgtcttaggctctgcttctagggaacctaagcagtgatatttttgagagtatagattctttcttcttttatctttcatcctcaatctccagcacatctggatcatgatgctttacaagtattttgaagagtaagcaaagtaagaaatttggccttcatttggtgtgttagttagtccttgcattgctataaagtaatatgtgaggctggattattattattattattattattattattattattattattattattattttgagatggaatctcactctgtcacccaggctggagtgcattggcactacaacctctgcttcttaggttcaagtgatttttctgcctcgcctccccagtagctcggattacaggtgcccgccaccctgtccagctaatttttgtatttttagtagtgatcgggtttcaccatgttagccaagctggtcttgaactcaaatgatccacctgcctcagcctcccagagtgctgggattacaggtgtgagccactgcatgcagtcagagactgggtagtttataaagagaagaggtttaaatggttcatggttctgcaggctgtagaggaagcgtagtgctggcatctgcttctggtgagggcctcagggagcttacaatcatggcagaaggtgaaggggaaccatgtatcacttggcaagagagggagacaggagagggaaggtccacactctttaaacaaccagatctcacaagaacactcattactgtgaggatggcaccaaggcattcgtgagagagccaacccccaaaaccaaaaacctcccaccaagtcccatctccagcattggggaatacatctcagcatgagatttggagggcacaaacacccaaactgtatcagttgatcaagaactgaccatggaagatggatagttgaagtcacaagcagtccagcacaattctaaccttaccatgaatctgaattcttagctcactaaagatttaggaacagaattggggagtagaattatggtcatgtaaaaatagagtccgtttaacatcctaaccttaaatcagaaaccatcaaagcatcatatcaacaaaaaaattgttttcacttatgaaaaatatgaatattaacacaattttgttgcacacttactctctgccatatgtcttacactaggcattgagaaaatactaaaaatacataggatatgttccatgctctcaagaagttgtgaattgtgaaagaacctgatagttgaagtaataatttcatgcagtgtgcctaaacatgaaatagaattccatacaaagtgacatttaaataggtagaaaaaccagagaccatatccacactggtaacagcatgggcagaggtttgcagttagacatgaaagttaatgcagtgttcaagaatatactgaggagttagtaagaaattaggctaaaatgtatgttgatacagatatgagaaagggctgtaagactcaagattcactttatcttgagggcagggtggcagctatcaacagtgctaaagcactttctcttccactttaaaaattaaaacagtgtggtaaccttaaaaggtgttctgaaacaatattctaagcaactgttatcacttttgctttttccttttttttatcaggtgcttacttaaacatttctcataattgcaaagattgtgacttgtaattatttgtagttactattttaccatgagctttacccacatttttatgtgttttaattttaagtggctaaatattattataaatagtgtgtgcagtataatttatattcgtcattttcattttccctgaaatctttgtaggctattaagaagaacaatgataggatcatatttaagttttagaaaaatgacaccttaaaagctgcaggtagattaggatgagtaggacttggagtcagaaacttcaataagggagtggctgcaatatagactaggaaagaggtgataccaacctgtcagtgtcctcatcggtaaaagaagatacagctgggcacagtggcttatgcctgtaatcccagcactctgggaggccaaggtgggcggatcacttgaggccaggagtacgcaccaacttggccaacagagtgaaaccccgtctctactaaaaacaaaaattagtcaggcacagtggcacacgcctgtagtcccagctactcgggtggctgaggtaggagaattgcttgaacccaggagaaggttgcagtaacctgagatggctccactgcactccagactcggtgacagagcaagactctgtctcaaaggaaaaaaaaaacatacaacaagcctcataagtgcttgtgaaagctaattgaaataatatattaaaagagtttggcatttagaaagctctgaaacgatcattcatttaacagaggaagctatgaacattttttttttaaaggtcagtttgacttttaggcacctgatttcctgaaggactctttgaactctttgaatgtgggtactgttttatgcattttcatgtgataactaaacagcctgatttacattcttgcccaatatacgtatttcttcaaataatgaactaatgaattcccgggcaataaataccttttggttaaatggacaaacagttctgttcagtgggaaacatgctagtagagtctgcttttaaaggaattgctgtatgcagtattctaagaaataatgaggaagtatttttacttcaaaatactttgatcataatatgatgataggtattttcttctcttgcctgtgaaagtgtgtgttaggtatgtacattatggggccaaactagtgattgttgctaattaggatatatgtggcgcattctatcaagaatcccagttttctgggcactgtgagctgtaagtcaagtcataaaaaggagtgaattgtctttttcatatatagcactgaaattgactggagttaattatttaatgcctacctcccctactagactacaggctgtgtcacacacctccctcagcatctagcacagcaaatggatttagtaatatttattgaatagattaagaaatacagagtgaataaaataggacactggttggagtgttgggtcaaccacaattttggtgtgatatattctacatatcacagtgagaaggaaaatgatataaaatgaataatatcctccttaaagtactatacaaaaagaatacttcttatattttttcaagatgatgtaatcttgtcaaatatataatatgttgcatgccagtgctttcttaatccttaatagtaataccagtaattgtatattaagttcctgctatgtgtcaaatacttctaggtactttaaatgtatattcagtaatcttcagaacaagcctagagagcagaatttagttatttcattgtaaagatgagaaaagtgggtctcaaaaaaagcagataacttgtcccagatcacacagtagtttttcttggtacctggagtgattttcatccctctttcaaatacaaccctttggctattgggaagtagctattacaactgtattttttctttaacttgatgtaagggaaagaccactttacacatatacaaataggagaaagttttgccagaccttctgcagctagtatttacatgagtgagtagagaattgtaagaggttctggtagcagtaaaaacaaattacaaacaacggaacatgaagagaagatgttgtctaccaacatctgtcaaatatggcagatgatcttctttgtcttattttgttcaataccactcaatatcatcacttaggcctctctctcttactgtttagatctcttgggattctcttaattttttaaagcctataccttgaaaaattctgtttaaaaatacattggaaagcatatagattttagtaggctgaataatggctactggaagataccaggtcctaatcccaataagctgtaaatgttatcttttagggaaaagcggtctttgcaaatgtgattaagtaaaggatcttgacaaggtagattatactggattaacagtgtgggccctaaatccagttacatgtattcttataagagcaaagcagaggaagatttgacagaggagaagtcaatgtgaccacagaggtagagactggagtcatgtaaccccaagtcaaggaatgccagcagcactggtagctggaaaaggcaaggaatgagttctcttctagagcctcagcagcgagggtaaccctactgacaccttgattttggcccagtgatactgctttggggccctctagttcccagaactgtaagagaataaatatgtgtggtttttagccatcaagtgtgtggcagttttctgcagtggccttgagaaactaatacagacatagaaaattattttatgactttttcttttagatgcagttgttaagtcagcatttgatcttatttgagctagatagaaccagggttttctaatctacaaactattgattttcatcttgatttaaatgtgtttacttattcttcctctataaggtaggacaattttgcaaaagatgtataagaatgtgtgtctcctttcaggttcagctgaaataatcttcatataacaaaagttagagaaaacaatctgtctgagccagagacttcgttatatgaattcatacaaactaatgaaggaatacaaaacttggcctcacagggagagagtggagtgtcttatgcaaatctttgttgtcagccacattcctacatgcagaatgcaaaaaccatgtttcagtttgttgaggatttggaaatagcttgagataatcttaatttaaaaggactggcaaattctttcagctttgtagaatttattccacatatgtcaaagacaaacttgttgtactgcaaaataaactagtactgtgtgatcttagttgaaaaggtaaatattacaatttacattctattctctcatattcattcttttggtacatgttaataaattgcaaaactatattgctgaaaaatctaatgatcctgaaaaatctaatgataaattctagcaattatcagtgattacaatataggcctggtttgttgttgttgttgtttttgtttttgaaaaggaatcttgctctgttactcaggctggagtgcagtgccacgatctcggctcactgcaacctctgcctcccaggaggttgcaattctcctgtctcagcctcccaggtagctgggattataggtgcctgccaccatgcccagctaattttttgtatttttagtagagatggggtttcaccatgttggccaggctggtcttgaactcctgacctcaagtgatctgcctgcctcagcctctcaaagtgctgggattacaggcgtgagccaccatgcctggccataggtctcattttgtacactaagaaaatgtcaaattactaattttcatacttagtgctaaatttacatttatcataaatgtaaacatgtaatagagaaccagtaattttttattttccttaaaaatgatcctggtaaataagagaattgattcataagatcatggtttgttgatgccatagcaacataatcttatattgagaacatcatctgttacaatgcaagtagttgtggccatgtgcctagaatagacttagttattaaagtacattgtgatatgatagaataagatttgtccagatgtttacagagctcttacaaggaattattttagtctgtttctaaattattttagtgtgttcatctgggttgaaatgttatgtgcttaaaggattgagttactgtgatgacttggaatatttaagtagctttgaattgtgcgggtatgttaaatgcctgtttgggaaagaaaaataatatgagtgaacagagattaaaatttgtgaattatctgattgccctagagatgtctctatttgagtttaaaataagagattggcctggtgtggtggctcatgcctgtaatcccagcactttgggaggccaaggcaggcagattgcttgaacccaggagttcaagacaaacctggacaacatggaggcacctcacctctaccaaaaaaaaaaaaaagaaagaaagaaaacattagccaggcatagtggcatgtccctatagtcccagctactccagaggctaagctgggaggatcgcttgagcccaggtgggtgaggctgcactgagccaagatagctccattgcactctagccctggagacagagtgagaccctgtctcaaaaaaataaaataaaataagagatcgaatagttctgttttaaaatagtctaggtgagaaatgatagtttggttttttttgttttaatcatattgtttaaaagaatacttcccagcagagttttattgggaaaccacaccaaaataaggaacatgctgggggcaaattcagtggtgaacataaatctgaatgttaagaagacaaaggaggcaacaccagctccagggcagaaggagagttgagaaagttaggaggggctgacactaccaatctagcatccagagaggtttgatgaagaaaatttgactttagggagttgtgaatttaagatcagaagtgatttatgcgtagaaaatgatttctgtcatttcacctgattcttgtaacttcagcttgaagtttctaatttcaagaaaattagaaatcactcgtcagctaagatttggggaaaactgttaatagtcacatgtgatgttattaacaatttattggatagctttatcgatcctgtttctcaaattatacttggttttacagattttagcctttggtttgactcttcttttgccccatttttcttggctgctccagctccactgctgagttcactacaggtcagagaactgttcagtatttttaaagcagaaaatgcggtgaggatgggattttgtaatgtaagtttttaatctccgtatctgagcattttggttcgtgcagtgatcccaagtagctgagatgaggcaggctccagtatcttaacctactaagtatgtgtaaacttgatagagaacacaattttcctttaaatatcttagctctctagtctctcaaattgtgaaaacatattgggggcagattgtgaaagaaatatgttcataaaatataaattcagtgatatccatggaaagagcaaactcagagtgaggcagatggaagaggaataacttggatcatccaggtgggttaggtgttccaggaaatactgaggacccccagccagctgtttgatctggcaatactggaggacggtgcctcagcgatcccttcaaaatcaatgaagatttttcctttactccgtaagctgggggtcattgacagtagttggactcatttggagtgaggtgcatagaaactggcttttaggaattcaaaactctcatggaatatgtgaaccacttggattcagtggatttgaaaataatcgaaaaagtaaatatactaaaggtcaaggaaaaatgaagtcacttgcttaaaggctgctgagtattagattttaagagaagaaacgtaagggaccaaaagttttcatggcaaaaagacaaaacaagcacccctctgtcccccgaccttccagccccgctaccaacacacgcagtgttttatgaagtggtcgcaggagaatctgaagcagccataaagaagaaaggagtatgagagatccaactgtgccactaacaggcacttaatttcttctgagaactaatttataccaactactctagcttttcaaatagcaagcaaaagccaatttgcatttacattgtaaaactctgttttccaaacagtggcgtacagagtgttggtggtcaaatctctaatgtaagcgagggatttggggatcaaatatttcctgaattgttactctttgctagagagtcaagataggcgctggtatgtaccctccaagaagaaataaatggaaaacacacacaggaaacaaacctttataagctttcttcaacattatctcatataattcttagaatatatataaaagaatattactactacattttatagacaaagaaactgagattcaagttatgtaacttccccaactctatacattggtgaatggtcacttcagaaagccttgctccttctaaaactccagcctacctctattaggctgtgatttaaagttcaaatgagaaacacagccaacaagtgcagagaaattccgaagtcccttgggggattgagggctggaaaaggctttgtggaagagatgaaactttctttctttttttttgagacggagtctcgctctgatacccaggctggagtgcagtggcacaatctccgctcactgcaagctccgcctcccgggttcacaccattctcctgcctcagcctccctcccgagtagctgggactacaggcgcccaccaccacgcccggctaattttttgtatttttagtagagacagggtttcaccgtgttagccaggatggtctccatctcctgacctcgtgatccaccagcctcggcctcccagagtgctgggattacaggcgtgagccactgcgcccggctgaagagatgaaactttcttatcaaaagggtccaatttagacaagggaagatgttgagtataaaaaggttgattatctagaattggacaatctatagcccactgaagtattttgggtgtgtttgttagatactttgagaattagaaattgtgaaatgtagttattagaaaattttagacagccaagaaccatttaaaaataaggctcccatcttttcattcattcactcaaggccaaaaaatattttaggattaaaaaccaatctcaaactctaaaatatttattaataatttagactttatactaaattatcttggaaaagctagagctcaactaaaatcattttttaaatctggttcatctgtttaatattaaggcagtctctaatttagtaaataaacacctctaaaaattgtagtgcaacctctattaacgtgatttaaaccatgttgtgtattctcctgagatatgccagattaaggaattatcgaagccttggtggaaaatgacctactcaaaatgaaaatggaattcataactaaaagcatcccaaaaaacagctagtcttaacccttcatttcgtaaataagcagagtgggaataggtttaaaatgtcgaccatctttactattttagatcacatcacgttcttataatttgagcactagtaaaggttttatttgttttctatttctttctctaatattcaaatgtgattttgttcctgtttgtgctttgaatggcatgtttggatgactgtcccagatctggcattctgagattgtaccactaaaaatgtcaagtgcatttgccttttaattacatacagtacctggattttaatattttagatttttccctgaagaagagacttttctggtcctgtagtttgtgggagggaaaaaaatatcactgacattatcatgaagctttttcccccaacgtctccatatatccacatttatcatttcagaacaatttcattttgggtcaggtttagttgttctgtagcttactttgctataaacactatgtttaaatatataattccgcactgtttgtttgtacttctttctcttatttcccattaatgttcagctcagcttgttttactcttaataggccattactacttggatgtcacatatgtaataatcagtatgtggaaggtatagtttcttgtgatttacactcctttccttcctttacctttggcataaatgtgaaccagctcattactttccagggtatttctttttttacttccccaaattaaattttaatttcatcctattgttattctctgatttttattatttcaggtgggcaaaaaagtcttatttgtcaatgaaacaactccataaccactgaactcccttttgcacctactacatagacaaggtacttaaagcatttttgcttttgagatgatacagttcctcaacttaaaaaaacccacaccatctacctccgtgtcttcttcagaaaggtcttctctcagctccaaatctaacacagtcaccaaggcactccaccttgtccttctattttaattctcagtatggaagtcctcactatcaggtgatccttgtttacttgtctattgtttactagacaacacagggatgtaaactgcacgagagtggagatattctctgttttgttcagtgatgattcttcaaaccctagaagtgtgccaggtacatgccagggacaacaaataattcatttaattaatgaaaggaaggaaacaaaaaagtaaatgttttctttgtgtgtttaagatggggcatggaacatgtatttttttttttctttttgcttctaaggcttcctctcagaaccctcccagattccattcatttgtctatccatttaagtctgcttttatttgtccccaaaagaatgtgactgactgccaatttatgtgtatttatatctccccagcttttcctttctttttgttaggtagtagttgaggttgacacctctattgtatcccccacctcacccccatgttttgaaaaggcagtgttaaacattactcctaatataggcagcttaatcacatttctcccaagtgaaagtgccagatgggagtcagaaagcataggctatatttttaattatgtcagaagttaatactagaactattaaaaagccactttcctctcctgagattgtctttctttatttgaaaactggagttggactttttttgttgaatgattctaagaaatgttttagattgtcaagaaatcagatacaaattcatccccctgtggaggagccctatctgtgcctcttctgtaataccagtagccatggtatgtattgcagtatgatgctaataagtacagtcatttgagtacttaccatattcttcttctagtttatacgctctctaaaggaagaacacttgttcatctttctggttttttagcctagtacaatgttttgtacccatcagataattcaacaaatacgtactaaatgataaacaataacagattcttatctctgttttttttagaaagtagacttccctccatctaatgctgcttctgtgatgctataatatttatggtgcagaaatctagatttagaaagagaactttattcgaatctgtttatacattccctaatacttactgaggctctatgaagtaccagatattgtccttagcactttacatgtttcaatacatttaatctttgagtcaatctagaaggtagactcaatctccattttaccaataagaagtgaggagcagtggttaacttacctaaggtcaacttgtggcaaagctggaattcaaactctgattaatggttttgttttatcaaaaaaaaaaaaaattaaggccacctgacaagaatgttcactattagtgtttttccagagatgttgaagctctttaccaactgatgctatgaaaagcagaatttttctcttaaagaatgttttagattttataaattagttcagttaaccctagcattaatgtatttgtttcaaaaaaagtttaaaactttaagcagtatattatagttgataaatgctcttatataagtagcataccttgacaaattatgagcatttttaatatgttacctattcattgggcaaatatatattaaaagtttataatgtattggtaactatgtaaaaatcattagccataaagacatgaatgagattatatctttgcccttgattcgctccagacctagtgtgagttgtagacttgctgagaaatatttgcaatacaatttttatttgggttatgggaaaatgattaactggtatttagaggtgagagggtagttaagggaaaggtgttaggaacactaaagaacataaaagcccatgatcccacttcccattttggaagcctggcaaattaggttctcagaggacctctgcagaacagtcctaccctggataggacacatctgtggatacattgctggacttacagtggctggtggagatatctcaggactcactattctgccaaatatatatatatatatatatatatatatatacacatatatatttatttatatatgtataaatatttatatatgtatatatatttatttatatattatatatatagagagagagagagagaaggagagagagagagagtgagagcgagctgaaaacagtgagcaacaggcagaaagagaggttggtaatacctgaagggggatgctaaaactatattgcccttgagacttttatcttcagactggtaataagagtgttgcctagcctgggactcccatatggagctggcagaggtggtctgaggtctgagacacctcatagctactggtaggagatgtaaattatctttgagatgaaagcatgatcaatttaggcctgcagggttcccacaggctaacataaagcaattaactcacaatcaaaggtcaccaagcattcttgaaagtaactcactttcaagagtgagagttagcagaaacaacagatgtaaatcctcaaaaaaactgcaggtattgggattgtcaaatacaaatagccttgtacaaaatctctaaagaaataaagtgcaaatcataaagattaacaagatgctatcaggaataactaaacaaagatccgtttacgaagaaccaaatggaacttgtaggaagggaaagcataattgttcaaatttaaaaataactctttggatggacttagtagcagatttggcaaaatgaagagataatttattagctagaatttaaatctgaagaagttacccagaacaaaacataaaaaagagctaagatgctcaagaagaaaagaactaggcctgggaatatctccataatatatacaatatgttacagaactatagtagttgaaatcatttactgtcagcacagaataatatgtttcctctaagaataaaatggaaaatccagaaagtgactcatgtacttaacgtaattttgatataggacagaagtggctgtgtagatcattggatcaattcaaaagttatgcacaggtaactggatatgtatgtggggacggaggaggacctgaaacaactttctactatacatcttggactcttttaaaactttcaaataaaaaagaggatttttgaaaaactcagctttgaaggagcttcttaaacaataggccctaaccataaaaaaaaagattgatatatttgacttcattaaaattaataactgttattcataccataagtaaagtaagaagaaaagcaactgatggctttcagggcacattaccccaaaatatggcaccttggcatactgaatattttaacctgaaaaaagttggagaaagtgacaaaaacaggaagatctctctgaccttcccttgaagcagatcataagaccctcatatgagaagtgtcctccttatagctaggggggaaaataaaaagcacctttctttccgaagataagggacacatagaagaatctgaacaaacaggccttgctaagttttctgcagtttactatacttagctcatactcttcgccctatcatagtcctttataacgtcacccttcatcaaacctgctataaaaacactcgggtttaactgttgcattagttcttcatttccttatgaagtctaccatgacttgtaaaacttatattaataaatttgtatttttctcttcttaatctgtcttttgtaataggggtcctagccatgaacttttaacatcttgaaaggatggttttcatcccttatacagtctgataggagaagatatttgtaatacaaatttcagtcaaagctatatactgagcatttcagagaaaaaaacaggtagagatatttcaggtatctcaaaaggtcattttagtagtaatcaaatatgtattacatttcattttctactactgaagtgacaaaaatcaagaaggctgataatacaaagtggtaagatataatttaaatggggttggcatacgctgctggtgggtatgtaaattggtaatagtttggtattatcttgtaaagctgaatatttacaatctttgttttatcaaaatgggatggataaaactcagggaccacagtttgccaactcctaaaataaagagtatttgagaaatggtgaaaggattttaatgataagagtatatgaatgaaagtgtctcagaagatgaggttgaaaatgttgattggcacctgcttgtgaaaggccgtatgtgtcataacttttgccttttcctcttgaatgtaaagcagtgaagtcatttcttcgcatttaccttttagaaaactcatccaactagcaatatgtaggataaatctgaggtagccaacatgggaagcaggaggactagtgaaaaaacaagattgggtcttgaaggcagtcgaaggtggggtggagaattcagaaccaatttcagagagaactaagcagatagaatcaactgtgtttaagaagtaagacagtgcactaacgctctattttacctaattgaatgaatttagtgggaagcttgatgaaaaattaatatgcacattaaaacatttcttcttcattactatgaaacaaaataatattttactttttttaccattatatacattcctaaaatatacttattttattgctttcttaaaaagtatttctgtcacttcagaattttgtacagcattttgaactgtgtttttaaaaccaaaacaaatttagagactctaagactagaaggagatgccttaagcagtgtaaaattaattttcaatatctgcagtattaatctgtaattttatttcttagttgtttaaagtcttcatagacttttgcactattttccacatcagaaatctttggatcacgtccatatcattattaaaggagaataaattattttccaactactgttaaagcacgtggcatttagctgctctcttttctcaccagtaaaatctctggtagaccctgttttagtcagtgatctaatactgggcaagtttcataagatcacatgcaatgaggaagccaaattacttcaaaagatcattgagttaaataatacatacttcaagacacccataaggtttaggtgtccagtgtggcagcctgtgtaataaataacatgtgctttacaaaacctgtcattgtatatttatataataggcagctaagattttttaaaagctgtttttcagtaatttcatttttcctattcatagtttttcatttctatgtaatggacccaaagaactgacatctagattatctctacctagagcagcagcgtctactactatttctactatcccatgtgttttagtttacaaaaacctttcacaccattatgttacttggtattcctaaaagctacacaagatgggtaatgttattaatttttttttatagatgaaggcattcactctaaaagattctcacttgctcattgtcacacaacagataagagaacaaactaagaatcaaaacagggtcttgctgatccaatcccttgtgctttcagtgacactggacttttcttgcacattggtttggtgataggtggtgacagatggtggaaatggttagctctataaaggaatgtaacaaaggggcttgaaatttccagagacaactcagaaatgtttgttatcaagttcatcttatgttaatgtccacaacagtaagagatatgtctgatcagagacatccttgtgttttttaaggagataactgattttctatatgccagtgcaacctagcttaggcaggcttagtggtggtctttcatttattcaactaatattttctgttctgttgctcctttttaggtcctactagaaattcaatggtgagcaaaataaatatggtttttgctttcatgggctttaccttaacagcaatgggaagctattggagggctctaatcagtgaagtgatatgatacagttgaaatcctagaaaataccgtgtgctacaatgtgggttttgaggtggaacaggcagacagtatattcagagatttaacataggtggctgctgtgtgatctgcctgagaggatactgatctgaatgaaggtagtagcagtggggatgggaaaagtgatgacaaagaatatttaggaagtagtaattttgtaactaattgtgtgagaaagtgactgtgcattccagtttgcccaagataattccagtttttgttttccttcaaaagcatcccaatttggatgataaatgttaatcctagagataaggaaagtggaggattcaagaatgatgcataggtttctggcttgaagaactgtatggatagttttgccatttactgaaaggggatacactagaaaaagaactggcatgagataagattatgagttcgggttggacatggtgtgcttaaggtgactgtcatacattgacgtgaagacatattaatcacatgactccatgggtcaggaattcgggttgcaacttttggtcagagatatatcgattagagagtgatcagttatcaggatggtaactaaagagatgaaaatggataagatcaccaagccagaaagtatggaacacagtgtcaagaggcataggtccctgaggaactcaaaggggcacctatttttaagggatgagcaaacaaaaatctggaaaggagagaccagagtcctcagaaaactaggaggtacccaagttcatggaagtcccaggaaaagggtgttccaagaaagagggagtagacaggaatgtcacatgctattaagaggtcacataaaataagactagaaaagtacacattgaattcagaaacttgcaagtcattagaaacattggttatggtggtttggtgtggatgggggacataagcctgccggtaggattttaaagaatgattgggaagtgagtgggaacagtttctcagatctataactgaaaaagaaagaaagcactaatgaaatgccgggaggatttgcagaatttgagtgacaataatgtctctgaagacaccataagattacttaatacattgtacttacaggcttctatctctaatgtccattatgaaagtagaagaattagtttgcctaatcacagctattaagatagttttaattttttaggtaaatttgtgtgactttaaagctatttcatttttaagtagtgggagcaaggacacaattgatcaagtcactttagctatttttaccccccaaaatgcatcctagaaatttgctcaataaaaataaaattgtgccttagttttttttctcgttgtacaaagaattatgcttctcttggcttctgaacactggggattccttatatgctctttggcagataaaaaaaatggtaaagatttatggccaaggaaagcatttctgaaaaaggtgctccacattgtctttgtgtatgtgcagaaattataaacagaactcaggggcaccaccactataatagctttttgctctctttgaagaaaatggaaaatgctgacttaggggctactgcttgtatttcctttaatgaatcttctaagcttgaatgattttaaataggatatttatgttcctcggttatagcaagccaagtacttaaaaaaatacatgtgattaaaatatccaaactaataaatatatacagacatatttagtaaaaactactgttcatagtagtaatagtaatgatagtaataaatgccacagctaaagactttgaggagaattcacagtcaaggaaaacaaccaccaaatcacatgtatttggagaatttgattagacttctatacttaagtttaataattatgttgaagattagtgaacaactcttggcacaagaattgtcttgacagacaggcagccttacccaactcaaataaataacttaatgggcttttttttctttattaaccacttggtaaatgtgaattgaagtctagtttttaacaaagacatatagattatgactttattatctctgatttgcataatagattatgaaagtctcaatgctttgtactcttggtatacctgcaagcgttttagtttctatctatgttaaaaaaattactttcagatttggctttttatttctggaaatatgtttacatgaattcattaacctatctatattacttgtaagatcttaaaaatgtcttcatcccctgagtttgaaattgttttacccatcaccctcatgtcagttctgttattttattactaaacctaggtaatagtattaaagctgctgttcttacttcatgatgatagtttatatttgcacctacatacattatatatattatatttgtacccatatacattatctgcttctggtagggattagcagctctgaagatttttgtaaaatgtagcatatgcgactcataataaaatatatttagaaaattataccataatagcatgtattttatttaattaaactgttatgaaaaatactgacctcattaagcaagaactgctcttccagagaattttcagaaacatttaattctataactcagatatgtcagaaaatcactaagggatcattatcattagcccctgaaagccaagtgtctcatagaacctgaagaaagtagtctttgattagtgaataatgatgatttgttgcatggactaaagctttttttctagagatttctacatcaaacttctgtttctcttcctatttgaagtagtatctgtggcaaaccaatgtaatttgagttacaagcaatgactatgttccttttaggttttttcattcaactttgtaatatattccacctgttttcaatatctacatatatagagatatagatatatgtatatatttctaacgtcgccctggaaaggaaaagatctctaacatatttactacatgttttggtaaattcaaccataaaataatttgaaagccttaaggtatctctgttcataattatgaggttagaaattccctacagccggaatatatggaaagtgtcaagtcagaaagggaatctcccttagtttcccaaaatacaccagccaaagccttgctttttctgcttgagaataatagttagtgaatctagtctatggagaagtttttatgcaattgaaataagataaattaagacagttatagtgaattgttttacaaagttaactgttctgacgcttttatttgagctatgtctttctcaccagtttagctttaaattaccattttatataatgatatttacattagatatatttattctttcagatttcttactttgagaaattaatagttaacctcaacagtctccttttggcagaatctgtggctgttgggaaaagtggagcagatacttggatgtatagaactatgggttgcggggagggggatagagaagccaagaggagaaggtaaagaagaaaggatcagaatgtagacaaatggttgatttttaagagctgattaacagattgtccactggaaaggcatgaggttaggtttagagatttctttgcgtatctgttcatgtggacaccatctcttgactccaagtgcaaggtgctgtgttgggtgcttcaaggcaatttcccaaatgtgtctaatcctgagaatcacctggactcttgttacaccaatttttagcagtaggagccatggatctggagacattgagaaattttgtgttaaaagacagaagatatagtagattttttctttgctcttgagcaatttataaactatccttatctttgtaagcctcagttcctttatcgataaagtgtagataataatactttccttgtcaattttcaaggtaaatgaggtaaaaggaaaatgtcctcagagagttactggggcttgtaaaagggttaaagttggtaattttaattgattgtgtgtatgatgagtagtcagatggttttgagaaagaaaggaagttagggcatacaaagaagtttttaaaaataatcatcttctcaaagttgtttcccaactttattatctgggttttatttaataaaagaatttgaaatattccttggtgtgtctgtttttctttgcctattcttctcttgtgccaactcaactattcatctcaaattatatatattaaatcataaacacatgcttctaacagttatattaggcatttatttaacctaaccccttctgtcccagacaagtaccattaatactgccttaaagcaccaagcataccacctggcatttgagtcaagaagcatttgctgaattgactgataaacctctaaatctgaccccatctctttccaatgtactagttgctagacaaccttatgttcggactttcaaggacacttggggaaaactagttcatcattctctttgatatttattgtggaggtttgttttattttttgtgttaacaaaacctcttgtcagaaagatttccttacctcaaccctaaatctcgtattgtattttagcatgcttctgtatttacattgtgggattatttttattaatatacaataaacaagttgtgtttcttggaggtaattactgggaataatttttttctgtgattattagcttctttcagtaactgatttttttttttatccatttagcagcagcaacagaagaaccagaagtgatcccagatcccgccaagcagacagacagagtggtgaaaatagcaggaattagtgctggaattttggtgttcatcctccttctcctagttgtcatattaattgtaaaaaagaggtaaggcctaatattgtcctgtcccgctcacttaccatttatgtcactggttttaaaaacctgtttttctcaagatcctttaaattagaacaaacaacaggaagaaaattttaattttaacaatgttgtcagcacctgagtctattggacatgctttctaataaattcttatttggttatttgcagtttaattttggatataaacatatgctttttgttaagttgacctagaaattaatatccgaatttaaatgtctcaaatgcaaaggtacttgagatcatttatcttatatttgaagtgttattattaacaatggcaaaatatggatttattgtgatacttgggctgtggtctaggaattattttgtgctctttttctgtatttttctacttcttggctacaaataagatatgagaagaatataaacattatttagtaaaattgtacattaaatattcattgactaaaaattttagccttttaaaatagagagtaaattgttttaattgaacattaactttttatactatatcaactaatatcaccatcttctgacgttacttgaagatactgagacctactggaatttaaactgagctttgctctggagaccaaagtatattcctgatgaaaagcatttcaaagtacacagtttttataatatgagctattgtacattatataaaatgccataaatctgtaaggcattgtcttggaaactaatatagcactctaatccttcccatcatgtatttgggttaatgctacaatttggaaggacttttaaaaaaaatatttataagcaaaagtacagtcctaaaatagtttggtgtatagaagtggttgtgatcagtgaattctattgaaaaatataataagtgatgttgcttatattacattaaattatctagtttactattatagttattttatacttgaaataaagcattaacattatagataagactcatactacatgttttaatgattccatcagagtttattttaatatattgcctctttacgattatcccctggagatatatatgttggagaagacacatctgcattagaaacattaggtatgcattatagtgttttgtgttaaattagctacatacgtgctttccccaaatagtgctttctcttgctgttgtctccctctgtggttggaaaatacatcatatgtgaggcaaaagttttaagtattttagcaataaaaatttgccagtaaagatcaataaaaatcaccaaatgtaaccttcagaccttatgtctctgtttagtttaaatttgtatttggagacttaagtaaacaatttagagagtaaagttaactaaacattgcttcacaatgttctggtcacttcagattggatgtaaacatgaaagtggcttctgattatatcctcattcagctagaattgggctaaactattcagttttatttgttatttatttgaaaacattcatttgtcttgataactctccctatccaggcctctgatttagcaataatgaaaaaattgaaaaattaacctcctaaagtatgctaaaaccatcactaagcaagattttgggggaaggtaaaatgctctgacagctctctaaaattgtgtaatatgacaacttgattttctggttcatatattaaatggttaagttaatgagcctctctattaaaatatttaacatttgagctttcataattatgctttgattgtcttttgatagaaagtatgctagggcttttgcttctgttcctcaccatcacctttatacccaggaaaagctgcacttttaaagatagaccaggtttcattatttagatatgttaccttctaatatatagtatttatatctacattacttgaatttcttacttaccaaagcaattttgtaatgacttttactcatatgtagcgtgtcacacatgtaccatgtatgctttaatcacaagtatgtttatcatacatataaaaaagtatagatatagcagcattgcattggatattatcatcaagtatagcttaaaactattaatataaaatgtttcccttttaatatataaatttataataaaaataatggaaaaggaaattactttagcctcttatctacattttagtgggaaattgttaagtttgattttatccctcactgggatgaatacatgtagatatatttcttatgcggaaaacagttccatgtctttttggttgttttgcaaaagaatggtgtataattcaattgagtaaagttttacagctaaggatatgtataaagtaagtttttaggctaagaaaagggatattgcatctttcaaaacgcaatgtcattttttaatttaatcgctattcaattatttccaaatgtatgccattttttcattggttgtgtattatattttacatgcacagcatgaacacattaataactcaaacataaatttgaaattatgtttcaatacagtaaatgtttgtgtatgatatcatgttcacatgcatctactgtagaagtatctgtgtatatatagtatatggtatatatgtatattcacataacatatgtatatacctatgtaccattaagatataataacttgtttgtagaaatttaggtgttattctgtatatatgatatattaacataatagatctttatgttttgtatctaaagaaaaataatctatatagtacacaagttctatgcacagctgttccatctgtcatatttagataatggatgatattatgcttaactgcatgttgaaaatacacaatccatttaatttttcaatattttggcaataagaaataccagcatgttattttttccaaattatgtattttaaattttatttttatattgcatatctgtctgtttaattgcatggcaaaaaaaactaacaatgcatgagcaaattgaaatgcaaagcaaaaaaaacatgaattttattttattttattttattttttaacgcacatttttctgctttattgaatgtgacagagtcacgcttttcattcaccattgcttctctttttccactgtctgtgatttgcttgccaggaggagctactattcttactcctactacctgtaagtagaaaatgggtgatgtacaactttacgtgtgttaaggatgcagtatcccttttcaaaaacaaaacagaatgcttgcaattttggtgacatttcaaaaaaaaagttttttcagactctaaaactataaactttatctatcacctattttgccaatctttttaaaaagggatattgtatttctgtatgtccagctacttttaatttagttataatttccataagtagctttagtctagagccaaaaacataatttatttactaaagttaaacctgtaccttatcttagcaatatggcacttcactcatctggtaaagaagagatagtggttgtaactcacaaatcactatctttatgtagcattgtcatgtctgacaaaatgagccaagtggtgtatttatggaacactcaaaatgcctttacaggatgcaaattagttcaggtctgcatgtgataacatctttctccgtatttctaggaatccaagatgggttatagcttcagaacatctttggtccggccattaaggcaatcattgtgcttttgttaaagaaaaaaaagtagaaaaaccatggtgttgcagcaacaaagaaataaaaattctttttagaggaaaaaaatgagtttattgtaacttaagtaggacaaatgttttctaaaactacagccaaaaaaacctttgtcaactaggaacagatataggcatcacattgctccttttctcttccagagtctgtaactcttccgaaactcaagcatgatatgttcatttggataaggatggagaagatggtccattctatttcctgagtcatttttcagcttatcaccttatatgccagagtagtttttcatccaaatcaaaggaacattacagcaaagcattcttggactttgcttgaccagtatttgatccgccagctttcaaggtttaaagattgaaattaagaatgtttggggcacatatcccacagcatttaaatcactagataaattcaagctagctttacagcaaaacctttataagagtctccattctccatgactataacacaattctgccaacattttaaatattataaacattttgcttcctaaaatctgctaaaccaagtagctgtacactaacagtgctcctaacttattgtgatgaatcataatatccttgttaaattatgtttgatgaagccagagataatcaactgtgccatttcatacaatgatggagcactttccccctttatggcccacccatacatccacctgcagaagtttgtgctgttggctgctttgataatgaaagtcatttgcacatctgtcaaactcaaagtagttgcaaaacgaatttcttaactgttctgaagtgcacattatgtatgctagttactcaggaggagacaaagcatcaaacatactggaatcactaagtatttaattatgagactgtcaataagcttaacattaaccattgatgtagctctgatgttaaaatgagattcccttttttggtggatagacaacatttctgtgttccagacaacgtaacaggttatactaatattattatagtacatggggctactggtaattttaatcataactacagatattatcacagagatatgcttttaaaggctgcttaaccatacctagtgatgcttatctggattagaggggtttttaaagataaaaatagatataaattagagaagagcttaaaagaaaaccagatgtgatctttgagctaatattcattgacattgtcatagttactatctgtttttgatcaaaacacttaacactgatgtcaatttttctttgttttagaagaacttgaatgaaagcctacctcacagggttgttgtgaggattgaggtataaaaaccaaggtgataattcatggctggcagatatttacaaaggtcatatttccccataatttgtcaactaatctaggtttgtgaatctgaaaagttaaagtccttcattgcatgaaaattttaacctgtcatgcatttgacaaattcattacttattgtttttctccaatcatgaactacatataaattatacatattttaaagtaaagcctcagggtttaaatttttcttttctattggctttgaactgctcatcttcaaaattttaacattgttctgaatccaaatttcagtttgtgctatttttattcaattcagtctctcatattttttgagaaatgaatttattcttcttatcccagaaacaaagattgaaagttatttcctaaagcaatttttgctgttttaaaatttacaaatggcaaaatatttattctatatattttgctgaaatttgtaacgactagtgttcaactgctagagtaaatactggtgtatattaactagtgttcaactgctagagtaagtagtgccactttgaaatgtgtcaatttaaaaagtgtaagcaaccagatacagcgtaagagcttagcctttagnnnnnnnnnnnnnnnnnnnnnnnnnnnnnnnnnnnnnnnnnnnnnnnnnnnnnnnnnnnnnnnnnnnnnattgagttaacaaatgaaaagtgccaagtatataacaggcctaattcatctattcaacaagtatttattgaagcctgctatgtgccagacactgcgtcaagtgccaaggctatgcagatcatccttctctttgtggagcacatagtggggaaaacaattgaaagatatttgcacctatcaatcaataacactcattacaggggaagaatgtggtagtatagaaaatacctagcctaatttgagaaaggttgctttggagtcaggcatataaaccctccctgacgaagtatctattacactgagacagaacagacagattttagccagatattacaggcaaaaaaatgttgcaggttgaagaacaaacatcttgtatgatggcctagtgggaagtttggaaagtgaaagtccataggctaaatgtgaccttatgatgtttcatgtggcccatacactgtttcaaaaaataaaatcacttgaagaaaatcaagaaaattaacatcaatcagattcatggcttgtctttaaaaaaaaaaaattaagccagagagaagttcaacagtgggatcaaatgcccctaggcaagttgcccctaaactgctttccagttcttcacagccattacccttccttatggtatcttgccactgacagcagcactcatttatattacctgtctgaacctacatattcataaaggattttgaccctcaagtctagaaaaagattaatagctctttgaatgtatagcacaaatgttgctaataaatgatggtggtgatggtgtagtggtagttatgttggtggtggtaatagttcttgttacactttgtcattgttttcttattactaatactgtgattctgtgattatcattatttattatttctaaaatagccatctgcatcctcgaatcttagcttatgactatcttaaacaacatagtgtcagatctgctgtgtacatgtgtcgtgtgtgttgtgtatgtaccgccctgaggccaagtactgtaattctcagagaaaatatatcctacactggagcagtcctccaattgctagattaaggttgtaaaggaaaagcctttatacataaactcaatcttttaaatgagcctttgtagtatttgtagtacatttactctggtttggatattaatgaggatcagaaaagaatggcttagcttataatctagtgaaggtaatggtgttcttaaaacaactaaagatttccaaggcaatatgaattgcagccataaacttagtaacataatttgcctattacaagcttttagagtgcctttatttatacataaattttcttgttagtgtgatttaaatattttatgtgcctttaatagccctttttcttggatgttacatgtgtaacattcacaagaactaaaatatattttacatccatgatatgtaagataaacatgccaatatttgagtagttcataattctaatgctgttaatagccaatcccttaaatcatatgcctttctgcatttataaagcattgctgtagttagttgatagtatgccatgtggttctaattagaaaacacatttttaatatttgaccatgtgaatattccaagatgataattttcatgtctttccataccatattttaaaactttcctcactacttttcttacacagtatatgatttaatcccatatattcatgtgtacttgaaattttctagcagtggcttattctaaaagtcttcagattagcttctgattaatgttataaatatattgctaaatatgttaatgctacacattgcatttttacttaataatagcacagagaatgaagaatgggacatgtctttgtctgttttaatttggtggctacagtaaaacagacttgaaaagttagtcatgttatttctaaaaggaactaaaagttgatcaaaagaattaattacccaggagtatcaaaacttggctttagcttgaatatttattgaattactctagtaaggaggtatttattttgcttttaataaatataattatattttatgatatttaagagaacaggaaatgatgagagatttggattgacagcttgaatattgaaatatgcatctgacaaaatacttttatagcaaggagcaaatataattgtttgaatgtcaaacttaattcctgaaattgtgaccagtgcttggggtttctaaaccatgtttgtaacattatcctcgggctcacctggactatttattgctggtgttaactctcctgcaagcctcaaacactaaggatgcccttttgtatttgccttggcagcaaacttgctaaaaaacgcaaagatgccatggggaatacccggcaggagatgactcacatggtgaatgcaatggatcgaagttatgctgatcagagcactctgcatgcagaagatcctctttccatcaccttcatggaccaacataactttagtccaagatgtaagtttttcattaaaattttaataaatgatgttacaactcatttcactttgaattctacacgataccttttgagtaatgagagagagtaggaaagtgaggggagaagcagctagaaagaagagaaagagatggagaatattatggaatttacaagaaggattctcatcaagattgatactggatttagtttaacttcaaactctatgaattttattactgtatcacaagggatattccaaacatataccactcagtccatagcacgtgtcattgctttaagtggaaatacacgattgcctacaaaaagttagttcatgtcagaatttataattctttttccatttgcatcttcctttgtgtaagatgaaagtctcttttgcgataagaggaaacagtaattctttttgggaattattgacataggtaaaatcattgcattaaagtagtatattgtagactcctggaaaattgcaatactaaaaagttaactcagggaaacattagtctacatgctcttaagtatctggtgtgaagtccaaaagtatacttgaattgggggttttgcaaggcatagtgaaattcatccatccatctgtcttgaaaattcctaatgttggtctatgaaggcaaggcttttaaaatatttccactgaagtaccatttaaaagcagatgattttaataattaccccagaatcaatattactgtttattttcaaatttcatatgaatgttatattctgttctatagtgcatctgtttaagttaattaaatttaagtgaaattgcctaactttgtttcttcaaatcctcaagtaaaactgatgcttgaggcaggcaaatcaggtatatctcttgagtatactggccttgtataacttgggccttatggcatttggctcagatcgcagagatatgctcaccccggtttggaaaacatgggtataagcaaagaaacaatataagtattatctcctgtacaaactatgaacatatgtaatagtaagattgaaaacaaagtatttgtaggttgtatgcttgtatgtaaagagggaagtttttttctgaattgttcagcttggagaaatttttcagtaactattggatctaaaatgaagcccatcattttctatgtatatatgtataccaaattagtagttaaggatgctatacatgagtcattttggaatttagttataatcatgacagggcctttcagatctattttatttttatttcactatagataaatgatagagaaaaatgtaaaatactattactgttgaaagtaagttttgcggaaaataaagatgtatcatctctttaactacttaatttaatatttaatcaattaaggttttgaaagcattcatgcctcccaaacttgtctatctattgcctaccttagggccttatttgaaagtttgaattcagcagtgtaactataaatatccacttatgaacttagagaaaggattaaatctatttcccacagataactgaaaaaaattatttggaatgaatatgagataattatttctttaaataccttacacttgatagatctaaaatacatgggtttttttttctttaattttttaatgtcaagtttaatcttctggctttttaaattaaacagagttctgaaccataattatagatacacctctcttgatgtttagatataacccaagctgagagagaaaattttacatttgcagaatacagtaatctgagaaagtttaataattatatttcttaagaaagcataaatctattttaaagaaaaaagattttaaaaaacaattttagagcaatatattccttcatgagctttgttttcctgcagtgcccaatgatccacttgtaccgactgctgtgttaggtgaggccctaaatctttatcatcttttcattgcatggatcacacctccttgcatgggtttgcccacatagagattatttacagtgcaggaggcagcttggttttgaaaatagacagccatggtattatcaaagagagcaactgtgttcaacccaatatcagatctagtggatttcaaattagcaaggcatgctatttaatgtattcttcaattcttggttgttagatttggagcaaaagtacatggcccttaatgtctgactaatattaatgtgtcaaaattagtagaatgaagccaaatgcatacatctgagggtgcaatgttgcctgaataactagtttatatgtaaaagtctacctaatggaaagggatgtttctaaatcctcccaatttataaccacgaaagaacaaatttacaagtaaatattaggattatgtgcatttgctctagcttttgtctttattaagaatgttttaatgtaggtaaagttgctaaaatcttgatgtggggtttgacattctacatgaaccttacctgataagtaatgttatctttcaagaaatttagaacaagctacttgggttaccactgtataacatctaagacaatgctattactaatgacaattaacgcttttacagatgtaaaattatattaatttttaaacctacctatatatttaagaatggaatgggtttcatttttcatttcactttgtaccctgttccttgactaattatacaccaatgattagtaatcagcttgcctgtatgtttacaggttccatatcaattttaccagcgtttctagttaagctttaaccaaagaaatatggaaactatcaaataaatatatcttgtaaattcccaaatgtcatgtttgttatttatatttaacatttcttgtgaacaaaaaactttaacttatattttatgcttgtatttttgttatacatacaatcaatgttcaattgcatttttaaaatattttggaacaacacaactaactcagttatgtaaaatatacctcttatttactaaaataaatatttaaaattataattttataattactataaaggatatatattctaaaataatctgaaaagtcaatgttcttcatctctacttgcactctccctttgatgtccaccaataatggttaggaagtgaactggggatttgccccagggagtggtcttatcacacagggaggagccataaatcatgatcactggggatcattaaggatacatcagatgcctctgaaaatgtcatcttctgctaagcactgtggaatgctgtcagtataaagttaataaataaatttcaattaaaatattgagaactaattggaaaaaaattagttgcctaaatgttaaaagtttccttacaataattttctacacatatgtaaagtccaagtctcggtcctcctgtggatttacaatatgaactcataaaaataccttacatctttgttttcccatctataaaacagtataataattcctaccatacctttttcatggggttttattataaagagaaaattagatgatgtgtatgagttttataaactgtaataattatcatagtaattttccctgtgaaaaaggatattcatgtttaaggaaagctagatttaacacaatagagtcataaagtctagttatataaacattcattacacattttatttaattttgaaagtcaagctggttttaaaaatatattggcattctttaaaagctaaatatctcattaatcatattagatgtagaaatgatttgttgtatttttcatcattcttaggattgtggtctttagagttttgcatccaatcatttttgtatttataatgcagtttctgaaatcacttcaaatattgcttaatgctaatacttactgatttaaaagggcttagaaacttttcatactgattcgtatttttggtttttgtgttttactgcttcattgggtttaagttcctataacaggtaagtgtattgcaaagaactctagaaaacctttcaatcaaggatatatttcaagttattattcttaaatgtataataaggataatgattagtacgtgtaccctcactactagtcacattattaggtggtttaatgaggtggaaatgtattgagattaataatgcatatgtgattattttaaagaccttactgctcattgtactactgtattaaagcttaatgcaaaacaaaaggcactgtctattttatattgggacacaatcatctgtaagatttggaatatgggtgaattctgtgtttctcactgagcctttttcaattgtaaatattctgctactccagcaggtaaaagtgagctctggggctgctccactgagccctggctaccttcttccagcttgagtgattgcattttgcctctctgacgttatctgttctctttacttctcatccttaactgtatattctgtggcagtgcccaaatcaattgcttctgaatttaatttttctggggagatgtatttattctttatgtcggtctgttgattgtaatattttaatagaagtagatccattgactttggtcgcatagtgagaacaggaaactctcatgaatcatgtttgttagccaatgtttttgtgtagaggggtgggcaaaatctgagtaaaagacatgaattcacttgagtggttaggtcacaacagaatctatcagggattttttgattcagtgtatttttaggaatgaatgctacaaaaagagcattcagcttaataagagggagtaaagataaatgcaatcaagctaaattacagaggcacacaaatctgattgtagggttcttttttttttcccttctccaggaagaaaaaatgtttatcatggggacaacaattcattttttgctatatcctatttgtagagttggtgatagaacaggcaaatgtactagcacttgaaatatgtttatctgttaattaaatatcattctctacagtatgcattatcattaaaaaaaaaagttcccctaagagtgtattttctcttctgttaatgagtatgacggtataatgcttttcaaagtaacaccccttaaaacatttgtttttttttttaagtggtaagtttaaatgtgataaatatgagcatgcttctcgttgtaatgtttagtacttcggtcattaaagtactgtttattcttcataggcaaaaatgttcttgttcttttcttccttcttatgacagaaaaagaatttaaagtttcttttctttttaagctaataacacaattgggaagggacttacgcttaattgtgagtggtcagggattcagttgactttttaattcattcattggaatatttattgagttactgttatgcatcaggcactaggaatagaaagaaaaatattctgtctctgtactgtgtgttcagaatttagtgaggaaaatagccaagtagataaatcattaaaatatagagcaagtgaaatgacatgtaaaaatgaataagaggtcatgggaacataaagaaggagctttgtaactcaacctggaggggccagaaaagacttccaggggaggaacccacattttgctccagaagcgcgccctgatttctctcgcagcgtggccaagagactcaaaatacatttgcaataaaaacaataacagtaataagtcaaggcggcagaggttgaatataaatgcacgtgtagtctggctagcagacagagtggcatcagggggtgatcatgtggaatgcccatgtttcccagtgcagagtgtgttgtggtaaaaagccccagagaatagggccacgagaacaagaagagcagccctttggggatgggtcacctagatcgggtatctctgagggaggttgggatatggttgggaaggagtttggtcgacttaatagaccatgaaaacacctccacttgacagctgggtcctctggtcccactctatactgctatgactacagatgcaagaaaaacaactcagcaaaatttcccgcttaagcttttaaaaggtctatcagatgtctccctgcatctcacagtgtctgttgtcttgctgatatacacataatatactctcacctgaaaccttgagttttgtctttggggatactgtctaggcctatactgtatgatatttctttcccagaattcctcttgttatcagaaagatcttaaggtcttaaaatcttcattgcatagatacatatattaaacaagataactttgtctcttttttaatcttctgaaatctgaaaaatgccagatgagaaccacagtgctacagcagagtccagtcgccttctagacgtacctcgctacctctgtgaggggacggaatccccttaccagacaggacagctgcatccagccatcagggtagctgatttactgcagcacattaatctcatgaagacatcagacagctatgggttcaaagaggaatatgaggtgaataagttttgatactgtattgaatttgatttttaactatgatactcagtggaatttagcatttttttccctctctttaacacaacaaggaggggattgttctataggctctctaatctagtgtttatgagtgtacaaccaagtgtgtgtacctgggaatgggaagggaatggggaaaaaagcacttcccagagatatatgagtctaaatttattacaagaatctttaatgttggattccgtaatttattttactatggtattaaaaaaaaacactttgcgtatctccccatgcaaaaatcaagtagcaatacactttgggtcccattgttccattgcagattctatcatttgaatgaatcaagtagcaggtacttctctgcccctttttttgttgaccttatggttgagaaatcagatgaagctttgtgctctaaatatactacttgccactctcagtttaattttatggattattggttgagggtggctgagaaaaaaaatagagcactgcaaatctagtaaacaacactgagaagccaaaagaaggcagtgggaaattcttcttccaaccttatttccccttcctactcaaaccaaaataccaggacttatctcacaaaggcaatgatttaaaaccaaacattccaacaaacataatatagcaaaaggaaaatagttcctttgccacccttcacttactgagaaataccaatctggggcatggaaggaagccagtccactacccatgaacacatcacagtatgcacacatttaaagtgaaagaatccaagtaatattttgctttgaaaaggccatccaaaatacatccaatttcatgaagaatcttttaaactccatattttatctatggattacctgtataccttaaattaggagtgttaattatctctgaattttgaaagttgattttagatatatgccagaaacactgccgtggtaacaaaataagtacaaggaattagactattctgccagagctggttctttttgttcatttcatgtgtactcctgtgtaccttgcttcaaagaccactgggctctttgaagaccccgtttcctgtgttgagcaaagtttaagttcttttgcaaaatgaaatttacacccgttttaaattgctgcatatagtaattaaactagtcaacaaattcttctgttcccagattcttgaagaaggggactctattttaatttttatatggtcccttgttgtgaagactcactctttttcatgatcttcaaagaaactcagatgcgatgtattgcacacaatttaatgaataattatggagggaagcaggttttctttctactgttataaatgctaaatgatgcacacttgaaagatactcattaaaagcttttttgcagttttgatgcattatcattcaatacgttttgaaaagaatgatactttgctacttctacttctcattatagtgatcttaattttaaaatactttcaaggtccattttttttctctaaagttatttttttgtctttaatttgacctgaatccaatttaagatgaacaagtatgaatccaacaaagcggctttgaggtctgagaatgaaacttgtttactactgtaggactgctttcctctctgagaaagtggtttttactatttggggcttcagaacagataaacctgatttttaaaaaggaattaaattcagtctgcttattcgttttgttttcccagagcttttttgaaggacagtcagcatcttgggatgtagctaaaaaagatcaaaatagagcaaaaaaccgatatggaaacattatagcatgtaagttcccattcaattcttggtgaatgtaaatattatatgcttatatggttttaaactttaagaaaaatcccagagagtggtgtgtctgtttatgaagtaatctatttaatattaaaacagcatttacaatcaggcttgagggctcatgcctgtaatcccagcactttgggaggccaaggcaggtggatcacctgaggtcaggaggttgagaccagcctggccaacatggcaaaactctatttctactaaaaatacaaaaatcagctggcttggtggcacgcacctgtaatcctggctaatcaggatgctaaggaaagagaattgcttgaacccaggaggttgaggttgcagtgagcagagactgcattactgcactccagcctgggcgacaaagcgagactctgtctcaaaaaacaacaacaacaaacaaaaacaacattggctattagcagtgattctgaaattgtcatcatcctcattaattaaattgactcagccacttcaccctgtggagataacttgctgtttgatttcatgtttgtacataaatgcatggggtattactgaacagctgagactatcaggataatgaaaaagtaagatcttttcagttataaattgttttaacacttccatcaaacatattcaagattggggtgttattctttccacgtgcctttaattcttacttggagccactgtctaaactccagttgttcgatattatttatcgttagggacttcctcctgagtaagtcctcaagatatacacgggataataaagtcattatcagacaaaaccacaggatcagtaaagaaagtagcagatagtttaacttgtaactagctgctgatttacctagaccactctgctctgaatttaaattattttaaagtatcttatgaatagctcaaaatctaaccttgattctcagggagtaagaaactgagagcgggaattcaaaattcactttttaattctgtggctcatttgctgtaaagtgcagaagaaaaggatccaacccgtttaaagtcatgactaaaaagcaaaattagaagttaagtctagttcagttatgtagacaattctatgactcaaatgattacttaccagacaatttcatgtctcctaaacactaactatgaaggttcaagtcagtgaagcttaagtcacacaatattataagtgtaatagcaaggttcactaacattcttatatttcttcaaaggactgatttggtagtagtatactatggatagactatgggcaaccactgaattctttagtctctaccaatgacattgtctcagaacagggggaaaatttaacagcttatatttattattttaaaattttagatgatcactccagagtgattttgcaacccgtagaggatgatccttcctcagattatattaatgccaactatattgatgtaagtatttttatagttaagtatgtctactttattggcttatatatatgaacctttttgcttattacctataaagtgattgctagctttttaaaatataaaagtacaaactgtacacttttccttgttctgcgtcctagtacttactgacattgttgtgctttctttcacacctgactttggtttgggctgtagatttggctgtacagggatgtaagtaccactatatgtaaataacagcaccctattataaatacaaacattcttaattacagttattactaacgctctgttactactagttatttctgcatgcttcacctaattagcttcatacaatatatctctgttcgtttttttgtaattctttcacatgcgtaaagatctattttaccaccttcccttttcttgtgtagaaaaacaggaccatttttagctttgacagtttattatgtactcgagttttatttgttgatgatttctgtttctggcttttattcttacccttccctaaacatatgtgagaagctggatagtatgatgtgtattagtgttactgaaattttactttttacatttgacttctgacgttaaaatgagtagggagactattttgtgatgtgttgtattggcttttaaagtaataaaattactcaggcaaaataattactaaatttcaattgtaaaatacacatatcacacatatatatcgaatcacagaaatgaaaaaggttgctttgatcatatatttcactgttaaattttgattacatacatatctacatggaaattctttatttaaaggaagtaattatcaaacaaaatatagaatattcttaaagggcaatatattacattacctataaggaagacctggttcataatcaccctggagatcttgggaatgttacttctctctctgtacctcagtttccttatctttgcagtggggataataataacagtactaacctcatcactttgttgtgagaattcaatgaagtaatgcatgttgagcattttgcccaatgcctagcatatatttagcactctttaaacttcaactattttttttacaattaaaatctaggtgtgctataattaaattgattcacaatatgtataattataagacaaaaggtggaggtattaagaatggtagcatatgtatacttctatagacctaaaaggtatgaaacctaggacccaacattttataatttccataaataggaaataattttcattacatttattaggttcacattttagagttatgaattgtcattatgtatttagttgaactaatatattttataaagcatagtatatgagtatatgagttcaatttctgatcataatcttactcttattcattatataaatttatcaaacatcattatgtaaaactaagctaatggtctaatttttagaataaaaaaatcaacagttctatgacaaatttgtaattgttcttacctatttagtttaacctgggttttctgccaggacttgtacactggagccttgttataaaattatttcatggttcatatggtaggactgtattttaaataagacttgttatctagtctttctgttaagaccccagtgtattttggtctatttctatacaatttcataattttccctctcccattagttcattatatgtaaacgatatgagtatatacttctgcaattggtattttttttaagaagtggaaatgaaatacttataaagcttggaaaaatttttccataaaacattgtgctattttccataaaacattgtggtatattaaaaatttgaaatcttccaaatttgcaataacgtaatactcatgctattaaattttaggttggagatctcagttcacatgtatttatatgtgtattgagttgcccacaccagtatgtggacaaattgtaccacagacttttactaaggctcattggtaaatatgcaacaaattcagaacttaggatcatatcatcaacatttttacaacttatgctttgttgttattcaaaccaattgaaagcaactaaaaatctattcctcctcaacagaacttttagcacactgaaaaaaaaaatactaaatttttgctcaagataagatgcatttttaaaaattcttctttccctatatatatgtgtgtatctataattatgtgtgtgtaaattaacattgtgagcacgcacaaaatagtttttgcatatccctgaatgtgttgtagaacaggaatattctctaaaaatctcagcaggactttgattggatgcacacatgcattgtccagctctaacattggaatgttctgttatttttttatggttctaatatgtcctcgtccatttgtaatgcagtgtgttgtacttttggatgataaaatgagaattaatatttttaaacactattttaccaggaatgaatgactaaacatttacatgaaggcataaacattttagtgaaaccaaacaaaatctatgaggttattccatggcaaacaaaaatcaattatacaatatatattctaatcagagcctttaaaatatttaatttttgttttatgtttacctttcagataacataggtttgagaagtgaactatgtgttcactactcatttctggactttttattataacttaatcttaacaggtggttgtcttcatctttttatgccttcattcatttatttctgatattgatgtaaaatgataactaatttgttctcttattttagggctaccagagaccaagtcattacattgcaacccaaggtaaaactttgccttgttaaatgttatagaaaaaacaaacttgcttattcatctatgtggtggtttttattattttttaaattttatcttagtaacaaaaaaatcagcccttctgattaacactgctccttactcatttgtatagtacaaatttattgtgtgtgtaaagcttatataaatttaagcttgatttacttttaattaaaagtgaaagaaaagctggtagtggttattatgatttgatccttgttacacagataggtcagagcactagtcaatagtgccagtcagaggaattactcatttttgaggaaaggaaaaagaagtctcatataagaggcctgtcttcttgcagcaagtttgttagtagtacccaagaccaatattgttataatgagctgttatactgagcaattttttgacgagtcaagactgagacaaaacaaagagatggaatttagtcaagttaattcttcatggaatataataagacagtagagagatcttgttatagtggtacactggggagtaaaagtatccaaataacaacaacaaaaaaagcatctgtagttatctctctaaattgactactggccctcagaagagaaacctgtacatcttttttatataaaaggaaagtaaaacaaaagctaggtttactcttttaacaggggtcatttttctgtgttttcacatatctttggagtaattgagttcagttgtgtactctttaaagttagaaagatcgaccatagtggtgaacaatattcagttttatggtattcggtagagaacagcccagcacatgcttttgcagtttggagatattatgataagattaggatatgtccttacgtgtaaggatatgtttttattgatccctaaacatgcactatttataaatagtgggcacttatttaattggtaatatatgctgtctggttgatggtggtataagagttctattttttacacatatttgaagatgcattaaagtgacttagtgacaaatataaatacccaagaaactagtgatagtttcttctaaattgggaagtgtagagggcaaattgaaaaaaaaaaaaaaaaaacttgtatatgcctgtgtttttgcctattgtgggaatttagatatgaactgaatttaagtattttcagtgacattttgtgttagaccttttttggaattacttagtttactctgcttcttatcttagctaaacttcttactaactacaaaattcctttgataacataatattcaaattaatttctttgtaggtcccgttcatgaaacagtgtatgatttctggaggatgatttggcaagaacaatctgcttgcattgtgatggttacaaatttagttgaggttggccgggtaagaggaagaaaaagaatttttttgtcataaaaatgaacatagttgagaagcaacatgtaagacactcaaaatagaatatcatccaattgtttaaaaaaaattataggcacaacattttagttgagtacttctaagtagaccttgactggctgaaaaattatttgatttctcattgagtaataaaataagctttaattttgtactagaatctaactgcattatcaggcttgtatattttttgtgagactatataaactctgtttattgtataatagatttttttctcatttatagatttttaaactgagttttaattgtgacctaaggagttattgctggaattaaatcaccttggctaattagtattatatattcaggtctgtctatatattctttttgtcacttaggttaaatgctataaatattggcctgatgatactgaagtttatggtgacttcaaagtaacgtgtgtagaaatggaaccacttgctgaatatgtagttaggacattcaccctggaaagggtaagtactctaaaattctattttaaaaagtgatatcaaaactgctttttctcttaaaatctttgccaagttctgttttgatgatgctataaaatccattcattcatgtattcattccacaaatgtttatttgagagtttactatgtgccagacatgtttctaaaccttgggacacatgttaaaatcgcctcgtgtggatcttagagccgattgaattaagacagcaataaaaataaataaatcaactaatatatcatacatcatgacaagtgatatagagaaaaataatgttggggaaggaagtagggaatattatttaggcagggtaagaaatggtttacaattctgaaaggatgatcaaagaaaaactcattgttgagaaagtaatatgagtagagacctgaaataagtgagggagtgacgggttatgtccagggcaataatgtttctgacagaggggagagtcatttcagaagcctagaggcatgtgtaaagctgttagaatgccagacagtcaccaggccaagatgtgcagatatccataagtgaaggggaaagaaatacaaaatgaaggcagagaaatcacaaaattggataagtggtgccttgtaggccatgatgattttagttcatactaaaattgagttaggctgccattgtagggtttgtgagctcagggataacatggtctgaattttatttctaaaaggatcactccaagtgttacattgcaaagaataacgtaaggtggctggtgtagtagactaaagtgaaatatagtaacagtgaaatacattttgtggtaaagcttggtagatttgaccacacaaaattgtgaaattacctgtggcacaaaaaaatatcaaaggtacatacagacagaagaaccttgcgattgtttattaatgtccttaatttataatgttaataccagtagaagaaaaaaaaaaaaactagaatctctgaagaaacacaattgttaacaagcctattaaaaatgtttaacctagtgtacttatataccattttgtccttccaaatcagcaagaactttaaaaaagaataatcctcattgattgttagagtatgttgaaacatatttttatacattactgatcatagttaaatcgctacaaaccttctttaaatcaataaaacagtatatctccagagctttaaaatgtttatgtcctttgagaagttaactttcatgaatctctcctaaggaatttatttaaaatacaatgacttcatttatagtattaaaaacttatagataaccataaatgcccaacaatagagaaataattgcatagtattttataaaaatacttgtgagttatcctaccaacatgaaaaaattaggcaaaatattaagttgaaaatagcattatacagaacaacataatcatgattattgtaactgtaaaatatgtatgaaaatttcttagacaaatcaagtagaataaaataagcaattgatatgggagatttcagaaagaaccattaagcttgatttaatgaataactagctcatattattaaaaaagaaatgtggaatatgcagtctcttaagttcatacaagtcttgtaaaaatcaatgatgaacttagtaataaggaaaacctgaatacataacaaaaagttgagatattgccaaaatccaatagaaagcaatgatgacaaactgctgaccagtgaccccagaaattagcctattagaagtcaccaaatcctcttctgaataatccttgaatgatttcctcaaaactaaaattatattatatagatcaatagttttacatcaaaatttacctcattattctgtaagaaaaatttatactcataagtgatttctgttttgaaatgtgctctgaaatcatgtgaaaaattataacattggaaaatcagaaaaagtagaatagaacaaaggaaaaattaaatataaaaaagaaacaaatgagaaaaaagaaaaagcttgtttattgaaaagatcaataaagtaattaaaccactattaattctaaatgaggtacaatgaaaatatacaatattagaaaacacagagggacatagccattatacttgctattagaaaagctatggaaaatattatgtataaacttaaaaatataacttttagtccaggacacggattttctgacaaatgctgattctcaaaaattaggtcacaaagatttagaagcatgaatagatggtagaagaaaataggatgattgttattatcattaaaattgcactatggttttaaagttaaagttcctttatactttaaggaatagctaatatctatgttttaaaagttagcataatgtacttggaaggctgaggcaagagaatcatccgagttgggaaagcagaggttgcagtgagccaagatggcgccactgcactccagcctgggcgacagagggagacactgtctcaaaaaaaaaaaaaaaaaaaaaggttagcataatgatgataacagaatcagataaagatagcattctctggagctctcattccctctttcattatgtctttcttctctctcttcctctcttccccctcttcctctcttccccatgcacacacatattgcagaccaatttcattcaagaacatgaaaaaattcaaaataagatattgaaaatttggatctagtagtgaattaagaaaatatcactacatgacctattattttttccctaagaatgcaagaatatttcaactgtagtgggaaatcttaacaggatatttcattatgtgcagtacattaaagtaccaaaactgtatgactttaatagattaatgcatttaattttattttcaaaatatttatagtaatactctaattagggaaattaagaggcatcctaaacatgataaaggtgattcaacaatacctagtagcagccatgttaaggaatgaagaactaacgactattcatttatcataaaaaactagtataaagattatattactgcttctacaatcatgaatgttacgtggataatcagtgtcactaatattaaacatttttggaagttttagcaaatgaaataaggcagcaagaggaataaactgtgtaactactagaaaagacaaattattttaagatgaaaggatttataccaagaaaagtatggataatatttttaaatgggatgtataaacatttatttaaatgaccaaatctgcataaatattcatgagttatagcttgtctttatattagtgataaacagaagtaagaaaatattactaaataatctttaaaaatacaaagtgccaaaatatctcagaatatatttaataagaacgatatagttcctgatttaataaaaacacaaaagtgtacttacggatacgcataatatgtgaatgagtggagacatgcaccatgttccagaatatgggagtacttgatattaatatcactgtatggatttaatacaatcctatttggaaaatcattggattttttttttcttgttatttagaacaagaaaatggggggggttgtttttttaaccacatatttgaaaatcattcagaaaaattaaaaaaaaaatcagggaataggtgctgacatatgaaaatgtactaaaaagagcaaaccctatacatgtaatagaaagataaagggagcaaggcctattaagcaactccaataaaagaattaatatagaaggagtaaagtattacctaaaatcaggccatgaaacaatttttgaccttcctcactagagttgaaaagtagcaaaaggtgattttccattggggtgattccatggtgatgcttatcattgtgattgttacagttatttattgatgatccctgctttgtgtagggtattgtgctaggaattggaattaagaaaacctttaagaaatgatcactaacttccaaggttttggtggtattggtttgtataagattgaatctaaagataaactgtttttctcagttttgtttatttcatgtaatgtgtctaccttttctgattgaacaagtgagattgatagttcacagatagttcacagtagaatttgaattatatagattatagtgggattttttttccttttgctacaaatgtgagttcttaaaaataaattcggcaatatttcatctataccttccaagctgtgctacctcagtctacagacttcttctaaaaaaaggaaggaaaaagctttgaaatgtgcatttacagggttctcttaaattaacccaataggagagcagcacaacagcagatgcttcacttctttcattttgtatttttgttactataaataatactgcgctgaattatttcacagagctaagaaaaatagtttgcccaaagaacagtttagctgcctgtatattttcacaagccaatctagagcagcactgtcctggaaaatccctacatgctatgcttcaaaaccattttcaacatggataagcaaggcattaaaatctctttgtgaggtgagaagctggaaagttgcttttatacaccacttgagaactcaatgcattgggtcaatggggcagcattttagctttcccatttccttcttttcccctaataatttaatgtgttgtcactcccagcaagaaacaagctgtcaaagtaaataaaatttacccagacttttagaactgagcaagacttataattttctttctttggcagttgtctgacaataaaggtaagctcctagtccatgttaggccttcattttattatatttttttttttaagaaaaggcatagtctttcgtaaaggttttattgttatcattgtcagttgggtctgtacccataattgtgtttaatggctttattttggccattaaaatggcttttgaaaacatttctttccatctttgcacagagggggtacaatgaaatccgtgaagttaaacagttccatttcacgggctggcctgaccatggagtgccctaccatgctacagggctgctttcctttatccggcgagtcaagttatcaaaccctcccagtgctggccccatcgttgtacattgcaggtaagtggtggtccaaatggtattgactgtatgcaatcagctttttttagagtatcaagacaaggcttttgagcacaaaaactaatgtgtgcttacgaagttccagcttgcttgtattatagataaagtaaaacagcaataaaataaaagttggctgtaagtagtctataaaacaggaacttaagaaatacatacattcatcctaatgcgtgtagtgttatccacaatttaaagtatagaaactctgccttttaatggcaacatctgtgttttttgtttttatcacttttgcaaatcccatattgtatagaatgctaggttgaaatagacatttcttgccaatctagaaaattcccaatagaattccagctttaaaactaaatttcagacatacagagttactaaatggcctaaattgcaaggatttgtgctgcaaaacagctatttaaaaattttttttaaagaattcacattagaggaccttgaaaactgcatcagtgagattcagcaaatatatgccaaaaaacacgagcattatatccagactttcttctgattagaaacttctcttaaaacaagcatttagagatactaaaagcaaattacatggcctcattttgaggtgtgaccagaaaaataagtactgaatctgaaaagcgtttcctaaatgatgctgcacaccattctcatacgctcttccctccaagctacataataggttgtacctaagcattttttgctttctgaaaatccaacctattcaggatttaaataaccatgtataaaagaggggaaaaaaagcagagaatgaagtaaaggtaaaacgtcccataggatcagatactatgtaccctgaaaacaaaaaaaacttcctttcaatcctcctcatgaaatctgatgtactcttaaattacattcctgtctccaactctgggaacagtgattgagaagatggtaggggacaaagataaatagagatagccacaatatcttttgcttaaatttctaaaagaacagtgagtttaagagaagtgaccaaatctgaataacaaggaaataatgttactagcctatctaagcacttagaaaatgagataaataggttttcaacttaagaatttcttgatttatcagagaggtttactttcttatgaattgcttgcttcagaaatgctccaagattctcagatactctcttgaaacagaagtgtcattttccacctacactgaagcatctctggactacaaagtgaattccccactccccgcaaaaaatccttattttgttttccccattgacttctatatataaaattggagaaacattccccagctgcaaaataatcacagtatattacaattaaaggacacaaaatatggtgagatagaggaatacattttagtgttctgtaccactgtaggatgagtctggtaaatgataatgtttagtttgagagagctagaaggaagatactgaatgttcacaacataaatgatacatgtttgagaggacgcatatgccaatcacccttttctgatcactctacattatgtgtattaaaatatcactatgtacccaagaatatatacattattatttgccaattaaagactaaaatataattttttaaaagtatttttaaaaattaactttagaattaaatacagtaagatagcggctagccttttgatttgctgggaatcatattctacacctaataattcattttcatttctcttcagatcatgattcaaatagtctttacactgttactctcctcccctttgataaccgtcattctcttgcccacccccaccatttgcatttcctgtgaagcgtggctcctcagatttcccgtttaaagttttgggaattaattttcttttgccttggtatttacaagaggtgaagacagtgagtgagccaacattctcacattgttgccagaggacacacaactagatgaatctaaaaatattcaatcttgagttaaattttgaagcgtgaatctgccacttgatcaattctatgaacttgaaattatgtgtattaaatttacataaaatgaaaattgtgagagaggtgtggaacttaaacagtgttattttcaatttgaaaataatttagaactcttgttccaatctttagtttataccaaagcagatactctgcatgaagctatttgtacattaataagcttttacacagcagggacaagtgctgtgccttgcagtttgttaaatcaatttgattctacctatctgacagtggaaaaagtccttatttaaggttatgaagactaacatccttcttacaattcattaaatttaattgtttttcagtgctggtgctggacgaactggctgctacattgtgattgacatcatgctagacatggctgaaagagagggtgttgttgatatttacaattgtgtcaaagccttaagatctcggcgtattaatatggtccagacagaggtatgtagatttacctgtagtggactttgtttttattttttattttttttgcaaacaaagagtagatgtctctcatatatactctactcaaccgaaagagatgtttttcatgtgtaatcaatattagctgagtcatatagaaaaatattggtgttttaattcatatttccatatagagaaaattttctgtatttcctaactttgatgacagaaaagtgatactaaaactagtacaaaattttctttttcattcttttggtaggaacagtacatttttattcatgatgccattttagaagcctgcttatgtggagaaactgccatacctgtctgtgaatttaaagctgcatattttgatatgattagaatagactcccagactaactcttcacatctcaaggatgaatttcaggtattaactatttctaaaacctcttttgtgacttactacaatttgttctgggcgctaggaatcctttcaaggaaggtctttcaagtcaaatttataacctttgatcctgttttaaatacaatacgtatctctttcattatacatattatatagtcacttttctattgatgaatttatatctactatatccaaaatgacaaataagttcagacttagggaagagcaaaggggaaaggtatcataaaagtcaaaaattaggccaggcgcagtggctcatgcctgcaatcccagcactttgggaggccgaggcgggtggatcacgaggtcaggagatcgagaccatcctggctaacacggtgaaaccccgtctctactaaaaagacaaaaaaaattagccaggcatggtggcgggtgcctgtagtcccagctactcgggaggctgaggcaggagaatggcgtgaacctggcaggcggagcttgcagtgagccgagattgcaccactgcactccagcatgggcaacagagcgagactccgtctcagaaaaaaaaaagaaataataacaagtcaaaatgagtggtgatttgtgtgtatttagtgtgtatttatagcctttttttcatgcagtcatacagattttgacctgggtcactcacaatgtgatgagatcaagcacattaattataactgagtctgggttcagtggcagctcacacctataatcctagcactttgggatgccaaggcaggcagatcttgaggtcagcagttcaagaccagcctggccaacatggcaaaacctcatctctacaaaaaatataaaaaatagccgggtgtggtggtgcatgcctgtagtcccagctactcaggaggttgagatgggaggattgcttgaccctggaagtttgcttaaccctggaaggctgtggtgagccaagatattgccactgcactccaacctgggcaacagagtaagaccctgtctcaaaaataataatagtaataataataataaatgaagtttgtagtacatgttatttcaaaatagccctaaatgttttcactgcccttaaaacacccctgaaggtgggtgaaaataaaatcaagggcagagaccaaattctttgattgttgatccagtgctctttccaacatgccatagcttatcttcaaatatggcaagcccagatgttactacaaatgataccgtttcccagtgtgatgaagggtcattatcataatggactgcccgattgcattttctttggttaaggcaatgcattttgcaggtagcagtgttgtttagcgtaccttttccttttaagaagaggagccctgaacaatgtgtgtcttgtttctttgtcacttctcaggcttcattagctttaactacaaggtctatcagcctgtcatagtagcaaatgccattgcctcgcacaaatccttcactttctacttggccttctaaattcctgatggatctgtgttatactgttaaatgggtcacactgtcttttaacctgggttctcttttctttttagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacgtaagagactgccctctttgttagtgtagagtgttgtggaaagctacataatgcaactgaacactggctagttttcttttcgaggaaattaaaataacctaaaaaggaaaagtggaaacttttattgaaacacatttttttggaaaatgattttaggttttccctatagagattcttaagaactgtcatttttatagctttattgtagatttggagcttgattgtcaattattatattcatgtagtaaatattgcaagttataaatttcatcttaattattttcagaaaagaaaatcatgccttatctattttgaatataattagaaatgaattttttaaatcacagaatgccaaatcctacaaaaatcatgttaatttgggaaatttttatttctgacatttaatgtttcaataatttacaattaatttgttggccattaatcaataaggactattataagtaactagagaggggatggatggtattatgttaacacatccatcataatgaaagaacaatcttgccccattctaaaatcttaaattgcagggtgttatatagcccatagacagaacaatatggaaagaaagttttctgttttagtttttggtttttttttttttagacagagtctcactctgtcgcccaggctggagtgcagtggcatgatctcagctcactgcaacctccgcctcccaggttcaagcaattctcctgcctcagactcttgagtaacttggaatacaggagcgtgctctaccacaccccgcttattttgtttgtttgttgttgtttttgtttttgagacagagtttcgctcttgttgcccaggctggagtgcaatggcacaatctcggctcactgcaacctctgcttcccaggttcaagcgattctcctgcctttgcctcccaagtagctgggactacaggcatgcaccaccatgcacggctaattttttgtatttagtagagatggggtttcaccatgttggtcagattggtattgaactcctgacctcaggtgatccacctgcctcggccccccaaagtactgggattacaggcgtaagccaccgtgccgggccttttttgtatttttagtagagatgagatttcaccacattggccaggctggtctcaaactcctgacctcatgatccgcccaccttggcctcccaaggaaagaaagttttaaattatgactttggccactttactttgattatgttggaaagaagcaagaaagctatcatggtttataatctttttaaacagtttactgccttcatttctagcttttgccctttctcctatgaaaccatatcaaggagaaattagaagccacggttcatttctttctgactataacaggctttctaagttattgttcctgttaagcccacattctgtttctacgagtagtcttcaccagttactttactctttttggtgctgcaaagcggaatagtctaaaggcaggctctcgtccttgctgtggtcactcttgcctgtgaaaagctctcatccttgctgtgatcggagtcttgcctggccattaatcacatccactgaaatcacattaaatcctaattataccttttctttttatattaggtgtctggaaaggcaaatatactaaatagagagatggcatacaatactttttcatttctgcatctaaatatggaataaaaaaaggatgtgtgaacaagaaaaggagaaaataataatatttagaaaagcattgatgcctttgaattttttgccattggcatctttgtcaaatttttctcaatgtccagattgtctccttttcttttcttttttctttttctttttgagacaagctctcactctgtagcacaggctggagtgtcgtgcatgatcacagatgactgcagcctcaatctcctgggctcaagtggtcctcccacctcagcctaccaagtagctagaactaaggtgtatgccatcatgcccagctaattttttttttattattttttgtaaagatggggtcttgctttcttgtccaagcttgtctttttttctgtatgaaagttgaagcttgtaatccacctgctcttactgtctgcttaatcccctgtgattcaaaaaaaagacatttcatagttaaagctgttctggggatttagtagtgcaaatgaaccgttggagaagtaaagctggtttgatttacaagaacagggtttattgttcacttctttctccctaccctttatccccatcattagtacccttttgccaggtctatgagggattaggagctagggccaagaattctgtaatttcaaagccttacatatgttcctgcatttagagggaaaaagaataggaagtcttcagtcttctcctctcttatcagctcctcctcatgcatatcccctcccctgtggctcaaaaaatgagtagatagccgtcagtctgctttgacttacctttgcatggagcagacatttgattggaagaagagcttcctttcttctaacttttctcattgtattagttcattctcacactgctaataaaaacatacctgagactgggtaatttataaaggaaagagttttaattgactcacagttccacagggctggggaggctcaggatccctgcaattaggccgaaggggaagcaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattacaattctaggtgagatttgggtggggacacagagccaaacaatattactcatgaaccttcctgcctttcttaggagacactcatcccagctgcacgtgtaacttggtaaggttttgaggtcatttagaagtagccaggtaaattattattgtcatctactcagatttatcctgcagtcttcagccaacgctgaatgccatggttggtagcatttcccaaatggtggtagcatcagtgaagtccaagaaccagttcctgtgctgatgttaagattcttgaaggacttaaatagtagtatgatacaaatgagttacaagatcattgaaaatttttgtcagcattagggaactctataatctactaattattattattattattgcaaataattagtttaaatcaaatggcaattgtccagtccagataaatattgtttttactacttctccctttggaaagagataatatattgtgttctaatcaaggaggacttggttaacaaggagctatctccccgcttatgtggggacaggaaatatattgctgttatgctttggtgcttcaggatcttaaatggttgagactgtcattatgacctttgatatatgttagaaatgcccaggaagctgtggaaggtggattgtctgcaagatgtgcagaatatcctggtagtgtccacataatgtaaaagcacaagtgtttgagctacttgtggtttttcttatttggagtggagaagagtaaaacaattttacttgcacgcacacacactatacacatacccagatgattgatagacataccaggggttttgtgcttactttgccttcagcctctcagagactgattacgtttggaaaattgaaatagcccaacaggaaccttacagaggatgttaacctcagaagctttttagtttcttcttttgtatttgtcctgtatttacgtctttcagtaaagtaaaaactcagttattgacttgaattgctttggaagcattgaagtcttccaccaaattgattcattactgtactaattcagttcattccagtggtctgaatctcctattccatggtttaatcatcactctggctccttctgcatatgaagctattgcatcttactggtcctacattgaagtgtattgtatctgtttgtacaaccgatcatacattttaagtttttatatttctccatctaccttgtttcttcacagagctacaggcaaccagctgctttcatcgtcacacaataccctctgccaaacactgtaaaagacttctggagattagtgtatgattatggctgtacctccattgtgatgttaaacgaagtcgacttgtcccaggttaatggctatggattgcttttatgtacttatatacaacttaatagagtagtaatgaattgctaaaatctgctttatactatcctaactagaaaaaataatactctttttttttttctttcaaaacgttcatcatttagggctgccctcagtactggccagaggaagggatgctacgatatggccccatccaagtggaatgtatgtcttgttcaatggactgtgatgtgatcaaccggatttttaggatatgcaatctaacaagagtaagtcactatcggatcctttgagctgatctagaataggtcagtcataaccaagatgtggtataattttattcagacaacagggagactacaattaataagcactatatcatccacctcaaagctagtaaccatcttatgccttagtactcgaataaaaatacaggaaaacagaaatgctggaagctaggtttttcggtcagtcactagactagcatattctctcaggaaatacagatgcactggctcagtcaagttggacagcctaggcctggcctctgagtgtatgtagacttatcttaaggatgactgcatgttttattagtattgacatccagcccagaaaatggcatgtgataaaaaaaataagaacattgcaataacaataatgacagagaaactgtactgcaggaggaaagagacatgttggatcaaccattatagaagggttccatgtcactgttccaagttcattattgattatcctacctgcaatttcatcttcctaaacgtctcaacctatggctctaagcagatctaaaggtagaaccagtgctgctaccaccatgccttttcccagcagcaaagtagtaactgtatcgtctttctctgactcctcatttgctttccactacatgacaaattcaatgtgggtggggaagatcttaaaaaaaaaagtgctaataaagcccgggcacagtgcctcatgcctgtaatcccagcactttgggaggccaaggcgggcagatcataaggtcaggagttcaagaccagcctggcaacgtggtgaaaccccatctctactaaaaatacaaaaattagctggacatggtggtggcatgcctgtagtcccagctagtggggaggctgaggcagcagaatcatttgaacccgggaggcagaagttgtagtgagctgagatcacgccactgcaccccaggctgtatagagcgagacttcgtcccccaaaaaaagatattaataaaaacaatttagattatgtaaccaaataacaagcagaattggaaaagaaaacattagtaactttcatgaaattaagctctttttagagagaaacattactctgttttttaaagcaccagctctgtgggtatgtattttaagtgtgtgattaggattatcatgtttcagtgtctctcatatcaaaatgactacgtgtgtgtctggttaataagtctatatgtatataactatgagcagggaatggaatcatatcgactcctattgctcatttcagtggagaaaaaaaggataacttcaatcatctcataatattcatgcatatcttagatgttaatttaaatggaatctcattatgtctgcacatctgttacattatggttctagtaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactctcatcatttaatatatttaatatatttaactgcatcaaacatttaacatgtaccaacaagtttgtagagtactaagtagggcttgtaatctaccaaaagatgcatgggctcttgccaatctgatatgatttactcatatattacatattcttcctgatatttttatttcaaggtttaaggttttgattcattctttcaacactactacttttggggaagtattatgcaaagttctactgatacagagtgtaggaaaaaaagatttccgtgtacttaaggaatctttatttttttcaggaagaaaagcattacatgaaaattgtataatcctttttgtataaaagtgatgcattttacagtgaaagagtaaagaatatagagtgtttaactgggtgatctgacataactgtgtgatcagagatgacctctttgcgatagtagtatttaagccaaaatttaatgaatcaatagaaattagttgggggttgatgtaacccaccatcctggtttgcccagggcaggagctttcccaagacacacagccttcagtgctaagaccagagaagtcccaggccaacctgggacaagttggtcattctatttgggattgagaagaccaagcaaggaagaagtattcaaggcaaagggtacatacagtatatgcaaagtccccaaggcaagaagagacttgatatatggattaaaagaagacaaagagaaggttgaagaagggggtggagccagatcacataagtttttttaagccatgacaacaatttggattttatgctaagatcatttgaaaatcattaaagcaggaaatgacaagattgtatctgcagttcaaaataatcatgatgcctatagtaagaatggactggaaggagatcaaagtttattcagggagatcagctaggaggtaattatcagaacctgtgactagtagtgtattgatgtcagtggtgataaagagaaggcaatgaatctgaaagttatttaggaaatgtaatcgtagtaatgaattactggatacatagtgcgagggagaaacaggtataaaggatgattgccatgtttcctgctgttgtcacttagaatgtttttttactagcatgtacatattgaggatttatatcagctagactcaatccagtgtagatgccatttgtattgtaaattatatgcaccttttactttttagtaaaaattgtagtcccagcgtatttacataaaaacacttccctctacagccacaggaaggttatctgatggtgcaacagtttcagtacctaggatgggcttctcatcgagaagtgcctggatccaaaaggtcattcttgaaactgatacttcaggtggaaaagtggcaggaggaatgcgaggaaggggaaggccggacgattatccactgcctgtgagtagggcagctcagcctgtcattcatggggccttggtgcttattttctcattttcaatgttaaagactatctggcttgcatcttatggacctcccatagatgttatttttaaacagtcttcctgtctcatgagtctataattaactactaagtttattttgtatattttctaaatattgattattatatagctatattatttaaactctttggaacactactcgtaacaacttctgatttacacagtttacaaatatatcagaatctcaaagtctagattgcagcaatctatgcctatagcattttcctgagtataagctactgatctaatttcatcctcaagttttctcctctctgccttgtacacatataaagcaaaattaagacacaaatggaaaacaattaaaactacaatgtcttattttcccaaacatatatgatggtgtgacctgtggtcacttggtgctgctatctaaaatgcctttgctttctttgctttcagaaatggtggcgggcgaagtggcatgttctgtgctataggcatcgttgttgaaatggtgaaacggcaaaatgttgtcgatgttttccatgcagtaaagacactgaggaacagcaagccaaacatggtggaagccccggtgagtcacagaatcttagatttggaaggcatcttagagattagttagtcatatacctacttattgatttgacttcatacacacatagggaatcagatgtgaaaatgagacgttgtggggactttcctgcctaattaatacattgctgagcatccccctctacccacagacacttaatcacgtattgcataaactgctaatcatgaaactattttcatttaatttgggaaatttgtaggattttttttctgttatagccaaaaaatatttgctgcagtaaactttggtaaatggtcctataagaagaataaatcctatatcaaggctgtatgtctaagggatataggtttcatcagtaccttagacacccagtatttttaaaaggcaatgaaatttagttttgtcattatctataattattcattcattttctgatcaaattgtaaatggttaaactatcatggttaagttttcagcttttaccaactgtagagggcagttcatatcatgctacttgagcttgtcaaggctcgtaaagtcagaacatagcttacaaaataagagctgataggtatgtgtgtgtgtgacagttcatctaggtgaagctgtatgcagagtaagaaagaaagttacacttatctaacacattttacttctaacgagagatatctgtgggttacacatatgtatgtgcatggtgggatcaggttgggagcagctgtgtagtgtatgctcacagaaaagtaaaccagaaaaaccaaggcatcattgttgcttgccctacatttatcaagatgatcagataactagaatgagcaattcaataaacctttaaagtatttcaccacttcctgctcatggattgctcgcacaagagttgcgttgcttcctgagacaaaatctgaagacttaggtttgtactgtttcacttttacaagcggtaccagacttccaccctttctacaggtgtcctcaaactccctacaccacctcatttccctgggttgttgcagctgtctacacaagattacattggttttgattggggtgctggctatggagatgagaaaggggggatgaatcggagggatttttgagggagaactctcagatcgtcttagcaactaaatgaatagtggttatgtctctaaactttgcgatttgaagatttcttgatgtaaactctgcctccatttttcaggtcaagtcttaaaatcatcagtgggatcatttctgacttcagaattcaacttttaccttcaaatttaactgatttcccaccttttttaattaaaaaaaaaatctatggttaaactgtgccattctgggaccttccaaaaagttactattttcctttacattcatgtcccgtgaatcctgaacaccccaccctctgatttgtgtttaatcagtgttgatgattagtttagtgagctgtggagttgagctgaggagtttggtgaggagatttagagtgaaggcaatattgctggagactgcttaaagagacataactatttctaggcacattttggttccttgaatgcactcgccacagtggtaggtgaatttgaatcataactacttggtgaatagtgttggaatgataaagacctcttaaggaaagttttattaccctagtttattgctggagacacctcgaacttctattccaaaataatatgcattttagactgttctccagcctgaattttacccacttgaatgaactgagttgggaatttttaaatgaattgcatattataagtaatagtttatgatatggtctctgaatttttctaaattcttattatggagcaagtccatagatgggcttagaggaaaggcagttttaactcaaaaattttattgccaatatgttgtcttaaacatataaaggcagcagaaatacattttcaggtataagtaggctcaaaatttaaggatcactaaccattcttgaaaaatttgcttaaatactctgatggacaaaaacagtgtcaaaaattaagaacttgaaattgcataaatggctgtttaaaatggctggctttttttttctcaaggaaatcatctgaaatatatggagaaaaacatttgcagtttatcactgtagcattataaaatagagaaaaaaataaaagcaacttaatagtcaaacaatacatatatttgatttttatgtggtattaaaagatgttaaataacatggaaaaagaattgtaacaatgttaaattttaaaagttacatttaaaattatattttgaaatatacatagttatatttattctaagataattatttcaaccatgcacaaaaagaactgaggcaaactaaggtgatattttaacaatttcttctgatgatagaattatagctctttttctcattctttatatttgttcagaatgtgtatattctttatatttgtacagaattgttctgtaatgatcaaatattactattataaacagataaaaaattatagatatttaaaaaattgatagaaaatatgcggcaaagataaaatgtctttttaagataaatttcctttttcttaaatggatcattagactcaagtataaaatatgtatgcctagatattaatctcatatatagaaaaaataaattgtaatccttgagtaatctaaattggttgtcaagtttcatttggtaactgttattcaacattagtctctttcttaagttttctcactctttgtgttttgacatctttcaggagcaataccgtttctgctatgatgtagctttggagtacctggaatcatcttagttgggtgagactctttaaagtgcatccatgaagaaacctgtccatctattgagccagcagctgttgtacctgttacacttgtgcagaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatgccaccttttttctcatggtttcagtagagcagctaccacatgttgcatgagttcatactttctacgtggcatttttctccctttctaaaatgaaagctgatgaatcttaaaaggaagaagaaaagaaaagctgtgcaaattcatagtaaagttcgttttttatatgtttccagtgtagcagatctctatataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataacagttattgtttgcacatcattttttcctcttaatgtttatgcattcaccactaaatgagtagcttattcctatactcgttgatacaagtaggccacaaaaactctatttaaagagtaaaactgatttccaacctctagtttcttttatttttattttcttaatttaatgccaaaatgtccagtaggtggagatggaaaaggccaggagattgacatcattttttgtttgttggtttctatatttatccatgtatgtaatacacattttccatttgtgtttgtcactatccatttatataatacacatcttacttttttcttataaccaacatgacaaatggtacttatgatccctattttacagatgatgaaatggaagctaatgagaaggtacatgatttgtcaacagattcattcttacttagcagctatgtctttaccactaaacacattgtttcccaaatgtcacaaagatagacaaaaaaatttagaatttcatttctattgttcctcattaatcaattttctcttaaagtattattatcataatggacatcttcaatctcccatttgctatgtactttattagaaaatgcgtgactttttaaaaaattcagataaagcaaacttttctta

SEQ ID NO: 13030 - DNA, 18264 bp, Human
  misc_feature (1)...(18264): n = A,T,C or G
atatatcgtgttttagcacaacacataagctgctaggcatttattcaatctgattgggaatgggttaaatttggttaaaaaattttaccttaggttgctttaattaaaaaaatgtttaaggctgagtgcagtggctcacacctgtaatcctagcactttgggggcactgggtgcagtggctcacacctgtaatcctagcactttggcctagcaccgcttgaggccaggagttcaagaccagcctggccaacatgatgaaaccccatctctactaaaaatacaaaaattagccaggcgtggtggtgggcgcctgcagtcccagctactcaggaggctgaggcagaattggtcaaacatgggaagcggaggttgcagtgagctgagacagcactccagcctgggcaacagagggagaccctgtctcaaaaaatagtaataaataaatttaaaaagttcggccaggcgcggtggctcatgcctgtaatcccagtgctttgggaggacgatcaccactttgggtgggcggatcacctgaggtcgggagtttgagaccagcctgaccaacatggagaaaccccgcctatactaaaaatacaaaattagccgggcgtggtggcgcatgcctataatcccagctactggggaggctgaggcaggagaatcacttgaatccaggaggcggaggttgcagtgagctgagatcgtgccattgcactccagcctgggcaacggagtgagactccgttctcaaaaaaaaaaaaaagtttaaaatatcattggtctttaaagttatacattcattctttgataattgctatgttgaacgcaacctcctaactgctttacaatgattaagcactaatgatttgaacccaggtttaaagtctgactctcaacacatgtgctctgccttctcacgaacatgatttcaaaaatcatagccccgggatttgggattggtggcttatgcctgtaaacccagcgacagagcaagaccctactcttaaaaaaaaaaaattaaagaaaaaaagaaaaataaatcatagtgttgaactggcaggtttcactgagacgaaacttgggactcttccttttttttttgtttcgaataaagccattctagaatgagacaaaattctaaaatattttatagttaacagtttaaattgggtttaatcttgacaagactatctagggctatatacacaaatctcttttggagaaaataccacaactaaactgaagtctattcctgaatatgacagaccaggtcaaatggttatccttgccctcccgggggatgtcactcataaacgtgccaaaagtcacagtctaggccccattaccttacatgctcatgaccttcccagggaggcccctcgcccttaccaggcactttcatcttgggaagacacatcagtcctggcggagaaagcagcaaggcctttccccggctcacaaaaattaatacaaatctcagaggctgcatcccacagccgtgaccaccgtgacttggcatccccttttctgcaaacttaaatgttatctagaaatcgggcctggctctgaaagccaagggcctggcaggagcccgagaaaggggagaaactttctgcggccccaagctaatggcagtcactgcaccgagacccgtcccctggcatccctttgctccagctggccaagacagaccaccaaggtcagccagatttccacccagtctggccgggcccggacccagctgggaatgaaccgagaagcaccgggacccggatcccggcgtgaaaggccgcgcgcggggcacggcgggaaaagacgctgcgcgcagaaacacccgccccgcgccgcgctctagtgggcggccctgccgcgggcggctctgattggactgccgaaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaaggtgagggctgggggaggggaccggcgctgacggagccgcagtgcgggtcgggtctgtggcggacagagagggtagggagcggcgaggtggcgatggcggccgcactttggcctgcgcctctgctgcgtcaggcgggaagctcggctgctgccgccgcctcggacccgggtttctggcgcaccgctgtcggacgacacttctgtcctttcttcgtcctggaaagctgggtcgccgagcatgcgggtctttcggcgccacggccgcaccccaggccgcaggcttagggcagaggaggcccgcccgtgcgcccttggggccgaggccctgacgcttcgagggtcgcggaatgagggaccgagggtggatttggcgggaactcactggaaggagtccgtgtggtggggaaaggctcccggctgcggatgaaggggggatggggtgggtatagtcgtgcaggccatgtgctggggtcgtgcgcctggcgggccatgtgccaagggttttgggggccttagaaaagggttcttaggccgggcgcggtggctcacgcctgtaatcccagcactttgagagtcccaggcgggcggatcacgaggtcaggagttcgagaccagcctgaccaatatggtgaaagttggtctgtactaaaaataaaaaattagccgggcatggtggcgggcgcatgtagtcccagcagctcgggaggctggacaggagaatcgcgtgaaccccggaggccgaggttgtggtgagccgagatcgcgccactacactccagcatgggcaacagagagagactccgtcttaaaaaaacaaacaaacaaacaaacaacaacaaagggttcctgaagaagcctttgtgtttggagtggcgagactgctggaagacttgggagcttttagagtttatactccctatccttgatagttttccgattcttgaatttttatcgtcatttaaatactaagttgcttgtgttacattaccattccaaaaggggctgatggggctcacattccaagagttaacactatttaagttgctgggatcctttaaaagcgccattaccagaaaaaacacgaatttgtcaaacctccaaaaccacagcagcgggcggtagtctgcatcatttcttggattaatgaaacagatgtaattacaaacgagacacgaaattcaactagctcccctccatctagatttttccatatcgtgagaacctgttttagaatggcataatggtccacatttgggtttaggtgttgattttattatgggtaaggcttgtgcttgttcccacatgttaaccatatggcctcagccacagggcacttccaaaggaagtgactgtttctggtcttgggggtcttgtaaaaagagaacattgctcagtaatcgtctgtgattttagctagtgtgtttcaggcattattcagaaggactcaggtgagataagccaaaactgaatttgttttttgtctttctcaaagtgaaggaggtctaatgaatatccccatcttgcttttaaattacatttttaaaagtagatttttccccctttcctattgtttgacccaattttggagtgaaacgtaaccagttactatttccattcgaatttaaattagcaattttatgttatttgtttgttcaagcagtataactggagtgtagagctttgagggtttcaaaaagataagagatatagtccttatctcctgggcttccccctcccccctcctaaatagttttaaatgcttctaatgagttactctggttaaggataatcaaacacctgtaaactgccaggatcctaggtacatgctgtttttagtttgttgagcctgattcttgtctacaagagttctttgtgtattggaatataaaaggaataatttattacattcccaagggcagaattaaagacttaagtttttccgatttcatctcttgataagtttttctttaaaaaaataacagtttgtgtttttctgaggaaccaaaggtcctcttttttttcatattggtaacaggagaggtaatgtatttcagatggtgcagtctgtaaaatattttgaaccaaatcagtggaagaccaggggtttttctttttttttttttttttttttttttttgagacggagtctcactctgtcgcccaagctggagtgcagtggcgcgatctcggctcactgcgacctccgcctcccggattaagcgattctcctgcctcagcctccgaagtagctgggattacaggcgcccgccgccacacccagctagtttttgtattttagtacagacggggtttcaccatgttggccaggctggtctcgaactcctgaccttgtgatccgactccctcggcctctcaaagtgctaggattacaggcaggagccaccgcgcctggccaggtttttcttaaactggcatttgaacatctggaacaggcagggagatgtcttttttaaagtataaatgtgttttgttacatgatttatgacaattctacttgtcttttttttttttttttttttttgagacagagtctttctctgtcggccaggctggaatgcagtggcacagtctcggctcacagcagcctccatctcccgggctcaagcaattctcctgcctcagcctcccaagtagctgggattacaggcgtgtgccaccacgcccggctaatttttgtattttttgtagagacggggtttcaccatgttggccaggctggtcttgatctcctgacctcaggtaattcacccgcctcggcctcccaaagtgctgggattacaggcctgagccaccgtgccttgccaacaattctacttgtcttttaaagttcaataaaaatatgtggcacgtatatgggatagtaccaaactggtgcctaaaagcagtgaaaccaccattggactaattggaatgatttgtctattggctgaagatttgaccacagagagattctgcttttttttccttgcagggatgaaaaattaaaaaaaaaaaaaaagattggttcctttttctcttcctagcctcctgacagtaagtagagagccagaagaatgatgccaaggcatcctggcctgctatgtggagaacgctctttccttactgtctcacttaatagaactcctgttctggcagtgtcagatgctgcagcagcaagggaatgccattgagtgattgcagtaagctatgcagcattttcatgtttaaaactactgagataataaagtgagaacttgaggccaccaaattttaagttgtaattagaaggattttgttaattaggaatatgagagtgctacagtgatcacctggaatggctccataaatacaaatgaggtgttaactagtgaagcaagttgccagtgtttgtgtgtttggtgagactcctaagttctgccatgaagttaaagaaaatattttttaagattcaagaaagctgtgtgaatgaattcaaaattattatgactgtagatcttttaaaaagctatcagtattagttttactttgatttttatctaaagagaaatacagaatgaatacttacagcattacaattcaaatgtgcgtggcttttttttttcttagttactagatatatagtagtaatacctttatgtaatattttgaagtagagattgaattggtataattccctaccttaaaaatattacacaatagcatttttgtcatatattacgatagcatttttgtgtactttaccacttaactttttttttccttttcttttttttttggagacaaagtcttgctctgtcgcccaggcgggagtgcaatggcaggatctcagctcactgcaacctctgcctcctgggtttaagccattctcctgcctcagcctcctgagtagctgggactataggcgtgtgccaccacgcccggctaatttttgtttttttagttttttttggagacggagtctcgctttgtcacccacactggagtgcaaatggcatgatctcggctcactgcagcctccacctcctgggttcaagcgattctcttgcctcatgcaccaccacgcccagttaatttttgtatatttagtagagatggggtgtcactatgttggccaggctgccgacctcaagtgatcttccctcctcagcctcccaaagtgctgggattacaggcatgagccactgcccctggccagtgtcagatgtttagtttgtcattaaaatggagcaagaatacataactcgtgaggttgtaagattatagatatgtttactaatgactgactcatagatatccagctgttaaaactcttcaagaagtaatcagggcaggcggaaatggatgtaattaaccaaggtcaagcagtaagttcaggaaccaggataaaaatacagaattgctcccgagtaagtactctgttttccattattctggctggaatgcaggtaatacagaaagtatattgcttcctttcattgctttttttttcttctttttttcctttgaggtggagtttcgctcttgttgcccaggctggagtgcgatggcatgatctcggctcaccgcaacctctgcctcccgggttcaagcgattctcctgcctcagcctcctgagtatttggaactacaggcacgggccaccacacccggccaattttgtgtttttagtagagacgggatttctccatgttggtcaggctggtcctgagctcccgacctttggtgatccacccacctctgcctcccaaagtgctgggattacaggtgtgagccagcacacccggcccccatagttcgtttttattaaaagaatctgggccatcctggctaacacggtgaaacccccgtctctactaaaaatacaaaaaaaaagtagccaggcgtcgtggtgggcacctgtagtcccagctactcgagaggttgaggcaggagaatggggtgaacctgggaggtgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagcatatatacaaatgtgaatgtgtacagctgtgttagaaaaccatataaaataataaagatagccagaatcataccctactttgctagtgtcatttttatctccaacttgcctgttgctactttattttaaatgtattttctaggacagagttatgaacattctatttattagaaccctagttgttagtcttgaccacatactgttagattttagtagtttactatatttgtttttagtatcaatagtatggtacaagtactgacattaaggaagacaaattagtatactaaccatttgtggtttctttaattccaagataagttcaaaatgtgtaaaatagttacacctcttagtttagcatacatggctcctcacagtaaatcttaagtcttgtcagaccttattttttttttttttttttttttgagacagagtcttgctctgttgcccaggctggagtgcagtggtgcgatcttggctcactgcaacctctgcctcctgggttcaagcaattcttgtgcgtcagcctcctgagtagctgggattacaggcatgcaccaccatgtccagctaatttttgtatttttagtagagacagggtttcaccatgttggctagctggtctcgaactcctgacctcaggtgatgcatctgcctcggcctcccaaaatgctgggattagaggtgtgggccaccccgcccggcccagaccttatcttgactatcttagtcatttcttctcttgcctgacatgccctgtgctcctaccaccctttaaagtggtttgtgtcataaacatttgatacacaaaaatggaaacttaggacaaatatcttgatgtctggtggttgaaaatgtgaactgatttggaaatcaccggtgtttctcctcttaatctcttctccattccattcaggaaatagactgtaaggtgggaaacaagtataagcagttagcctcactctaaacctgctatgtaatagacattggactgagttctgtctactctctgtaagcaatccaaggtaattggcgaaagtggaaggaatatgtactcagaagaccaaaactttggtttttaaattgaatatctattaagcacaaggtaacaattcttaccacacacatcagttttattatttcccttttacaaataagacacagatgggtagtcagatgtctttgaggtaacacagcaagtagttaaactgggttaagtgattaacccaggttgagtatggttccaaaatctcttacagtgtcaggcaggctacatcagtgcagtatacgtacatcaggtttcacgaaaaattttttccagagaaaacacaaacccaaggaaccttcagtaaatggtgccttatattagtggtttttagcaaaaggaagaaacttaagtgttttcctgctgcctgacaaaagtgaaaaacagtattttggtttttattgaagttagcatgtatgtttgtagcttgcataaaatagtactgaaatccaattgattatgaattcttggactaacagaacctggatgacaaattagaggttctggcctggttgctggcttttttagttgtcttgggtgtaaatttctcagccacacgtggggattgtgttagataatctgaaatctaattttcatggttttatgattcagcagctttcttcctttgatattttctagtatttgctttattatagattggaatcctcaaaataacattgacaagtagaagatacttctgttagtggatttaaaaaaaaattacattgggaatgtcctttgagtggttggccctaatccctgtcagaagctgaaagttgtggatcctaaattcatctgggcagaatctcacctatgatttcagaaagctgagagtttcagagagtgactgtagtcagtccttagtgagtacaaaattgagaatacatcattactttaaattaatggtgcagtaactcttgtgactgatagcaataatttaggtgctttgttgttagtacttgattagattggattgggtcagttagtttcaccaaattgctaaagacacctgtccccctagaattaaaatactgagttacataatggctactaaaaggataactatatggggtgttcgatgattcaaaggtgaattacttggtctctaccttcaaggaatatgatacaaggcaatatggtactgccattagacagatattaacaaagtgtcttgggacttaatagggagggtagttccaggctgggagatgtagtcagattcttttatagagttggcatttgagttggcccgtgaaggttggaaaaagttgtgacaggtggaaaaggagcaggggagaccaggacagtgcagtgaaattccagccaggagcagtcataggcaatgagacagactcatggagccatgattctcagctgtcttaccttaccttagttttcctaaggaatatcatggaattctgtaaagacctttaaactaaataatgttcatatgagatgagtgctaggatggggacctgctgcctaatataagtagtgtgagtctaaaacattgtggaaagtggttagtttaataatgttattaaagagacaagtctatcacaagggaccagttaccagtgaaactgtagaccacctgattcactgcgatagggttagccaaagggaggagagggcagattgcatacatagtacctaaggccactcaaagacctcttttaaaatcacgtgtcatgttgatgacatttggaggctattaatgtttttcttcccttttaagacttagtgttttctttattagcattaatttactctagtaaacaaaattatgtgtgactaaaaatggcaaaacaggctgggcgcagtggctcacgcctgtaatcctaacactttgggaggccaaggcgggtggatcactaggtcaggagatcgagaccatcctggccaacatggtgaaaccccgtctctactaaaatacaaaaaattacctgggcgtggtggtgcacgcctgtagtcccagctatgtgggaggctgaggcaggggaatcgcttgaacccaggaggtgaaggttgcagtgagccaagatggcgccaccgcactccagcctggtgacagnnnnnnnnnnnnnnnnnnnnnnnnnnnnnnnnnnnnttttttttctttctttctttctttgaagacggagtcttgctctgtcacccaggttggagtgtggtggcccagtctcagctcactgcaacctccacctcccgggttcaagcgattctcctgcctcagcctcttgagtagctaggactacaggcgcgttaccaccacgcctgggtaatttttttattttagtagatttggggtttcaccatgttggccaggatggtcttgatttcctgacctcatgatccgcctgcctcccaaagtgctgagattacaggcgtgagccaccacgcctgccctaattttgtgtttttagtagagatggagtttcactgtgttggtcaggctgatgtccaactcctgacctcaggtgatcctcctgccttggcgtcccaaagtgctgggattacaggtgtgagccactgtgcccatccttgttttgtattttctaaaagagatgtatcttgtttaaatattaaattataagatattcaggccttgcaaattgtctggattacactgtaaaagtaatcatttatgtgcaaataattccttgagatcaatagttaaatgagctcaagctgatctgactaaactggagaagatacaaaatgaagatggggaggaagtggtgccataagcagccttttttctttgaccattttatatgccttttttttttttttttgagatggagtttcactcttgtaacccacgttggagtgcaattgcttggcttgcaacaacctccacctcccgggttcaagagattatcctgcctccgcctcctgagtagctgggattataggcatgagccaccaagcctggctaattttgcatttttagtagagacggggtttctccttcttggtgaggctggtctcgaactcccaacctcaggtgaaccatcctcgtcggcctcccaaagtgctgggattacaggtgtgagccaccgtgccctgcccgccattcggtttttttttttttttttttttttttaattctgactcttctgtggtggaaaccagcaaatacttcacataatttaggatgctaatactagtacagttaaaagaatgattacaaagcagatactatttcaaattctgtaaaaatctgtttttaatatccttcactggctgtttgttctgactagaaatgttttgtatatctgaaagcaccagtaactcatagccatataatttttttggtaatatgttcataggcaagtggcaagagttagtagaaagatttctctaagaatttatcctaaatcagattacacagagttggggtaagtgagtattgtgttattttcttttgtatatttgacaatgggaactttttgaaactcaacttcagtgtaattttaagtcactaaatttgtccacaagttaatgattaaacagttactgaaagtggagaaccttgccatttttcggactgcgttttgggtctttggcactgtggttaggttagctaattcgattatccactcaagttttactcagttggaaatatgtttttctagatgatggtgcctgtgcttaggtttgagaggatatttaaaatacgactttgtgtgccattgtttgacagtggaattaagggtaaaaatatttagatatggaagtgtgaaaatgtagttgcattgttttcattatgttctattccatttcattctattttaagaatagcctcaatttatttttagattgttacataagtacaaaatccatttgctttagtgggagttttatttttattttaaaatgataaccaattaaaggagtttattatgaaattctaagtagcattgtttaaaatgtaaaattacattacagaaacatttggaaaggggagaataaaagaaaacaaaacacaaatgttgccagtgctgtaggtgctattattagcgctttggtgtaactcatggtcgttttcctactatttttattatacagtcatctcttggtatctgtgaagtggttccacaaactccctcaaataccaaaatcctcctatgctcaagttcccaatataaaatagtgtagtacttgcattacaacctttgcacatcttcccatatactttaaaatcatctttagattacttataatacctaacacaatgtaaatgctgaataagtagttgttaacattgtattgtttagggaataatggcaagaaaagtctgcatgttcaatacagatgcaacttttccactgaatatttttattccaaggttggttgaagccatggatgcagaacccatggatatagagggcctactgtacttgtaccatctagagataagatttgtatcttgcatttgttttaacatatctgttctaaggaatatctcagtcaccaggcaagtgctgcagtataactaggtactacgtcaggtgctaaggttaagagagtattttccttcactgactcctcactccgagaatccattttacagcttcattggtttgggttattccaattttttgatgtgagtaaataaatgacttctatttgcccaaaataaagcttatataggccttataaccatgcaaatgtgtccattaagttggacttggaatgagtgaatgagtattactgccagtgtgtgtgtgtgtgtgtgtgtgtgtgtgtgtgtgtgtgtgtgtctgtctgtctgtctgtctgtctgtctgtctgtctgcctgcctgcctgcctgcctggctgcctgtctgcctgcctgcctgcctgcctgcctgcctgtctgtctcactttgtcccctaggctggagtgcagtggtatgatctcggctcactgcaacctccaccccccgggttcaagcgattcttctgcctcagcctcctgagtagctgggattacaggcgcatgccgccatgcccggctgttttttgtatttttagtagagacggggtttcgccatgttggccagactggtctcaaactcctgacctcagatggtccacccgcttcagcctcccaaagtgctaggattacaggcatgagccaccgtgcccagccactaccaattatttctcttaatggattttcattgaccctaaccctgtaaattccatcacttttatcaaggtgtatattataataagtctataatacccaatcatgtagttgtgtgattattttatttttttgagacagagtctcaatgttgcccaggctggagtacagtggcaccatctcagctcactgtaagctccgcctcctgggttcacaccattctcctgcctcagcctcccaagtagctgggattacaggcgcctgccacttcaccgggctaattttttgtatttttcgtagagacggggtttcaccatgttagccaagatggtctcgatctcatgatccacccacctcggcctcccaaagtgatgggattactggcgtgagccaccatgcccagctatttttttaaccaatatattagctagcttttttccccagaataattttccaaaaatacatttaatagagaataaaagttaaaagaactttcagtggtttaatgctgttacttttaatatttcaaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtattttgtcgaatagaaaaatttgaagtacttcagtatttgttagtatcaagactggtctgactagccgaattctttgtttttgctcaaaacaggtttccagtttgtttcctcgtctcttccagatatttgttatcgctgtggtgagtctggtcatcttgccaaggattgtgatcttcaggaggatggtaagtatttaacacttccttttcatacccctctagagcttggagaggtgagcacatgcaactgtgtatagcatttccacctttgaggttttgtattgtataatttaaaacgtaacactttgtaaaggttttatagtcttggcctgtttcttttccttattgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtaaggtgtcagaatgttgttagaagaaaactcattgcagagattcttccagagatgaattagctataaatggaagggccttagtaaattcagtgaaacttagctgtgaccagataagaccaattttcagcatatgtaactggcagtctatctgtatataattctgtattctgccctgatatcctgtggcttatggtacctgggcagttttcacaactggacttttttaatatataaaagtaagagtgttataatttgaaacttccagagacttcatagaaagctctgtaatatacataaatcttttatcatgtaaccagaaatctttgcctgtttgtgacatgtaagtgtataatttgataaatgttgttgtgtacatatctgtgaaaccttaggggttaattgcatgaaaacaaagatcaggcgttttgttctgcatggtgactgttgctttggtagacagtttttttctgaggcccattgtgaaaacttttaatttcttttttaggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgcgccattctcctgcctcagcctcctgagtagctggggctacaggtacccgccaccgcgcccagctaatttttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacaggtgcgagccaccgtgtccggccgattctgaacagttttaataccattgctatttttgtgtttttcctgggcctttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtatctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccatatgtatgaaacagcataaggaaagactttttttcgaaggcatcactgttaggttgggggaaagatttatttttgaaggcatcactgttaaatgaggtttgggggctggtgtgcacatggagttatttccccccaaattctgggcctcatgtaggaaaacctaaaacatagcaaatgggatatgttgttatggctcttcaggtcagcttagttctcattaataatactt

SEQ ID NO: 13031 - DNA, 36457 bp, Human
tagagaagctggtgtttaccggaaactcaggagaaccagccaaccacaacccctgggttaccttggcaattgcagaataaatgcattatagttactaaagtaaaaaattagatatgcctgtttgcagattgaactataaaaataccattcaaagacaaatagatctaaaaataaaatggaaaaacataaacactaattctgtaaatattatacttaatgcacaactgaaacaaaatttgccagcttactcaatatcaaaatctatgaacagtttttctattttatataatttccctctcctctctctggatctcgctccccagctcattttttcttttttttgctctgattctttatacacctctgctgcctctgtgataagcagcttcaaagatggttcctaatgctttattggatagaatacaacaaaagcgatgaggtgttgcttccccaattacattacgaagcatccgtggcttccatctccagtgggttcacttgctgtctggctctaagggaatccagataccataatgcgggctgccctatggtgaggtttgcatcactaggaactcatgtctctgggcaacaaccaatgaggtcttgatccctgccgtcagccacatgagggagcttggagctcggaagtgaatcctcctggagtcaagccttgatatagctagccctggcagctgcttgactgcagccttgtgaaagagaccttgggccagaggcaccagctaaactgcccctggattcctgacccagagaaagtgggagatgatgtatttttgctttttgaagctgctgaatttggggataatttgttatatagcaatagaaaatgagtaactcttttgtattcctctttgtcctggcttccccattttgaggaaaataaagtaaatcaaagtgtagagctgaaatattcacatgaaaataataataaagttttaaaattatttgaatgtcttgtgttgacattccaaaatatatgaattccaaaaatttatatgttgaagtcctaactgtcagtatcttagaatgtaacttttttggaaaaggggtcatttcagatctaattagttaagatgaagttatactggagtacagtgggcactaaatcgaattggtcctatgattgagtctcagtctttcagtgagcctgtacccctgggtttatgaccttcagttggcttttttcttctgcccttatttggcataaaaacaaagcaggtggatcacctgaggtcagcaatttgagaccagcctgcccaacacggcgaaaccctatctctactaaaaatacaaaaaattagcctggcgtggtggcaggcgcctgtaatcccagctacttgggaggctgaggcaggagaatcacatgaacccgagaggcggaggttgcagtgagccgagatttcgccactgcactctagcctgggtgacaagagtgaaactccatctcaaacaacaacaacaataaacaaacaacaacgatgacaaaaaaagctagagctgggattttccctttccctgtgttaaagattagagtggtgtcctcacaaaaagggaaaacttggatacaggcacacacatggggagaatagcatatgaagagacacagggagaaggcagccatctatgggtcaaggagagaggcctggaacacatctttccttcaccgccctcaggaggaaccaactctgctgacaccttcatctgggactcccaccctccagaactgcaaagcaataaattttttattttttacaccacccagtttattgtattttgttaggcagccctagcgaactaatgtacatagagttcttgagttaatcttcacaaattactgcaataaggtagggtcttttgttatgtaacaatgctatgaaatcatagcgttttcttaattaacttccgtagtttaaggtactaagttctggacaccacgtgtcttctttctataaataccaggacatgctctgtttttcagcactcattggacttcagcatgactactcagttgccagcttacgtggcaattttgcttttctatgtctcaagagccagctgccaggacactttcactgcagctgtttatgagcatgcagcgatattgcccaatgccaccctaacaccagtgtctcgtgaggaggctttggcattaatgaatcggaatctggacattttggaaggagcgatcacatcagcagcagatcaggtaccatctctaccatctctccagtgtactggattctatgagaaaggagggggtcctaggagacagggccactgtcagggtcagttacacttttagatgatatatgtatcagagtagccaagaacctttattttacagttagaattctactttcctctcaaaattagagcaaggacttccctaaaagtaagaacaaagttaagaaaagaacaatttgctcattatcaagaagcagcagacctttgaggaactggccataaattcaacatctttgttccccttttctggtacagatggaggatggaggataaatgggtcagggactaggtgctattttcagagtattagtggccttcatgtactcatgtgctattaaggctttgcaggttttcgaataaatttataatctgaaaacaaatttaagttttcaattccttgccagcatgcattatatacttcacacttcattctaattacaagataaaagtatatgtaatgcattgtgagtccttaagtttagtgaaggtttcagtttgaagttaatcatacagtataaattgtggtttacacaaatattattttaaaagctattgatcgattaggtgtagaccaggaatacatgaagtgtgataaaagtcatggataaatgtgtattacatatatctataaatatatattcttttgtgttgttgagttaaggtctcactctgtcacccaggatggagtatagtggtgtgatcacgtctcactgcagccttgacttcccgggctcaggtgattctcccactacagtctccagagtagctgggaccacagatgcatgccaccgtgcccagctaagttttgtattttttgtagagatgggattttgccatgttgcccacgctgtacttgaactcctgacctcaggtgatccacctgccttgggctcccaaagtgctgggattacaggcatgagctaccgtgactgccctatattcttatatatactaatatttaaaaggttatcaggagttctgatgttctttttcatccttagtccaactatttccttgaaggtcacagagctttttaaggtgactctctaattggaaggtgcccaggttagctcaggcagtacttgtaggcatgggacagttcaagtaaccagtttgtggctcctctttttctgagaagcaggaatcatgtttgcaggggaaagctagggcagaggaggaaataaacagaatatttaagttattaatcagtcttgacacaggcacagtcatcagcgaaagttcaaggagaggcttggttccaggataagctaggtttatagttaacgactgccataggaaacaacaatggcaggattagaaaattaaaatgcttgactaagccaggtgcggtggctcatgtctgtaattccaacactttgggaggctgaagcaggcggatcacctgaggttgggagttcaagaccatcctgaccaatatggagaaaccccatctctactaaaaatacaaaaattagccaggcgtggtggcagatgcctgtgatcctagctacttatgaggctgaggcgggagaatcgcttgaacccgggaggtggagattgtggtaagccgagatctagccattgcactccagcctgggcagcagagcgaaactccatctgaaaaaaaaaaaaaagagagaaaaaaaaatgcttgactagaagcccaaacctcaccattatgtaacatatccatgcaacaaacctgcatttgtaccctttgaatctaaaattagaaataaagaaaagaaaagaaaaagaaaaagaagtgacagtgcactgaaaaaaaaggaaattaaaatgctttggaaaagaaaataaattataaaaatatagaaaacaaaataagatttaaggggtgtgggggaagcccaaatagttgttactcagccactcagctcctcagctcctcttgcaggcccccctttggattaagttgcatttttaacagggtgcgcatattattgtgactccagaagatgctatttatggctggaacttcaacagggactctctctacccatatttggaggacatcccagaccctgaagtaaactggatcccctgtaataatcgtaacaggtaaagaaacaacttgtgaaaaattcactagtaaacatcaacttgatttacctgggaaaactttgttgatgatcattgcatagatccatgatcaattcttaagtttcagtatagcttatttttcatctactatgggtatatttactgggagagcaaatatgaattatgaagtcacagaagtcagagctagaaagtagcttagaaatcatcacattcagtgtgaacatctctggtctctgactcctcaccagtgaacagaaaaatatttccctgtgtaggtctgtgatttgaaaactatatgagtaaatggcaaaagagagtcacatcagtttaagattaatagttttcctttctcattgctaagatagctgatgaggttaatgtagtaaagtccttaaagtgtaagctgattgtaatctaagaggtgatatggcaggattttaagtggtttaagtcaggtctcggctacagagatattaagtgtggtgaaagcagcactattaattttaatgtaaggaaaccaatatcttatacacctaagaaaatcatgtcgattcacatacttctttctgaatacacatggctaaaattattttaggaattcctcttttggaactattctcaaaaccgcacaacgccagttagaatggtgatcattaaaaagtcaggaaacaacagatgctggagaggatgtggagaaaggggaactcttttacactgttggtgggagtataaattagttcaaccattgtggaagacagtgtggtgattcctcaaggatctagaaccagaaataccatttgacccaccaatcccattactgggtatataccaaaggatcataaatcattttactataaagacacatgcatgcatatgtttattgcagcactgttcacaatagcaaagacttggaaccaacccaaatacccatcaatggtagactggataaagaaaatgtggcacatatataccacagaacactacacagctgtaaaaaaggataagttcatgtcctttgcagggacatggataaagctggaaaccatcattctcagcaaactaacacaggaacagaaaacaaaacactgcatgttctcgctcataagtgggagttgaacaacgagaatacatggacacaaggaggggaacatcacacaccggggcctgtcggggagtcgggggctaagggagggatggcattaggagaaatacctaatgtagatgatgggttggtgggtgcagcaaaccaccatggcacgtgtatacctatgtaacaagcctgcatgttctgcacatgtatctcagaacttaaagtataataataataatactaaaattaaaaatcccacagaaactggctgggtgtggtgactcatgcctgtaattccaacactttgggaggccgaggcaggaggatcacctgaggtcaggagtttgagaccagcctggccaatttggcaaaaccccatctctactaaaaatacaaaaattagtggggcgtggtggtgggcacctataatcccagctacttggaaggctgaggcagggagaactgcttgaacctgggaggcagaggttgcagtgagccaagagagtgacactgcactccagcctgggtaacagagctagactctgtctcaaaaacaaacaaacaaacaaacccacaaaaactacttacagagacaccttgattttgacaaggtggattttgataaattccagtgttatttatcataatcatttactctattcttatttaattgtaccataattatttcttatttaatcatgtcatatgtcagtgcttcagtttctaaaaggcaagcactctattatcacttccactatgaattgaattgacttatttctgaatggcctttccctagaacctcatctccaagggcctcctgaacatccccacaaggatgtcccattcacttcatttcaaggaacacggttgcccatttatgttttccatcaactaatgatgtctgaatgtcttgccttaattctctctgtctctctctctcttttttttttttttgagagagagactctgtgtcgcccaagctggagtgcagtggcgtgatctcagctcactgcaacctctatcccccaggtccaagcaattctcatgcctcagcctcccgaagatgacaagtgtgagccacaacacccagctagttttttgtattttcagtagagatgggtttcaccatgttggccaggctggtcttgaactcctggcctcaagtgatccacctgctcggcctcccaaagtgctgggattacaggtatgagtcatcatgcccagctgccttaatttattaactctgcaaattttttttgagtacctattatgtctaaacattgttctgggcaatgaagtgaacaaaacagattaaaaattcctgtccccttgaaatttatattctagtgtggggaggtaataaatgttttaaaaagataattatctatctatcatctatctatcatctatctattatctatctacctatctttatataggtatctttcatctgtctacctatctatgatatgaggtggaagtaaatgttatggaaaaaataaagtggggaaggtgaatagggtggcaagcgtggggctgaaattttaaaaggtcgtctgagggcatcacagtgagatttcagcaaagacctgaaagaaatgaggcaatagatcatgtgagtatctgaaaaaagtgcattccaggctgaaggaattctaaattccaagatcctgtggtcagagtatgtgtctaacctatggaacagaaaaagggttagtgtggttacagtgatgtgacagaagaggagaaaagtaggaaatggaggcagaagggcaggaggagcgcaatgttgagaatagactccagggtataggtcaccaaagaagcagagggcagttcaaaagctgttgtgatcattatggcatagagatgatgggtctgagaccaagaaatggtagaagtttaggtattgagaagtggacagattccgaataaagtttgaaagtagcactggcaggttttgttgaaagactggatgtaggatgtgagagaaaaggaggactcaatatccttccctgctctcatagaatcagatctcatcttattgagtatgtttgaagtatgcacatagttgattgctttctcttctcatattcaccaaacttttgggacctacatcacctcttagactgagcgttaaaggaacaggctctcatcacttttcttttttatttaatttatttagcatttatatgtcatatcgttccagaaggatttgaagtttctaattatatctaatataattaaaaataggatactttagttctaacaacaaactagaacccatatgaatagaggaagcagttgttatgaggcatcatggtaaagagctgctcattacaactggatgttaagtatagttctaagagtttctgagcagctaagagaagtacaattttgttcagacactttgattgcatcatagaagaaagcttgcatatttcttcagagacaaactatgtctaataacctaacttaaagatgaatttacttattcaactgtttttgttaattattttatttttaactttcatgggtacatagtagatgtatatatttatagggtacatgagatgttttgatgtttgtacacaagcatgcaatggtaacaatcacatcatgaagaatggggtttccatcccctcaagcatttatcctttgtattacaaaccattcaattatgctcttttaggtatttaaaaatgtacaattaagttattattgattatagtcaccctgttgtgctattgaatactagaccttattcattcattctaactatttttttgtacccattaatctcctcactttctccccactcctcccctaactacccttcccagcctctggtaaccatctttctattctctatctctatctccatgagttcaattgttttgattttcagatcccacaaataagtgagaacatgtgatgtttgcctttctgtgcctaacttacgttatttcacataacctaatgatctccagttccattcatattgttgcaaatgactggatctcattctttttgtagctgaatagtactttattgtgtacatgtaccacacggttgtttccaaattttggctattgtgaacagagttgcaataaacatgaaagtgcagatatcttttctatatactgattttctttttgaggagtatatacccagcagtgggattgctggatcgtatggtggctctatttttagttttttgagaaaccttcaaactgttctctacagtgactgtactaatttgcattcccactaacagtgtatgagggttcccttttctccacatcctcaccagcatttgttataagtcattttaacaggtgtgagatgatataattgtacttttgatttgcttttttttttttttgagacagagcctccctcttgttgcccaggctgaagtgcaatggtgccatcttggctcactgcaacctctgcctcctgggttcaagcaattctcctgcctcagcctcacgagtagctgggattacaggtgcctgccactacacccagctatttttgtatttttggtagagacggggttccaccatgttgtccaggctgatctcaaactcctgacctcaggtgatcctcttgcctcagcctccagaaatgctgggattacaggtgtgaatcaccatgcccggttgatttgcagttttctgatgatcagtgatgttgagcaacttttcacatgcctgtttgccatttgtataacttcttttgagaaatgtctgttcaaatcttttgcccatttttggattggattattagattttttttcctatagagttgtttggacttcttacatattccggttatgaatcccttataagatggatagtttgcacatattttatcccaatctgtgggttgtctcttcactttcttgatagtttcccctgctgtgcagaagctttttaccttcatgtgattccatttgtccatttttgctttggttgcctgtgcctgtggggtattactcaagaaatctttgtccagaccaatgtcctggagagtttccccaaagttttcttttagtagtttcatagtttgaggtcaaatatttaagtatataattcatttttatttgatttttgtatatggtgagagataggggtctactttcattcttccgcatatgggtatctggttttcccagcaccatttattgaaaaaactgtcctttccccaatatatgctcttggcatctttgttgaagacgagttcactgtagatatttgggtttatttctgggttctctcttctgtttcattggtctatgtgtctgtttttatgccagtaccatgcagttttggttactagagctctgtagtataatttaaagtcaggtaatgtgatttctccagttttttttctttttgcttaggagggcttctggatcttctgtgtttccacgtaaatttcagaatttttttttctatgtctgtgaagaatgacattggtattttgatggagattgcattgaatctgtagaatgctttggatagtatgggcattttaacaatattgattcttccaatctatgaacatggaatatctttccatgttttgtgtcctcttcaatttcttacatcaatgttttacagacttcattgtagagagctttctcttctttggataaattaattcctaggtattgtattttatttatagctataacaaatgctattcctttcttgatttctttttcagattgcttgctgttggcacagaaatgctactgattttttatgttgattttgtatcctgcaactttactgaatttgtttgtcagttctattagttttttggtggagtctttagggttttccaagtataagataataacatctgcaaacaaaaataattttcctcctttccaatttggatgcattttatttctttctcttgtctgattactttagtgagaacctccactactatgttgaataatagtggtgaaaatggacattcttgtcttttctagatcttagagaaaagctttcagttttccctcattcagtatgataccagccatgggtctgtcataaatggctattattgtgttgaggtatgttccttctatatccagtcattgagggtttttattatgaaggaatgttgaattttaccaaatattttttcagtgtcaattgaaatgaccatttggtttttgttcttcattctgttgatatgatgtgccacatcaattgatttgtgcatgttgaaccatccttgcacccttgggataaatccgacttggtcatgatgaataattttttaatgtgtcgttgcatttggtttgctagtattttgttgaggtttttttgcatcaatgttcatcagggatgttgggctgtagttttcttttttatgtgtctttgcctggttttggtatagtataatactagcctcattgaatgagtttggaagcattcctttctctattttttggaatagtttgaataggatttgtattagttctttaattgtttggtaaaattcagcactgaagcctttaagtcctgggcttttttttgctgggagatcttttattacagcttcaatcttattatttgttatctgtctattcaggttttggatttctttgtggttcaatcttggtaggctgtatgtgtctaggaatttattcatgtcttttaggttttccaatttatcggcatgtagttgctcatagtaatctctaatgatcttttgaatttctgcagtattggttataatgtctcatttttcatctctgagtttatttttcttctatctttttttcttagtctcactaaaagtcaattttatcttttcaaaaagaaactttttagttttttttggatgttttttatttcaatttcatttatttctgttcagatgtttattatttttcttctactaatttcaggtttggtttgctcttccttttctagtttaaaaaaatatatcattaggctgtttacttgaaggttttcttctttgttagtgtaggcacttatagctataaactttcctcttagaacgattttgctgtatcccataagttttgatatgttgcatatccattttcatttgtttcaataaaaattttaaatttcttcttaatttcttcattaacctgctggtaattcaggagcacattgtttaaattctgtatgtttgtatagttttcaaaattccctttgctattgatttctagtactattccactgtggtcagagaagatacttgatatgatctcaattttttttaatgttttaagatttgttttgtgacctaacatatggtctctccttgagaatgatccatgtgctggggagaagaatgtttattctgtagccattggatgaaattttctgtaactatctattaagcccacttggtctgtaatgcagattaagtccaatgtttctttattttttttttccttctggatgatctgtccaatgctgaaagtaggatgttgaaatctccagctattattgcattgggatctatctctctctttagctctagtaatatgtcctttatatatctgtgtgctcaagtgttagcacacttgtgtgctcaattgttatatcctctgacagaattgacctctttatcattatataattaatttctttgtctccttttatggtttttgtcctgaaatctattctgtctgataaaaatatagctacccctgctccttttgttttccatttgcatggaaatctttgctatccctttattttctgtctgtgtgtgtctttataagtgaagtgtgtttcttgtacacaatcgaccattgccattgattttttttcttttttatccatttagccactctatgtcttttgattggagagtttagaccatttacattcaatgttttattgttaagtaaggacatactcctgccattttgtttttttgttttctggttgttttgtggtgttgtcttcctttcttcctgtcttcctttttgtgaaggtgtttttctctgatggtatgttttaatttttgcttttcattttttgtgtatctgttgtaggttttttgatttgatgttatgcagcttgtaaataacaacttatagttcattattttaaagtgatgacaacttaacattgattgtataaactaacaagcaaagagaaagctaataaaagcttcatactttaacttcatcccccatacttttaatttttaatactttctatttatatcttatactgtctatgtcttaaaaagcttttataattattatttttgattggttcatcttttagtttttctactcaagatatgagaagtttacaccacaattacagagttataacactccatgtttgtctgtgtacttactagtgagttttgtaccttaagatgctttcttattggttattgatgtctttttctttcagattgaagaaatttctttagcatttcttataagagaaggcagtgggttcttttctggctcagggtgggtctagaaatgccatccaggagctaagtcctggaattgaggactttaggagtctgcttggtgcttcatgttactgtggctaagttggtacccaatttgtaagacaaagtccttttactcttccctctcctttcctccccatgcctccccatggctacaacagctgggaatgtgctgggtcacacctgaaaccagcatggtactgggtcccacccaagcctcgtggtgagtactgcctggctatcactgatgtttattcaaagcccaagggctctttagttagcaggtgatgattcttgccaggactgggtccttccatttaaggcaagaagttcccttatagcctagtgtatgtctagaaatatcatcagggagctagggcctgggttgggggattcagtactctacttggtgctttattttactgtggttgagctgttatccaagttgcaagacaaagtcctctttatgctcctgtctcctttcttaaggcagagggacggagtctctcaaagctgtgagctgtgctgcctggagttggaggagggttgatgcaaccactcctttgactactccagctggtgtctcactaggttatgtgcgctccaaggctactggttctgagctcagtacagcactaggacttgcctaggaattgtagtccttgtggcctaaatcagctgtccccaacgtttttggcaccagggactggttttgtggaagacaattttttaatggacagggtggagtatgctttctggataaaactgttccaccttagatcatcaggcattagttaaattctcataaggaacatgcaacctagattcctcagatgcacagttcacaacaggcttccattcctatgagaatctaatgctgcaactgatctgacaggaggcagagctcaggcagtaatgtcactcatctcctactgtgcagccagtttctaacaggccatggactggtactgccgtgcagcccaattcctaacaggccacagtccatggcatagggattgggaacccctggcctagactgcctttcaagtttatttagaaccccagagaactttatcccacattggtgatccttggtagaactcaggttctgactgctgggtaggacaattcctctctgacaagagctgttctaaatgtgccctctgtgggcactggctgaattctgtgccatgttgctttctgctgttacatggcaacactgacttccaatgtaaagtcccacaatcactgtactttccttcccccaagggcacaaattttctctccacaccatgtggtaacctggaggatgggggagagtggtattggcaattaaagactttctttcttacctccttcagtgcctctttccttgatatgattttaaaacaaggtactgtgattactcttctgatttttggttcttatgaaggttcattcttgttgtggatggttgttcagtttggtgatcctgcaggaagacaattgctggaaggttctatttggccatcttcctctgcttcctcctcatcttttatttcttcctcttgcctgattgctctggctaggacttccagtatgatgttgaatagaagtggtgaaggtgggcttccttgtcttgttacagttcttagaacaaaggctttcagcttttccccattccataggatgttagctgtaggtgctgacatatacgccatctatagcctttattatgttgaggtatattccttctgtataataaagtgcacatgtctgaattatatattacttgccttgtgggtgccaagaaactatttatactgcctagaatattaacctttattatgcctaaagagttcattagtcaaatgttggttttgatgtagacctcatagtttaaaatttaacatttaaattaaatgggttataatttttaataccacctaaatacaatatattgatccaatatagaaagttagatcaatgttagaaataaagagtcacagtgtacctttccagacttgtcgttagcatttcatatttatagttttagctttgatttgaatgtttcacagatgaacttaaatcaacacataattccaccatagcataatagtaattaggcagtttccctaaatttgagaacattgccttaatgtagttgtgatgttttgaggcttcatagcttaaatccattataccattatggaatctatagagcagggctatggagaaaggcttcagagaagttttttttgctactataaccttatttaaagaaacaaacagaaaaaaacccaaacgtatttgaagtctgcttaaatattactgttaaatgtgaagtgtttatatctaacattcataatcatatgaatgtcaacatttagtttcgagtagaaaaagataaatcattactgtgagttaagaaatttaaatggagatgtgtgagggagcatgtccatttcatccttcccatctccaccctccccagagtttcatccccagggtgcccttcttggtttccagcctctggtgttctgcttggggtcttgacttcttcccatgccactcaggctcagccccagactagaacagggtttgggaagcagtggggatagccaagatgggtgtcagtgggtggcccagcagtttctgtcccaggagtggccacaggccaggggtagtggtggctgtgcatgtggccagcctgctgccattgtcccatccttgtcagggccctctctttcaccttacagcatctgaggggcagagctctagagggtttgggcagacaatgcctctgaaaatttttttttaaataaaatttagatgacaagtatatatcatatatgcagtgaccaagcatataactactttacagtcatctaactgctgtagcaatgatatgtaactacagtgtcaaaacaccctgacagttttcagaaacccaatgtggagaccatctgccatatcttactttttctttaggtacaatattcaaattcatattgattttgcttacatatgaatagtttcaaatttgttcacatatggtttaaactttttgtccctattgtcttactcaggcttgtgtaacttaaaatgagcctgagcatgggtctacacacagcaagatgtgtaataaaaacacaattttagtgctactttcaaaattcatgctattaagaaagatgctgttttcaaagctgaaaagatcatgaaatggctaacttacatatcagaggttggataattccttactattgaggtgttatattttctgtgtagtaaatgccttcaaatattaactgaaagatcagtgaagtcattttcccctttgtgattccaacttcattttgtttattttgaagataattaatattttaattgcaaaagaaaattatagcattggaaaattttctgtatatggagaataacaatgaaccaaatttaccaattagggaaccatttcaggaattgttggatggtgaatttttcttcagtaactatgctttagttgcaatgcagtatgcccagaaacaatccatttcaacttctgaatgtttgatttggaacatttgtttgatgagtattcagttaaacacttggatacaaactctttccagaaggtcacatctctaccatttatcttggaatgtttctgaagacattctactcattttattaactgtatacacttctgtttttggatctccaatatgattatagacaatatcaacatagaaggctttgatttagactccaaagtttagagcatttgatcttgacatgccttaaattgggcttccagtcaaaattgaggccacttctcctttcaaatggcaagttcccttgaatgagtgaatagtggagttgtagaaattgaaaggcagtagtagctttcactttacattacaacttctccaatgcaatcttttccattctcatcaagtctgaaaccgtgaacctatattcacctatttggaacacatcagttgccaatgggacatccctttcctcttctattgattttacagccgaatagaagaagctcagttcaacacatccaaggtgcttgggctgcaccttcatttaacacaggaatctgtccagtaaattcacagagaaaatgcctttgtgttaaagccaaagaactgaattagactaacatcttgtacttcaaagtcctgtagccttgcagtcattctgaggctattgtctatcatgtgcaaactcaattagtctcaaaccacagatctttaactgacatctagacttcagttccaacaaggcattcagctggtgtagcagtttctgacagtcaggtttcagtacctctatcatcttgatagtgattgagcctcagtggtaaccacccttcttgggcctgcactcacctcaccccacgaaatccaatctcagaggcctaggaaacaaagcaaacagagaggcccagggaggggaagccttcctgggtggatgtctctgcagagccaccaagatcatattgccctcatcagggtcagcttggagctgaagggctgaaaaggcattttgatatttgattgcatattatttcatactgttatttcagagttttgtgtgcacacattgtttcttcagtaagcctaatgctttataagcatagcaaccacatctgacatttctatgtctctcacattgtatgcttggacagctctgcctggaatattcttcccccagttgcccacatgtccaatatagtgctttgtgttgtgtcaaaacctaatgcatatttgttgaatatttaacatgtgctgattttagattagtaaatatctttccgataattgatgatttttgttatacctaaagattgaacactttgaaagcagccttagaaaatgcatttcaattattctctttcacctcctccttctgtgcccagggcaaaactctgcatggattaaggactcagcaaatatcatggatgaagcaacaggcagatttcaggcaccataagcaaactgaatttttaaaccctaaattaggacatgtggtctaattttggagcattttatgtatacgccaaacagcctgagaaatgtagcttgaattgaaatatattagaatacatgaagactaatagagtcagtaggaaaatatgtttgtcatcagaactgtttcagaaatccaaaacaccaacctacttattccaccacttaaggtgatccaaaaagactgggggtaaacatgtttcaagtggttcaatgtgttgtaatttatatctatgcatttcagatatcaattgaagcaaaggtgggttaaactattgaacggttgttctttcttacaaacacattgaaataataattttctatatgtattattatatccttttccaatctttttcaaggatatgttttatagatgattgctatggctttccttatattcattatacaaatttgtttgtagatctagtagccaatatttgatgtcaccaaatttttattcatacaacagttatctcagccttctcagctattcttcaataaccatttatcatttcagagttgtgcaatagaggataaatatagcaatatgttaaatattattttcaaaattgtattttaattgctttactgggacaattattggtaactttgtaaaagaataaaaaaatcaggcattaacaaatgctccaggatttccatagtttcatactagctggtactgccctagccaatccttgttacctcttatttgaacaatggcaacagcttcctaatgaatcccctgcatttagtctctcactgttccagtacattctgcactccgtgttctatttatctttatgaagaaaattttgaccaggttgcttctgtcttcaaaggctttaatagtacctatttattactaaatttggaacaaatcttagcctcttgtgcaaagctcaatatccatccttccttccttccttcctccctgcctcccttctttctttcttttttttaaattttttaaattttttatttttttgagacagagtctcactctgtcacccaggctggagtgcaggggcgcaatctcagctcactgcaagctccacctcccgagttcacgccattctcctgcctcagcctcctgagtagctgggactgcaggcacctgccaccacgcctggctaattttttgtatttttagtggagatggggtttcaccgtgttagccaggatggtctcgatctcctgacctcaggtgttccactggcctcagtcttgcaaagtgctaggattacaggcgtgagccactgtgccctctcctctcctctcctcccctcccctcctctcccctcccctcccttctctctttcctttcttctcaaatctgagaatgtcttcatttctccctcccttttgaagggcagttctgatggatatagaattcttggttgtcagattttttttttctttcagtactttaaatatatcagctcaatgctttgtggtctccaaagttattgatgagaaatctgccgataatcttattggggatcccttgtatgtatgagtcacttctgtcttgctgctttcaagattctcattttgtctttggctttctacaatttgattatagtgtgtcttagtgtgagtctctttgaattcattctcttggagtttgttgagcttcttggatctttatattcatatctttcttcaagtttgggaagttttcagccattatttcttcaaataatctctcttctccttctgagactcccacagtgcatgtgttggacactcaatggtgttcctaaggctctgttcaattttctttaatattttttgttgttgttctgcagactcaataatttcaatggtcctgtcttccagttcactgtttcttttttctacatgcctgaattggtcttcgaatcctcctataaaatattcatttcagttattgtaattttcagctccagattctttttaggttttctatctttttattgatatttctactttgttttgttttttgattttctccacatcttcctttattttcttaagcttctgtaaaaccattgttttaaagtctgtgtttagtaggtctgtcatgtggtccttttcagggatgattttcgttggtttatttttcctttcttttgagtgagtcatactttcctgtttctttgtatgatttgtgatttttttggttgataactagacatttgaatcttatcacatggttactctgggaatcagattctctgggtttgctatgtttgtttgtttgtttgttttgttgttgtaggatgtttgtgttgaggatcagcttgagatgtaaatttaaggtcttcttagaccttttatgagtctgtacctttccctgggcatgtatggcgactttctaaatttccctgtatatttaattgcttattccttaaatgtctcactatccaaaggagaaaaagagaaaataaataaataaataagacactggttctttaaatctcctggaagccacttcagccagaaagagggcctgcaaaaatggtgtgtctgtatgtatacacaacaatagctgcttgcctttgcatttgtacctccatgatcagaagcaacaattagtgatcagaatgcagatctcgtatatttgaaagacaaggtcattattgtccaccctgctcccataagctgcctgcaagctgctttaggaacacagacatggcagcctgtcacagggacaggggatgaggaattggtaaccactattgagctaagagctaaaatggactgaaattaactgtaagttaccttccaagcattcttctggaagttgcaagcactagagctccaaaatagtaatattagacagattccaacagtgcaattgttatctaggtggggagaaaaattccctgctctgctatcttcccagcatccctctacctctaaatttttgttaactcattcaaaaaaatttttttttgagatggagtctcactcttgttgcctaggatggagtgcaatggcatgatctcagctcaccacaacctctgcctcccaagatcaagcaattctcccacctcagcctcttgagtagctgggattataggcgcacgccaccaggcccagctaattttgtatttttagtagagacggggtttcttcatgttggtctggctggtctcgaactcctgacctcagctgatccacccacctcggcctcccaaaatgttgggattacaggcatgagctaccacacctggccccccaaaatttgttttttgagacagggttttgctctgttgcccaggttggaatgcagtggaactcactgtagcctcaaaatcccaagttcaagcaatcatcccacctcagtctcccaaatatctgagactacaggcacacaccactatgcctggctattttttttttttttcattttttgtagagagacagtcttgctttgttgcccaggctggtctcaaactcctgggctcaagcaatccttcctccttggactcccaaagtgctggaattacaggcatgagcaaccacacccaccccaagatattttttaatgcctctcttctgttagacaaaattttagtaaacgggatatgtaagtcattgatctatgatatccacaggatgctgcagacattataagacaaacacgtaagtgaaaatatgactatagattacgataaatgctatgaagaaaaaatacgtggtctggaatcttatcctacagtaggttcctacaaccaattttactcaagcatgggcttcctctgaactcctttcttgtcttaatacttctcttctaattattgttatttagaatttacttttgcatatatcaaataataggtttaggcaactatcattcaggattttgttgagagttaagattgatttacaaagatttttttcctccaataaacatgtatcagatttggccagaccccagtacaagaaagactcagctgcctggccaagaacaactctatctatgttgtggcaaatattggggacaagaagccatgcgataccagtgatcctcagtgtccccctgatggccgttaccaatacaacactgatgtggtatttgattctcaaggaaaactggtggcacgctaccataaggtaaaattaatttgcaaataatccaattagttaatgcctaatgaaataaagtgggcaaggagaaaaatatgttattgataatgataagcacactttagaaatcgagtaggggcaaagcatagaaagtaatgataaagcgtggaaagctcctataaagaggcttaaggggttccgtgtacatataagaacacaggagtgtgttttcaggagtgtgtagcagtcagaaagtgccgcatgcattatgttgcctaatgttgccttttggactttgtccttttaaaggcataccctggcaatgggtcaaggctagaatgaaaaactgcttaccacatagactctgtcttgaggagaatggaacaaacaaagttccttgccaaggaaaacagttaagtctacttggcaaacagaagtaatctattttatgtcttataagattccagtgggtctttatagataaagatacccatgtacatatttgtaatgtggagactgaactaaaggcccagtttagctagaatggcctctgattctctaaagcaaactcatttcccatgaaaacactgatcatagatgaaattggcactaagatgtgagcttgtactttttcccacactgtgatgtccagatcaacttcctaaaataatttttttctctttatcttctgtttattgcagcaaaaccttttcatgggtgaaaatcaattcaatgtacccaaggagcctgagattgtgactttcaataccacctttggaagttttggcattttcacatgctttgatatactcttccatgatcctgctgttaccttggtgaaagatttccacgtggacaccatagtattcccaacagcttggatgaatgttttgccacatttgtcagctgttgaattccactcagcttgggctatgggcatgagggtcaatttccttgcatccaacatacattacccctcaaagaaaatgacaggtaatgtgtgatcttaaagatatgcaggctgatgtaatcagaaaagaaaagaaaaaaaaaacatgtttttctagctaacgcatactccttaatacaatgttttccagctcttaatttttgaacatctagctgttaatatgctatagaatcaatctcagtctaaattgttttgtagatttatttggttttatttaacttgatttttttttcaaaatatatgacttcttacatacaactctcccttcttggcttcttggtttcatactttaattgatttcctctcacttctctgtctttatcagcatgttttactgaaattaataaaacatataacttagagagagtaaaatgtgaatatgaggttaaaatagtaataacaattatgaaatccctttttactttccaatttcaaatgatgttttcaacttattacttccaggaagtggcatctatgcacccaattcttcaagagcatttcattatgatatgaagacagaagagggaaaactcctcctctcgcaactggattcccacccatcccattctgcagtggtgaactggacttcctatgccagcagtatagaagcgctctcatcaggaaacaaggaatttaaaggcactgtctttttcgatgaattcacttttgtgaagctcacaggagttgcaggaaattatacagtttgtcagaaagatctctgctgtcatttaagctacaaaatgtctgagaacataccaaatgaagtgtacgctctaggggcatttgacggactgcacactgtggaagggcgctattatctacaggtaatattttgatgtcagaagagttactggataaaataaagacactcagttaaatatacagtttagataaataatgaatgattttttagtataagcatatcacacttttggggatttatgtatgctaaaaattttgttgtttatttgaaattcaactttagctgggaagcctacaaatacaggctaaatttatttgctaaatcttttttttttttttttgagacagagtctcactctgtagcccaagctggagtgcagtggtgcatcagctcactgcaagctctgcctcctcggccaagcaattctcacgcctcagcctcccaagtagctgggactacaggcgagtgccaccacgcctggctaatttttttgttgttgttgtattttagtagagacagagtttcaccatattggccagggtggtctcaaactccccgagctcaggtgatccgcccacctcagcctcccaaagtgttgagattataggcatgagccaccgtgccctgcctatttgctaaaccttgaaaccttagatgtcagttcaattttaagctgattgggaaaaggcaggacatttacttgcagtagcagtattaaaaataaatattcaaattacagatcattataacaggagttcattgaaaacccattttatttcctgcctgaacaaattaagccattttccttatatgttcacaaatgcctatcttgctttataaagagtttgacactaagtatatcctggatatgaatggggttgaccaccaagatagttcaatggaatggtttattgctgcaaagatccaatctctcattgctcgcaagtggcctccatggtcctctcattcttctcttctcttccttggtctggcccccatcttatctcacttaacagggcttcctattgacagtctgacaatctcagctccatccagtcagttctccatattgtagttacagaaatcacaaaaagctgtttttgattataatactgtctggcttaaaattcttcactgacttctaattgacaaatcaaatttcttaacatgaaagacacacaaagtctagatgtgtggtcccttcctattctctatcctctaatctcacttctacttacaaatatcctgggcttctgcaatattgaaatattttcccatctcctatttgctagcatatgcagaacctcaaggtgtttgcacagattgtttggtcctttatccgtggcgagccccacctactaatctttcatagcacttttctggtgttatcgtcaccaagaggggttcctggatatttcccacagagctactcctacctctccagatgagttaagtacatcctttatgtgctcccaggacaccctatgcttagctttatcaaagacatattatgtcatagtattcacttacttatttgagactgagaaccccttgagtgctgaaattatgccaactgcacagtattttgtttgctctatgataactaccctaacaatactttttcgttttagcaaatgaaggcctactatatgccaggtatttatttagtgttaatgatatgaagataaataagcatagatcctcctcttgaagaattcagtctttagtaatggagaaagacatttgaacagataatttcagcataggttggcatgtgattgtccgtagaatgcacattttgctggaggagtactaaagagctctacttagattaatttgggaatgcagggaagtttctggagctgatgctattatccaggtgaaaaagagtaggaggggattctttgtggtgtgaagagcatgaacaagggtgtggatgcaggcaggagcagggtctgcagggaacagcaacaggtcagtgctactaaggcaactgaggcatggcttgcgaagctgggtttggtgggaaataagcctggaagcaacatcctgtcctgcaggatcttacctagcacacttaagattcagcctttattctgtgggtgatggtcagctggtggaagtggtccagtgaaggaatgatgtggtcagatctacctttgaatatatcatttttactactctgtagatgatggagcaaagacccaaaagactagattattaaaatagtcttattaagggtctggaccaagactgtgtttgttggaataaaagcagggcatggagtctagacatatttagaaaatggaactcagtggccaatttgatgtggaacaggaaaacggaatggagagtccagaatgtggcagatttctggcaagaatggctgggtgggtgagatgcatctgacagatcaggaggcaagagaggagcagactcactgacagtgggtagaggctgagttcagttatagatgtgctggttttgaagtagttatgagacattcagctggacccagccagttgtctgttgaatactttggtctgatgcttaagggagatactagaattagaaatattgtttcaaaaatcagcaagatacaaggggcaattaagcaaacaacagtgaatgatacgacaaaggagactgtactgacagtaaagaactattgacaaagtagaacctttgggagcttcggtatttggggcaggaaaggacagaggacaagaaacctgcaaatacaattaagaaataaaggaaaatttaaaaagagaacatctggtagatgccaaggaagtagagactcttggaggaaagaaatcatgaggtgtattaacacaatacgttgaccattattagcatttttgagtataattttggcagaattttctgagctcataatgataggatgatgggcagattatattgggttgaaaagtcaaagggaagtgaatgcatttttttccccaagaaatcttatctgagacaagaagaagagaagcaagacaatggtttaacagagactcatggtcaggagaaatgtgtgtgtatgtgtgtatgtgtgtgtgtgtgtttctcaacaaacgagagagccttgattgcctttgtaggtctaagagaaagagctacaaaaggaaaaaatacataaaatatgagaggaatcaggtccagtgcagtggcctgtaatcccagcactttgggaggtcaaggcgggcagatcatctgagatcaggagtttgtgacccctgtccaacatggtgaaacctgtctctactaaaaatacaaaaattagccaggcatggtggcaggcgcctgcaatcccagctacttggaaggctgagacaggagaattgcttgatcctgggagatagaggttgcagtgagctgaaattgtgccactgcactccagcctaggcaacagagtgagactctgtctcaaaataaaataaaatatacaaggaatcattactcctactcagtgttccaaggtgctggaggaaagagggaaaaatagtatcatgaacacaggtacaaaatgtccaacaactggaaattaaatgaatcatattgtagaagaacatttattgccataaaattattaccatataccatatgttatattaacatatatagccttatatatgtgacattcatatggtattatattgctatataaatttttaaaattaaaatataaattgtgatgtattatttttaagttaaaaaaagttggtcacaaaacaagagagtaatctcttagctcttcttccctccttttccttcctgcctcctcaatcttttcctacctttttacctcctccagagtcttggctctacctaaagagagttgtgggaagttctttcttagtgttgtgaggtaggttagctttgtcaagtaaaaccaagctttctgtttatcttgctagacggtgatatttcatctaaacgattggtaccagatatgttttggaatcttcctatttaaagataataatacatattacttgatattaccagcagagtctgggaaaatacccagaatcaaacatattaatatatctattggaaaacatgggattattcaccttaaatagcttgaataaaaatgttatagccttatgttaattcaagttaggtcttaatgccaatgtgccagtgggttacaaaaatcctttattttcagaagattttggatttttgtattgaagataaggaattttggtataatattatatttataatttttcatagtctaactgtgatgatatattatgcttgaaaaatctcgattatcaccaaaagctacctccaaaccaagggaagagacacaaagagaggtaaaagtgaaataaacccctatcttgccacacagattttccaagcattttatagcaaatatgcataattttgtttatatcagtatgtcattgcaaacatcactcagagttttgcttttatagtttttctttgtttttgctaaagttattaattgccttatttttttaaatttcattaattttctttgactttttgttaaaaccccatatcttccaacagcatctcagaataatttttccacaatatcattttcataagtttatcttgagctaaaaataataacctttctctgcactggtttccctctagtcattctgcacagttgtcatattgagatttcctttactgtcatcctaggaatgctctcttagctatttccttgttttaggttctctgtttttctccttctacctttatttgctcctttgttctgttgtagtcaacgctgtctagtcacattgctctaatctgaactggctgctctccatgccttgtatacgataggagtcatcctggaatctccctttatcctcatggtgaagatttttctttaccacttccctgtgtggatttcctgttttctgttccccgtcttccttgttttgggcttgtgccctctttcttgttgttaacagtttccggaaagagagtgatcgggatgcaagatttttgagactcactggtctgaaactgcctttcctcttaaatttagttaagtatttccctgggcatggaattcaaaggtggttatgacttttcttcaggattgtgaatgtatttatatcctcccatcttacgttgctattgagaattctgaagttcttctgattcctgattctttgtatgtgtattcctcattccacaccttccccagaatgcatgcagaatttcttcctttctattttcttttctctttttctgaaactcttattattgggatcttctgcctcttggtttagggctctaattttccgacattttctctgctattttttactactttatttttctcctctactttctgagagatttcctcctcttgatcttccaaatcttgtactgaatcttttatttttgttaacatgttcttaatttccaagaactcttttttcttgtcttcggagtttcaacacttattgttgttttgtgcatgtattattttttcttctctctctgaggctatttaggaaattttttattgaagctcctcccccctgcttccttcaagttgcttttatctgcttttttatttgctttttcatgcaataagtttttctcacatgtctggtaactcttggggattaccaaaaactcatagaaaattctgaccatgtgagtaacacttgccaattttgagcttcatgatagaatgatctagctggaccttttgctgcggggaaatcggaggtaagtgtctttggagacttcctcttgggatggtcaggtctcccaggtttcaagattcttctaatttccttcttgaatcagttgcctaatttaggaaataaaaatacaggatctccaggtaaatttgaagttcagataaactttgttttttttgagagagtctctttctgttgccaaggctggagtgcagtggcatgatttccgctcactgcaacctctgcctcccgggttcaagcaattctcctgcctcagcctcccgagtagctgggattacaggttcatgccaccactcccagctaattttttatatttttggtacagatggggtttccccatgttggccaggctggtctcgaactcctgacctcaagtgatccgcctgcctcggcctcccaaagtgctgggattacaggtgggagccactgctcccagcccagataaacattttttttaaaaagtgtaagtatgtcccattcaatatttaagacatacttatactaaaaaattatttgttgtgtatctgaacttcacatttaactgggagtcttgtcctgtgttttacctggcaaccctattcctgaaagataaatccttgctgacagcattagggatccaagtgaggaaaatggccttgcaaggtgtgggtgggggtggagggggaacgttttcaacattcagtgttatttattcaggtaatccccttcaactatgtctcttaaactttcatctaaagaccatccactttaccctctctggaaacattctccgttatttactggagtaggggaggatcagttatctggttttttggaggacttagtatccaaggcatccttcacaactttctgctcatttattttcctttgactgccacaactttactcctagctctaggtatagagcagtcccagtgattaatttgagtgctttgcagtgtagatagggattcttggctctttctactgctagtttaggacctggttttcttgggtctgctgaatcaattactactttttgtatcaacatcctagtttttaaaactgtgttgtggtctatcctcctattttcctacctttgtgggttaaaaaaaatagtgttcttttgaaggattgtaggaaataaaattgaagcatatgttcattctacctttacctgaaagttacttctatcccatcttaatacacttgcactgaagtgattactttccacctgcaaagtggaaacaataagaccagttagcggctgctgctttagtcaagcaagagatgaaggtgacttggaatatgctgtacagatggcattaaatgaatatggatctccttttggaaacttttcatctgcatggtgagatgactcacatacttagattttatattcaaatagctacgtactatagtggaagaaaaacttaatggagaagtgtttcagttcttgcgcagtatagaggatatgacttttccagattacaggggttgcctctaggtcaactctagggctcattacaactctgaagctcttttattgtgtgaaacaggcaataagatatgatttacacaggtgcctaaattaaacctttaaacacattttaaattcttgataattaaaatcattagtaacttgagaacaatgaagatatagctgttcatggctataggccaaggatctgattgcttttacagggctaatctttttgacagtgaattgcaggaggcactggggcttaaagccctttatttttattattagttgtattaattattcagtgataaactggatgactctaatgaagaagtaacattattttaccaaataaagtggcataggcatttttctagatcaagagagtatttcagttgactttctcatgttttttttttaagagcatctagcagtttatttaattattttattctattttttatctttaaaatttatcctagctttattgtcattaacaaatgaaaattgtatatctttacagtgtatgatgtgacgttttgatatgtgtacacaccgtgaaatgattaaatcaagcaaattcacatatcccacatgactttcttatgacttactggttttcatgacttccctagatttgtaccctgttgaaatgtaaaacgactaatttaaacacttgcggtgactcagctgaaacagcttctaccaggtttgaaatgttctccctcagtggcactttcggaacccagtatgtctttcctgaggtgttgctgagtgaaaatcagcttgcacctggagaatttcaggtaagaatcttcgaatattgccaattagtttcatgtaagaggaagcactttttgatataaaaatctgctcaagtgcttacaaatatcataaaatttccatttagaaaggttaagattatccttggggatcatgaaggacattgagcaggctgcatttcttgtctggaaattcttaacataataattactgtgtccttcagaataaaaaaatatatatcttattttggggattatagggagtttaaagtcttccaagtagaaagaagattcaacgagagtagtttcagaaccagtgccattggagccccttaggaccactggggagtgatggcctagggaagttgaaaggagtccctctcgtcgagtgagtcaaggctctgtgtgatggtagaaggaaaagagacaaggaaaagctgaagaagagagaatttgacagtggcggatgttagcaaaaaagcaaaaactttttaaagttcagaaataatcccttgcttcacatgtgctctgcccagccacattctttcgctgacttcctgcaagttctcctcccactccccgttcctggtagaaaccactgctggggtgtgggaggacaatggaatggtgaggaggttgtggtgagcaagagacaggagatgacagatgctcagttcaaatccctgttagtcaattgcttcgggccattgtggggagtctttatcttgtctgagaggactaggtttctcttctgtatactgccaaatccactggtttgtgtttattaactcttacggcgcttccacaggtaagtaaattagaagacattgattacgggcatctcactaataaatgaatcagtgccagtttcatagctccaatttttcttgtacttggcaacatttcaaatttttctgatagaatggaatttggccagtatttttgtttcttcattctgttatagtaaattttaaaagtgatttatgggattgtaaaacttgaaggtagcctttgcctacttttttgttttaatcaggtgtcaactgacggacgcttgtttagtctgaagccaacatccggacctgtcttaacagtaactctgtttgggaggttgtatgagaaggactgggcatcaaatgcttcatcaggcctcacagcacaagcaagaataataatgctaatagttatagcacctattgtatgctcattaagttggtagaatattgactttttctcttttttatttgggataatttaaaaaatgatggatgagaaaagaaagattggtccgggttaatattatcctctagtataagtgaattactagtttctctttatttagacaaacacacacacaccagataatataaacttaataaattatctgttaatgtagattttatttaaaaaactatatttgaacattggtctttcttggacgtgagctaattatatcaaataagtatcacaaatcttttacgcagaagaaataaaaactacgggtagaaaacataagaactatcataaaatttacttacaaggaggctgctcttgttaccacttttattatattacgtatcacttattcagctctgctgaaaatttccaatgactttgtttgtttgctctttttgttttttacctaaacaatacattttgattctcttgtgggttgataatgtctccccaaaatttacatgttgaagcacctcagaatgtgactgtatttggagacagggtctttaaagaggtaaaataaggtcattaggatagaccctaattcaatatgactgatgatcataaaagaagaggcgagtagggcacaacaggcacaaagggagaccataaggagacacagaggaaggacaactctttacaagctaagaagagagggcctcagaagaaaccaaccctgccaacaccttgatcttggacttccagcctccaaaactatgagaaataaatttctattgtttaagtcacccagtccatggtactttgttaggcagccctggcaaatgaatcaaagacccattcctgttcctctccccaccactactgttttctactgtaatctgaagcttcaacaaaaggcttacctggtaagaatattcagctggtctgggtcctcaagactccaatagacactcttagagaaggattgctgatggattgatagtgaaaccattagatcattgaattcctctggaattagaaaaccagagagtcccattttaagaaattagatatttaatatagcattgtgtgttctattttagtaacagcagaatctcttgacattacacaactcagtgaaacaacatcatttaagccaaaatatctcccaactgactgatagactctgagcactaatatcatagtgctgtgatgatggacaattacatagtaccgataacagccatgcactgtgcaaagcatgcccttctgcacaggagagcaaggcacttgcagtagtgatctatgccagcaaaacatcattttgagacaaacatttttgtggcagatgtttttcctaaaaagtactatatcatccaagaaatatttgagtaaaatcccttgttcttttgggtgacattaactgacatttgctttttttcaagacctaatagaaaataagaaagcccataatgtatttagaaacaggaatcctcagagcaattctctgtattctcatataatttcaatgtaaaacagaaaacatattgatgtgttggtgataggcttgaattattaaaaacttcaaaaacatcctaagtgtttcttttttgctcaacgttgtcaactatagtaggtctcccttgtggtgtaatgaattgcccccaaactattatcttaaaacaacaaacatttattatcttatagcatttctgagggtcaggatctgggactggcttagtggagttgttctggatcagggcctttggaaagttgtagttaacttgtccccagggctgccatcatctcaaggctcgggtggggctggagaaaatctgcttctcagctcactcacggcggttgccaggcctccattctttaggatgctagaaaaactttcataaaatgtcatctggcttctcctagagcaatgatactgagagagaaagcacatgagagaaagagcgagggaacttggatgtaagccacagtctttgaaaacctaatcacagaagtgacatctcttcttccacatgatgttggtcacatggaccaacaatggcacaacgtggacagaatcaaacagagttgagaatatcaggaggtggggcttcatgggggccattttggatgctatcatagtgaatatatgtatttatatttatatctgtatatattgcaatgtaatttaaaaaataggattgttttccttttctttttgctatatgtgatatgtatttcaaaatacactcccaatagttacgtctgaaaagcactacactaaaaaactttctatacattgaataattaaattaaataatctaataatctctacttttggtccatagtaaatttaagttaactgtttgccttaactacagtttgtggcaaaaccatctccttttaatatacacaagggacttttttttttttttttgagacggagttttgctcttgttgcccaggctggaatgcgatggtgtgatctcagctcactgcaacctctgtctcctgggtttaagcgattctcctgccagagcctcctgtgtagctgggattacaggctgggattacaggcatgcgccaccatgcctgcctaattttgtatttttagtagagatggggtttctccatgttggtcaggttggtctcgaaacccgagctcaggtgatccacccgtctaggcctcccaaagtgctgggattacaggcgtgagccaccatgcccggcccgtgggacttttgcattcatttttcagaagcttactttgtaggggaacatacattaaaaggtaacaaaataaacagcataagttccagaattattaattcatgaagtgcaaccactaggaaaaggggtcttaaaaacatcaccctctttactggattctttgaagaaaccaagatttttttcctaataatctgttttatacacaatatataccaaaaatatataaatatataagtatataacaaaagtgaaagaaactgactcttaatcacaatgttctgaatagcaagaggaatactaaaaaagtcaactagaaagtcatgtcaacgtcaaaatctgttctgaaacacatcactttgattttatactgaaagccgatacctcgaatttcctctgcttcgctgtcctgtggttgtactgggcatgttccaaatgtatcacttttatttttatttcaataatttcaagtgttattttagattcaggaggcccatgtgcaggtttgttacatgggtatattcagtaatgctgaggtttggggtacaaatgatcctgtcacccaggtgataagcataatacccaaaaggtagttttcagccctttccccctccctgtttcccagctgtagtagccgctagtgtctgttgttaccatctttatatctatgtgtaccaaatgtttagcttccatttaaaagtgagaatatgcagtatttggttttctgttcctgccttaacttgcttaggataatggcctccagctgcatccatgttgctgcaaaagacatgattttgttcttttttatggctctgtggtattctatggtgtatatgtaccatatgttctttatctaacccatcactg

SEQ ID NO: 13032 - DNA, 165651 bp, Human
  misc_feature (1)...(165651): n = A,T,C or G
gcagcctcaaactcttgggctcaagcagtcctcctccctcagcctcctgggtagctggactacaggcactcgccaccatgtccagctaatttaaaaaattttgtagagtctgggtcttgctatgttgtccaggctggtctcgaactcctgacttcaatcaaccctcctgccttgggctcccaaagtgctgggattataggcatgagccaccatgcctggccagaatcaagattattgtgcaagagtaattgtcacgtatctggggtcgtggcttgtattacaagtaatatttagctctcaatcatcagggttaatgggggattggagaggtgagaactgatatacagaggggactctgggctcattttgggggggctctgtccctccctgatctggacacttgctgcttaccagtcaggaatgctgttttaggagcttcctatgtgtatatgtgtgcatgtgtgcatgcatgggctagtgtgtgcacacaaccatgtacacatgtgcacatatgtccacctgcttacatgttttctggatgtgtgtctgtgtatgtgtgcatggatctcctaccctttcctcttcccatcgagggagggagctggacagaggccaaagggtgatggggaatcaagagccagagaggaagaggcctgccttttaaaaccccaggtgttctggggaattccctcatggtgacttcctttctgattcctaaggctgctgtggttagaaatgaaaatgaattcagctctggtcccatcctttggaaccccctctgcacacagtgggggcttaataaatacttgatgatgatggttctgaacctgggaagccagcagctgttcctagttctgactctcagagccccatggggcaaatcaggcagggaatgaccatgggggaatcttcagtcttcctgccagatccccctgtgactacacacccagctgttagggaaggggctggagccatggtccacttcacacaccctgctttggagaggccagttcttcctcagcagcttctcttttgttttccccaactaacatttgaacaatatttattgaacaaccactttgtactgaatatcatagtggaaatgcatcctgggagaaagtatctgatctgtggggtcagactgactaagttcaaatcccagcatctttaattacaagcgggatgacatctgacaagttacatatctatgtttgagcgtttgagtgttttttccactttcctttctctccttcttctccttctccttcttcttcttcttcttccaattttcatctgtaaaaggagagtgatgacatcatttttgtggggttgatgtgagggttggaaataacagagaggaccctgaacacgaggcgtaggcactcagtcaatggtaggtgagtttatccaccgggtgttagaaggtgtggatcccccctgcttctgtgaccttgacgttgttactcaacacctctaagcatcaggctttgtaaatgagaccatactgcccacctccttgggtgtttggagactgtatccggataatatatgtgaaacaacctatcgtaaaccctggtggttaataaatgtttgccttcccctccgtctgccccctcatcagggtgcacacctcccctccttcggaggccctctgtccctcctccccatcgcccagcgtgagcgaacatcccttatcgccgtgggcttaagggttgtggccatacctgtcagaggaaagaggacagcggctcagctccggggtgggggagcaaaaactacagttcccagtcctcgctgcgccgccactggggccggagcccaggacgccaggcccctcctctggggaggagcctatgcggggggcggagctaggaggaggttggagagttaagccaagccaatgagaccagctgctaataagtgggcttggcttacaatgtaacagtggcaggaggaggcgagcgaagctattgagccagcgaggagtgaagctgagcctggcctcacacgctcctagaggaccacctcctgagagagttctttcaccccctcttctttctccaagctcccctcctgctctccctccctgcccaatacaatgcattcttgagtggcagcgtctggactccaggcagccccagagaaccgaagcaagccaaagagaggactggagccaagatactggtgggggagattggatgcctggctttctttgaggacatctttggagcgagggtggctttggggtgggggcttgtgctgcagggaatacagccaggccccaagatggacacttctgggcacttccatgactcgggggtgggggacttggatgaagaccccaagtgcccctgtccatcctctggggatgagcagcagcagcagcagcagcagcaacagcagcagcagccaccaccgccagcgccaccagcagccccccagcagcccctgggaccctcgctgcagcctcagcctccgcagcttcagcagcagcagcagcagcagcagcagcagcagcagcagcagcagcagcagccaccgcatcccctgtctcagctcgcccaactccagagccagcccgtccaccctggcctgctgcactcctctcccaccgctttcagggcccccccttcgtccaactccaccgccatcctccacccttcctccaggcaaggcagccagctcaatctcaatgaccacttgcttggccactctccaagttccacagctacaagtgggcctggcggaggcagccggcaccgacaggccagccccctggtgcaccggcgggacagcaaccccttcacggagatcgccatgagctcctgcaagtatagcggtggggtcatgaagcccctcagccgcctcagcgcctcccggaggaacctcatcgaggccgagactgagggccaacccctccagcttttcagccctagcaaccccccggagatcgtcatctcctcccgggaggacaaccatgcccaccagaccctgctccatcaccctaatgccacccacaaccaccagcatgccggcaccaccgccagcagcaccaccttccccaaagccaacaagcggaaaaaccaaaacattggctataagctgggacacaggagggccctgtttgaaaagagaaagcgactgagtgactatgctctgatttttgggatgtttggaattgttgttatggtgatagagaccgagctctcttggggtttgtactcaaaggtaggggctgtggtttctctttataccttgaacaaaaggaatatgtaggtagcaagagagggattgagagagggggattgtgagagagagagattgagagagagagagagagagagagagagagagagagattgagagattgggagggagactgggagagagaggtggtggtggtggtgagaggcgcttgctcagttatattcaacactctaacttcccgtggttttccttcttgatcccgggagaattcattcctagcttcctctggggggtaggggacatccccacacactgtgtctaatttgcagactctctgttagggaggattcaataatcccttctgagaaatcgcttttcctcctggctcactcgtactaaagcataacccagcagcttaacgcaccaattaattacactccgccttcatgtgtttgccagttcctgcgacttccccttctttcctcccctccctgctccactccattttcctgaggataaaaaagaaataaatgtctgggtggggggtggggattccgtaccattgcccaagtcccttctctccctgtcttctccatctcttcccaagtttctgtttccctcctcttctcagagagtctcgggcaaaatagaaaaccatccatgacctgggtctcctgagggcatggggtaaaaatataggtggaggaaatcagtggtcctttccctcaggagagaggactcagaataaacctgctgctgcttcgtaaacatctcctgataaaaatggctacaggtgttacctgggcagagcagctgggcgccgccttggaatcagctgggggagcacctctccttgggacgggatgacagggcttcccaggcggtccccacaagcccgcgccccagctcagccccagttctcccctcccacctcaactcctccttgggataaataaagatgagtgtgtgtgtgagtgcgcgcccggatggagaacagcaggcactggctttagcggggagctggccccactgctccagcctctcagtccagccccaagacggaggagggggtttccctcccagagggagtggagatggaggaaggtgggtttctgccgatgctctgcttgccggggagctctcctgctgtgggctggaaggcttggagacctgggaatcggtggacaagtggctccacgatacccccacccccaatttgttggtgtgtgtgtgtgtatgtgcgtaatgtttgtacgtatgcatgcgcctgcttgttgcttgggtttttctatttatttgtcatttggggcagggggtggcttggtgggggggtggctgggcgggctggccatcgggtagctgggaggggttcagctgttggaggtttcaaatagagcttgtttcaggcagggcacagctgctgcgagactgtcacattccttattgaaatccagccgcaaaaacctaggaggtgctgatcggatttcccccattcccagcatctcactttaatcggtgatgggcagactttcccgccctggaaacgggtggggcagacctgtcagacgacctgaatagccaggaccaagacttccaggcagagggtcctccagcaacccggctgctctctcagtgggctgccccagcggagggcagcacctggaagccgccttagtcaaaatagctcaaggatgagcgtctcagcgagcagaagcgagtggggtttcccttggaagcgcagctcacttagtcattccctgtaatgagcctctgcgtctgcgggtccttctgctcgctgccttctcagaaccgcctctcctgctgggcgctccaggatatggggctggcagcctcgctaggactggcagctgccctggtcacagccctggctctctccagtcctcccttggagaccaggggccctcactggggaaaactgatgaaggcccaaatgcaaggggggtgtggggaaggggcaatcccagcaccttctctttcagtgacacccgtagtcagagttcttaaggaaacggctattcccagagacagtggctgtgcacagatcccagtgtgggatctatgcacatttgtcttaacgcgacgggagagtcaccactctgcaggatcaggccctcttccctgcctggggcaggtgccacccctgagggggagctcagggaaaggggctttcccagagatgcggaaggcagattttaggtgaatgaaaggggaggccacctgaggtgcttggctccccgcatttctgaatcacagaccctcatagcagcagtggcgtgcaccgagggggcagtagctgagaggtccttcttgcctcagcggccacttcctgtgtgccttggggctggtcttgagataagcagagctcatttaacttgctcactcattcacccatccctgcactgtccatccatgttttgagtcatttatgaaacaagtattttctgggtgtctcctatgtaccaggccttgtacacactgcagggccaagatagatatccctctctcctggaggcaaatgggaacatttcaaggaactgggccagagttggaatcccagctctgccactactatttgtgtgatcttggataagtcatggagctttagcgagcctgtttccccagctgtcgagtagggagaattaaattagagacgtgtaaggcacgtatctgcctgctcaacaaatgggacctattgtgattgttactgatgatgacaatgatgagaggaaaggagatatctttttcctgttatctaactctggctgtaaaattagttggagctttaacagattgggatctaagacttgtcaacggagtgagaagttgtatctgggagggaagaagtcctgagaagggactgggtctgactagagaccacctttaagcatggtttattcttggggggaggtgaatatctgtgtcccagtttcatggaggaagtggtctctactcctccatggtctgggttagtcacagcccaggagagctcagggacattcagtggaccctggggagggatgggtgacactcttttgctggagagctttgtgtgcctggttggccctgctgaccagtctggaggcaggcggatggacaaggcaacctcaggggtaccaggcagattaggtaattctgcccatccagtggcagctcccactcaaaggcccttgggaggtgacaaactttttttttccccaggtgattgaagattaactaaccttgtgcctgagctgctgctttctgaagttctctgcttttttttccgtggggttgtggccttgctgttcacctatgtttggcgggtggctgctgctggggaagtaacttgtcatgcaggcctgggtcttttgaaaaggagggtggcatgtgccctgagcatgttcagttaatgcaaatgggagccaatgtgagggggttgagcaaccgggacagaacatccccagctcctgcctcacaggcctgtaggtgctgatgatggaagtaagctctgctaggaggcatcagcctggagcagggaggtggggcttgattcctgggtgagctcagataagaggagagcttctcattattatgcctgggacatgagatcaaacggcagagatgcctgagatggccccagtgggctcctaaaggtaccaggtgacccttgaaccaaatgaggagtcctttttttttttttaataggcaggtttactctctgaagtcttagacattgtgacgaggcctggtctagagattctgttgagaatcttaatcacatcatctgtactgatcggtgccacctgggtagaccagcaaggacctggggagtccttcttagtgttctttattttcttttagagctggtttggggcacacccactccattgcattaaattacctgtatgctctcttccctgggttcagaaagaattagggaagggaaaggcctggctgccctcccctttccccaggctgtgacttcaccaccctgaccctgccatcatgttggtggctgagctggtacctctgtgtggctggcaaggcacccaggggccttgtttctcgggatctcaggcgttgggctgtgggatcttctcaggggaggctggagagtgctggtgtggcagcatggctcttcttttccaccaatctgtacaacctcaagccacttccccatgcccggccttgaaactggtctgcatctctcctcccaggcagaaccagtcctctgcccactcccccaccatgctcctgtctcgcctgccccactgatttcctgcccctctgctcctctctgtggcccctgcctggcctcgttgctggggtaacccaggtggcagagaggagttggtgtgaagatgcttatccaggctgccctgtctgctcccacagtgtcttcttttcccacttctagttactctttcttcagacaacctcatgggaggccgcttctccgtatgcccaggggagcctggtcgtctggccattcactctttaaacagaatggccaaggccaacttgtctgtctctttgcagacctcacagaggtccctgagtccatccccagcctctagaccaaatgattgagtagtatcactggaaccagttctgatcctctgctctccctggtcacggaagccttgtctgcagaagggcagagcagcagtgcaggcttggctagccaagtggctctgcaccttctgtttggacccaggtgctgctttgggataggttgttggctgtcacagtgtcctggtatttttgagaagatgcctctgggtactggtgcctgtgtttcaggccatggtggaaaagtaggagtaggatagaccctttccagccctttccatggaccctccctgtggggtgacctgcaggaccaggatgcagaaggcaggagactggctgagagcctgcgagcccactgccgagggccctaggcacacattttgtcttcacaggtcacactgagtgtgtcggcccacaggagggcaagcgtgaaaatggccttttgacagcgtgaaaatggccttctccgccacccgccccagggtggtggtgactttatttataatctttgtggacagtctgtaaatgagtcaaacatctgtaacccacagggggacagctaactttttatatatgcttctcctttgcgtgtcatcacactatttataactgtcctggggaaagacttcatcacacatccggacttcccttccccacaggcggcattacccaggtgctccgccaggggcatcctggctggggcacttatctcctgcacagcctaagtagaaaggcggctgatgcctcgtatttctcttattgtgcttttaggaagagggatttgtaaggccatggtcaaaagatctgctttaaaaaaatataaggtaaagaaagtcaaaatgaaaagaaatttgagtaacctctgtagagaatctggggcctggatggaaatgtaagatcagaatagagcgcttcagctctgttgcagttatttgtgaagcacatttgggggagaaaatgagtgtgtgcgggggttgtgaggggcggctgtatattgatgaaataccactttactcagctcagtgacaggcaggccagcacattcatttgtagttctttttcttctctttctttcaaaaccccaaaaggagagcaagaaagcaaggcacctattcctctttaaataatgagggtggggaattctgagactgtgcttttcccaggagctgtagggaggaaaattctagtgccttttcttcgggtgaggaaagtccggaggaggcgaatgggtttttaagtgccccctcccccgaccctgtcattccacccccaggagctcagctgggatctgagggaaaggaggggaggagcagctgggggcagggaccacgctactttctggtcacccagcacttcgctgggctggccgggatgttgctgagtgacaggagaggggaaggcaaggaccatttgctgagtgctgggctggctttacattacacccgggagtacaaggagcaggtcgtgctcaccgccccctgtgtagatgaagtcaccgggccacactgacactgccagcggtggtggcactgagataagaacccaagcccgtttagctcccaagttcatgccctttcccttgcctgctgctgcccatatccttaaaagagaaaaattgagtttatggcactgagacccgtgatgcaaaatgttggaacaggaggaactttaccacgagctgggcaggaagggcttgatggagggcgggagatgctggcgcaggtcctggagaagacagtgctggaggggtggccagggcaagtgtgggcaccccaggttggcctgggatcagggtgagattgtggactggcccaaggtcagttcttgatgcctcctctctggggtctggtgctgctgccctcagggtgataccgggcaggttgtgaggagggtaggtgtggagaatacagggaaaatgaaagcccttcctgcaaaagctccttccacagcccctagcacccccaccttccacccctggagggccagcaggacccctagacctgactggacatgtccatacataactctctcacccctcacctccaccttgctcttctcttaggctgcctttctcctccagcactggctgtgtggctgtttatcgggggacagtcacatgagctcagcatcttacatcttacaaggcattttcacccctgggtccctcatgaccctcacggtggctggcccagggctcatgatgaccaactatctcagggatgagaaaactcggctgcacaggggttcccagggttgagtgactcactccaggtgcccatctcaggaaagagagggttctagaatgagagctcaggtctcagtacacttctgatttccctattccaaaccccaccacaaacttctgctggggatttgagtgagggacctcgaagggcttctccattcctggttctagaagtttctttttcattcttgagtcccattttcctgcgtccctgtctgtgcctcatgcctctgttgagctctgtcatgggcagtgagtgccgagaaaaggcccgtctctgctttgagcccctcaggaggtgcttctgcctcttgcttccagcttgttgtgtgatctttgtcgagtcccttcccctctctgggcctcgtttctctggcctaaaaacaggagctgaactcccttcctgtgccgaggcttcgcaatctgattccagatcatgtttcatcacgaggatgagcagccacagtccggagagtcctgttcttaggggtgtcagacagcacccagatggcatccatcccaggcggatggtggtttatggtgttggtgcttgggaggactgaggaaggagacagtgactcagactggggatgctgggtggattccctgtaggaggttggggggtccctgaaggactagacaagccatgatgggaggggctcgggcaggggctcaattctgagtgtgagaagcccggggagagggggcagagtgtgtagggaatagagcaggcctgagggcagcttcaggttgctgccgtgtggtgcacacaggggcatgtagggaggaaagaggagactgtctcgtctggagaggctttgggcaggcagtgaacacaggcccagggcgagggcacagtgatggatggaatatttggtagcatcagtaaccaccagggctgcagagttctgcacactcaggccccgaagacctgatatccttccttttagaggtggccaggcttggtagttaaggacttggggccaggcgcggtggctcatacctgtaatcgcagcactttgagaggccaaggagggtggatcacctgaggtcaggagctcgagaccagcctggccaacatggcgaaacctcatctctactaaaaataagaaaattagccggacctggtggctcacgcctgttatcccagctccttgggaggctgaggctggagaatcgcttgaacccgggaggcggaggttgcagtgagccgagatcgcgccactgcactccagcctgggcaacagagtgagactccatctcaaaaaaaaaaaaaaaaaaaaacttgggtggcacaccagtgatgggcgctctgggaacttactgaacccaaagcctatttcctcagtgttaagagggaatcacaactactggctgtagcacagcagccaccacagagccagccacacactgggtctcagcagctggcaactgttgcctttattagagtggtggttagaagatgccacctggagcatcaagacaggaggggcatatgcgcccatgtcacccctccactgtctgcaggtgtccctgcctggagagcacgtgtggaacatgccccttttctcatgagccaaatggcttcccgtccgtgacaagctccccagtcatgtttctggatagaccttgttgggtgaatctgtgtgagtaaaaaggaagtgggctgttctccggagggcagggctgcagtggtggcctgggctggacttctggagccttcttaccccatggggccctgttattctacactcagttagcaatttgtggtctgggcagagctaaccgggtgtggacatgcaaatcggacaggtggagagagaacaaaaataaacccgtggggccaggccagaggctgagaggcctggaggaaggtcagggggacacacgatgaccaggcagaaaaaggctgagagagtagggccacagggagagccgaactaggaagctgacctgggacagaagcagggaagaaaagcattgccacagcttgcctgatgcgtcgtcaagagaacacaatttccccttcaagacttgagtcagggtgcttcctagaattctaaagattctttctgccccttcaccctgcttggagcaccagggctgtggcagtgggtgacgttcccagccaggtgccagggggcaggcagcaagagcagctgggcaggggagggacgtgcccagggcttgccctttgtggaagccatatctgtttcacaagccctgggcacagggtaaccagagttgtattctgagcagagccttgatgatactaaatgaacagcatgcaaatgatgtgtgaaataatatgcaaattggcatctgttatttttgagtcagcttgttgggcatttttcttaaaggacaggagtgctgctcagtgtcaaatgaacaggaaagtcagcttaaaggacactccttgcagggactgagctggcacctactccttagagcttgctgataccaggcctgccacgcgacatctgcaaggacagttgtttggtgttttgcttcaggttatagatggagagacctataaaggtgggtgccctgcccaggttacccagtaggtagggaggaggaagcagatgacctgttgcctggcttgagccattgaaccttgctgacctgtcagtggctttgagctgagggggccctgcagggaggcagggagaggctgcccttgctcattctggtccatctgccaccgttggttttccttaagctctgtgcctcaaactctccgagcctcagtgtccccgtttgtaatggatgtggggagactgacatccactaacctggggaggatgacacttgctagtggttggtcaagtggccagcctggctgtgggtgctcctgggctgccagcaagtggtggctcctcctagcccctttgcctgagttggcatcagcctgcctcctcgcaagcttccactagcagcgatttttgcagagcaaaaccccttttgagatttctgattttaacgaattggagtttagctattttctttcttttctggcttccagtgggtaagatgttggctccccaaaaatctcccatacatgggaatggccggagctgcctgcatgggtgatgttaccttctcccaaggtgagggcttggggtaggcatgttgctcagggttgagccaccgcctttggagggctcagagctggatggcattggtggaggatgcaggggaggcctcctcaggggggcaccatacctgccctagatggccaagctctgtaggccagccaggtgtgctagcctgggtgggcaagatccctgcatatgcctcccagccctgtgaggaaggcagggaaaggaccatcctcctccttataggaccccaaggcccatagaagttatgcggtggctcacacctgtaatccagcactttgggaggctgaggcgggaggatcggttgagtccaggacctcaagaccagcctgggcaacatagtgacaccttgtctcaaaaaaaaaaaaaaaaaagttacatgacttgtccgaggctactcagcattgttagtggcaggggcatagctggaatcctggaattcctggttttagttcttcctctctttttgtttctcccatccctcttctggaaacatatcctgaacacccactgtgtggcaagccctgctccaggcggcaggagtgcagagaatctgtgccttacagactccaggggggtctctccccagccagatgtgttgttctccaccaactcttcctaagagagcacaggctttccccatagacctggattcaaatcctggctatttggctgtgtggccttgcgcagcggcccctttatttgggaggtggtattttaattcctcttgtgggtggagaggtgaagaattcaacgtgggccagagctgtcacccagggggctcttgtccatgctgggcaatggtgggttttaccttggttgtttcttctgagagctcagtggccttgggatcatgcaaggtccctcacagctgggcccatggttcccagcccctcctgctctgggctggacctggtgttaagctctgccaagatgctttcccctgctctgggagagtaatggtgctgagcctggtgggagggcattttggcagaagacacctgacggggtgcacactatgtgccagcgatggaaagatcccttaagagtgaaatgaaattgatgcaagctgagagcaagtctaggatggagttgagtcatgagggtttcctggtgggtggacgggatcatatagaaagaaagcctgtgtccacagcagcttgggggaaggcaccgctctcattacatgggaacttatttttccttccgtaagaatgactccaaagcaacaccgggtcttattcaggagtgaagaggtgacaggcggtggagaagagaatatttattaagggcctactatgtgtgtttacacacctcatctcattaagtcctcacaacaaccctgtgaggtagatataattctccccattttacagatgacagacccaaggctccgagagtttaagtgacttgctcagggtctcacagctgggaggtggtggagtttggatttgcacacaggggagtgtctccgacgccctcacattgtgcagcagacatgcttttgcatatcagatcctagactgggctctttcaagccaaaaagcttctcctgccctgcctgagctctccactcccgcccaccccaccccttactgtgccaccctcagtcccctgccagcctcccccagagcctcaggggatgttttgtgctcatggagtggggtaagggtagagggaggaggggaggaggatgctggcagtttagatacaggggtttgctgaagctccaggtgccgtgctgggctctggggctgaggaaagtctcctgtgggccctggaggggccacccgagccctcaacagcatgcgtcctagtgttcttgccgcagctctgtggcttctcggctgtgcagccttgttgagaaaactgacctctttgagcctcagtctccaggtctgtgaatggggttaacagtgttttctctctctcatgagaatgggtgtcatgaggaataaatgagacaagggcactgcctggcgtgttctggttggttctgggggttcagcaccaaatagacatggagctcacaggctggtgggggaggcaggcactgaacaagtaacaacaggtctgatgtgagctttgcgagagacaagggcacacacatgtggcttgggtttgacccacaagcctgagacttggtgtcccacgcctccgtctgctccccttccccccatttcctgaaggtccatctcaccctcacttcttccatcctccctcatatctgtctcccaggccatcctctgattcttctatatgggctatctagcctggtgttaggagaacaggctttagtgccaagcagatattgggtacagcgctggctgtgtcacttactgtaggctgtgtggctttgggaagctgtctcagtgctttgattcacagtttccatgggggtgaatcctaacctggccgctggggctgtcatgagagttaatgagatattgctgtttgtaaggcagaggacatggtttctggcacacatggagcgctctgtgaaggccagctgagttgcaggtgaggagaagcatcctaggctaggtgtggggcagcttagtttctggtcctctgttttgtcatctagagagtgagagaaggagcctgaggaggggatgtttcctgcactggccatctgcgggaaggtcgtgagcaccagatggaatttcggagagaactggaagaaagctacgctattccagctggcgggggtcctcatcgatggtgcatgttggcagggtgggctgcggggggcgttatcttcctatcccacaagcgaaagcctgtgaagacatcgtggctaaggggattttctcactctcaggagacagctgagagacaggcccttctggccagcctccctccctgctgcctcctccctgcaggccagcccttggcacgagtcctgcttgtctcctgaaccctcctagcagcagggatttaattactataatgtaagtagctgtggcttgaggccttctggtggaggggaaacagatttgtcttctcactgggagaataaaagtctatggaaaggaaaagaaatgtacttttccccgaggtacctgaggctgttgggctcaggggagcttccctcagggcggggagagggagcatgggtggcagcgggaggaggcaccacgtctgactcaaggacccttggcgcttgcttttgctctctgtgggatcactcagctaagctgcctcagtttccccaatgaccctgctaacagatcagcctgacattcagtaggcatctgtcaagcacctaccatatgctagacacttagaaacttccagctgagtagccagcccaggcggaaaaataatttcattcatttgacaaagttattgaatgcctgttatgtgccagtgtattgttctaggcatcacagatatacagtcatgcgttgcaacgacggggacgcagtctaagaaatgtgtcattaggcaatttcatcattgtgtgagcatcatgcagtgcacttacacagactaggtggcatggccttctgcacacgaggctgtatggtgtagcctactgctcccaggcctgtattgaatactgtaggcaatcataacacaatggcaagtatgtatctaaacatagaaaaggtacagtagaaatactgtacaatggatacaaaatactacacctgtatagggcacttaccatgaatggagcttgcaggactggaggttgctgtgggtgagtcagtgagtgagtggagagtgaatgtgagggcctaggacatgactgtagactagtgtaggctttgtaaacactgttcacttaggctaactacatttatttaaaatatttttttcttcaataacaagttaaccttaccttactataattttatttatttatttatttatttatttattttgagacagagtctcactctgtagcccaggctggagtgcagtggcacgatctcggctcactgcaacttcaacctcccaggttcaaagaattctcctgcctcagcctcctgagtacctgggattataggcacgtgccatcacacccggctaatttttgtatttttagtagagacaaagtttctccatgtaggctaggctagtctcaaactcctgacctcaagtgatccacccgccttggcctctcaaagtgctgggatgacaggcatgagccactgcgcttggccaaatttttcactttataagctttttatactcttttgtaataacacaaacacattatacaattgcacgaaagtattttctttatattcttactctataagtttttttccattttagaaatatttatttaaaaagatgcatttttacttacaaaatcttttttggttaaaaactgagacacaaacacacgttagcctgggctgacacaggttcaggatcatcaagatgtcacgaagtgataggaatttttcagctccattataattgtacaggaccttgactgaaatgtcattatgggacacatgactgtagtagaaaaaacccacaaaagagaaaaatctttgctgtcacgaatttacattttaatagataagcctgatagtaaactatctaagttaattatatattatgttcgatggtgataagtgctatgatgagtgttatgaagagcctcttccctccaagatacaacttcttactccattgacaagtcttagatcccaatctgttaaggccccaactaattttacagccagagttagataacaggaaaaagacatctcttttcctttcatcattgtcatcatcaataacaatcacaattgttaggaccactctggatgggagtgcaggggcttctgagaggagagtggtcatattattttatttattttcaaattaatttattattattattatttttgagatggagtcttgctctgtcgcccaggctggagttcagtggcccaatctcggctcactgcaagctccgcctcccgggttcacgctatcctcctgcctcagcctcccgagtagctgggaccacaggtgcctgccacaacacctggctaattttttgtatttttagtagagacggggtttcaccatattagccaggatggtcttgatctcctgacctcatgatctgcctgccttggcctcccgagatgctgggattataggcataagccaccgcgcccagctttttttttgtgagacggagtctcactctgtcacccagactggagtgcagtggcgtgatctcggctcactgcaacttccgcctcccagattcaagtgattctcctgcctcagcctcctgagtagctgggattgcaggcacataccaccatgcccagttaatttttgtatttttagtagatactgggtttcatcatgttggtcaggctggtcttgaacccctgacctcaagtgatctgcctgccttgccctcccaaagtgctgggattacaggcatgagccaccatgcccggctgagagtggtcattttaaataaatgctcagagctaggtgcagtggctaatgcctgtaattctagcactttgagaggccgaggcaggaggatcgcttgagctcaggagtttgagaccagcctaggccatatagtgagacgccttctaaacaaaacaaaaaattagctgggcatggtggtgcgtgcctgtggtcccagctacttgggagtctgaggtgggaggatcgcttgagcccaggaggtcaaagctgtagtgagctgtgatcgtgccactgcactccagcctggggaatagagtgagacctggtctcaaacaaaaacaaaaacaaaaacaaaaaacaaaaaccacaaataaaacaaataaagaagtgcttagggccaggcatggtagctcacgcctattatcctggcactttgggaggccaaggcaagaggcttgcttgaagccaggagtttgagaccagccaggacagcatggcaagactctcatctttacagaaaaaaaaaaaaagctgagtacattggtgtgcacctgtagtcctagctacttgggtggctggggtgggaagatcccgtaagcccaggaattcgaggatgcagtgagctgtgattacgccactgtgctccagcctgggtgacatgtgaaaccctgtctctaaaaataaacacataaataaataaattaaataagtgctcagggaaggccttaccaaaaaggtgatgtctattggaggatctgaagtggtgagggatccagccacctgggggaagaggaatagcaaggtgaaggccctgaggggggatcatgcctggtgtgttgtagacagcactgtccggtggacacgaaatgggagctaccgctgtcattttaaattcctgagtagccatattaaaaatagtgaaaagagaaaagtagaattatacatgttaataatatttttaatttaacccaacatagccagaatattattatttgaatgtgcaagcaatacaaaaaattattgagatcttttacactttattttttgtactaagtctttgaaatctggtgtgtctctgacacagcatatctcaatcagacattaagttttcattggagatacttgatctgtatttagagtttataaaatttacaattaaaagaacagacttgctgggcatggtggctgacacctgtaatcccagcactttgggaggcagaggcaggtggattgcttaaggccaggagttcgagtccagcctgggtaatgtaacacagtgagactctatctctctaaaaaaaaaaaaaaaaaaaattagctgggtgtgtggcatatgcctgtggttctagctacttgggaggttgaggtgggggatagcttgctgttgaggctgtggtgagccatgcgtgtgcctctgcactccagcctgggcagcagagcaagaccctgactccccgtccgagaaaaaaaaaagaatagattcacacactcaagttgttgaaaacgtacttaaaatttttccaataaaagagtggagtgtctttttatatttaattttaaatgaaatggacttaaaatccagttgcactggtcatgttgcaggggctcagtggacacacgtggctcgtgtcctcacactggacggtgcaggcctgggagcagagaggatgcctgtgaggctgattcagtgagtggagggatcatgtgggcggggttgtgaggtcacaggggaggcgggtctggctctgcagggatttgtagaccgtcctgaggagtgtggcctttaccctgggtgagatgggagcaagaggagggcttggagtagagaagtgacaagatctgacttacattttaatgggaccactctgactgcagtgtttggaacagacagggagggtcaagccagggtcagggagccccgctgagaggctgtggggacagctcaggtgagggtggtgatggtttggacctgggtggtagcattgagttggtaaaaagtggctggacccttgggctatttaaaaggagggcattcctgatgaattggacaaaaggtcatggtgtgcaggtcaggcagtggtgagagaaaggggaagtcaaggatgaggctgagacttttggcccaagcaactggaaggatggaatttctgttaattgaatggagaagactgtgggagaagcagtttttttggggaagacagggagtttgtggttggactcgttaagtttgaggtgtatcaatttccatataatgcgtgtagcacctgccccaggggttgtaagaggtcacaggatggtgcttgaggccgtggcaagcttctgcctgggctcctgacccagaacagatggctcctctcaccttccagaggtctgttcgaggcatggctggcaacgttaaaaaaaatttggccgggcacggtggctcacgcctgtaatcccagcactttgggaggccgaggcgggtggatcacgaagtcaggagtttgagaccaacctggccaacatggtgaaaccccgtctctacaaaaaatacaaaaattagccgggcatggtggtgcacgcctgtagtcccagctactcgggaggctgaggcaggagaatcgcttgaacccgggaaggcggaggttgtggtgagccgagatagtgccattgcactccagcctgggtgacagagcgagactctgcctcaaacaaagcaaacaaacaaacaaacaaaaatcagctaagttatccatgcctccagcaccgtgggtgttgactccctgaaggtcactggaagttgctagggtctttctgagtcaatccacatttcaaggtcaaatctccctgctctgggctgatgaataaaatgtgtcataaatgctcagaagctcccccagtgtggcctggaagcctgattttatggaaacttactgaaatgatacaaaacgctaaagatatgcattcctaattttctagcactttcaactccacagggatgttgggggaagggattaatgagcttggagaggtggaataacctcctcaaggtctcccagctgggggaaggtaagcactggatgttgggaatcaccagcctcatgtgcaccaaccatgtcgccaaatgtccaaagcctgcagagggcccagggctctcacggaccacacagggaagccactgcacctgttctttttaagactgggaggagagtggggaaaggcagcaggtatggcttttgaggtcctctcctagcccagctggtgtctgatgctggcacccgggcttggagggtgagagtcttgggacctgtagaccaaggccacctcacttgggcagcccaggcctgctggacatgggccttctgacttagtttcaaagctggaccctgacccttgttggttgcaggacttcagtgatttaatctttgagtttatctgtttcattggggtgatggtgcctgccttggaggagttttgtgaagtgatgttaatgaaggagcttaggccggtgacttgacacatgcccaacataaggaatgcctgtggggccgcctggctctgcccctagagtggagggagatggtgcagagggaacagtagaactggtatgggctgcggatgcctggcgagtggcatgagtaggggagaaagaagcgcctgccagaatgggagtgagggagaacagtggggggtcccctcccttaccacaagacctgggatctaactgtgcctttagatcagagcttctcaactggggcacttttgctcctcaggggacttttagcaatgcctggagacatttttggttgtcacagtcaggagagggatattatagtcctttaatgtggagaggccagggatgccccctacaacaaagaattacccagcccacaatgtcagtggtactgaggctgagaaaccctgctttcgatgactcattctcaccagcttgttatgaggatgaatgcgaaaatggagcctgcatttctaactgcagcctgcccttccaggtcctctcgttccctcaccctttcccaagggggctgcctctgtcatcaagcagcctggtccaggagtcagcagacctgaattcaagtcctgactcctcatgcctcagtgaagtttttccttagtttctagtctccatgtcttttcatccttggaaatcttgtcttgagtggggcagtggtgtctacacagtaatggggctgtggtgtggactgagtgggaacccggatgggaagcatgcttagtcagctgtgatgtgccggcaaagggaggcagcaggccaatccgctttctagtccagcactgaataatagccttggggggcattgcccaggaacccccattggcccctgcgaggccacatggctgttctcccaggcctgctccatcttgcttcttgcttgtgtttccttgaacaggtggagctagtctccatttggggaagatggaatttgcaggaaaatgcagggctattatttctgtgctgtgtgagtgggagacagagctggttgagtggcagatttcctggcagggggagaaacagctaagtgtgccagcccaggcatcgctagaatcctcttgaggtgagtgggccaggattccccagtggccacctcgggaagcaaacatttgttctgagctcaggaccagccccaggaaaagatggggtttgctgtcggggaaaggtctgtaccaatatattgaagctctgagaacattctactcggcaaactttcactgatgcccattctgtggcaggcactggccccggggacgttgggggacacagagatggatgaggctgagggggtgttcgggctgccgtaactctgaggcaaggcagactgtgctaagtgcggtagagaggctctgcatcccgttaagggcctgccgcggatattaatgtttggaggcttcttagaagaagtaggggttgagctgggttttgaaggaaggtagggcttcatgaggcaaaagggaatgcgtgttctgagccgaggcaacagtaggggcagaggctcaaagttggagagtgccatgtgttcttagggagggctggagaggtaggttttcctagaagttctgggaagagaagactggagagggacatggagccccctgcccgtgaagctggtggagtagtgggggcttcacgaactaggctgatgaatttgcacttttgtctaaaggcacagggaacagtggaaggtatgtgagcagggcagtggtgtgctccagccacagcatggaggatgggttatagagagaggaagctggaagcagtgttactgcgatagttgtgaaaaggaggaatgaaggcttgaacccagctcggggcagtgggaagggaagatatggggggaggtctggggaggcaggcagcttgtcaggcttcacctttctccatcctgggtatctgagttgtgtgtgaggctcgaagtgactgtcgtggcccactcgccacattgctctgctcaaagcccagccttttcttggagaatgacaagcagcgagcatcaggcagccttctggtcccagagaacaggatggcacggtgcccacaccagccggcaccagccactctggctggggagggggggaggcctccttctggaactcatcagcgctggcttctggccaggcccaaaggaggtggaatacaccctcttcctgctcgttttcagagatttgggaggagtaggtatggaggacagcagcagcgtgctgcagccggctactctcgggttcgtgtcggagctgggggagtgactggctgtgcagttgggcaagttgcctggtctccctgaacttcagtgtctgtgtttgtaaagtgggcattatgatgcttggcccacgggtggctgtaagggcatcacacaggtgtaattacgcaggtgtcatgttcttagctcaataaatggccgctgtttttaattgtcaagatatgatgatggacttgacttgatgggtggggagaggcaagacctccttgcctttaaaggagttgaagacttgggaagcagttggaatggtgaattctatcttgggcgtgttggctttgaggggctggggaaaatcctaggatattcagaagaaatctagggtcttctaatcatgtggttcacataaatgacccttactataatatctatctcagagtcaacttttcaagacaccagcctccctgcaggcaaccccagtgtggcatcaggagagcggggtcttgggtcagcatggccagcccagcctctggctttgcttgtgtcattggtgactccccgtggtcctcggtgccttcctccgtgatggcatttcccattggctggctgggcctctgcccagggatccagctgggtgccggcccagctcaggctccagagaggaaagagccctggatctggggccagtgacctgatattcacgctggctctgccccttccctctcggtgtggcctggagagatgtgcaggctccccgagggcaggggggggtagtgaggagggttccaggagatgagggatgtgaaagcagcagcacgtgcctggcacacaggggccctggtagatgcttggcggacaagtgagggcaggcaggggagggggcagacaggattcagggaggcaggcctgggaggagcccagggctcagggaggggggtgaggggtcaggcggagccggctcaactcctggctctgccgcttactagcaggaagactccgagtccggtgcctgctttggtcacatccatgtgtgggtggtggcgatgggaggttggccttgggggccgctctaatgcctacctcacaacatagtgataggtctagatggatacacagcaccagggcctgagagtgctgaataaaccttcattcctcctctagtaagcacagtaaatccctagagggcagtccccaaaggccttgattaccccaactgtggagtacagcgagaagtggagcttctggagccagtgctttctctgctcaattttgtgtattctttcactcgttcatctgaaatctgacccagccccatggaaactggctgcagacacccaatggcagtagggtaccaaggggcaggggagcaatcggctcccggtgcagacaatgaggggtacactgtctgtagaggatatagaaaaataaataaagccaacaaaaagtctggtttttgttattgccgtgtaccggcacttctaaacaaggtcagtgataaaacactcctcctcccggggggcagacgctcctggctccccctcagtatgctgctgcctaatcgtcctccagaaaggagcctcgggggctgtaaatatcaggaaggaactcagcaaggcctggcagaagaagccagcgatgatttggagaataagcccattgatgattgcaatagcagcatggatttggggctcaggagaccaggaaggggagggtgccacactgtgaagtaagggtaaggcaagagagtggaggtaactgctgtgggttctggctgggagaggcatcgtctaggccctttagacgtggtcaggaagagggtgtacttcatctcccttgggcctggcaggaagccagcgctgatgggttccagaaggaaagccccccagccagggcagccgctgccagctggtgttggctggtgtgggtgctgtgccaccccactcttttggaccggcaggctgcttgccatcttccaaaggggactggcctcttgacaagggtaggaaaggagccagggctgccctatgggcttgggggctggtagggcgttggggaaggcaggattcacatttctctagcctggacaacaagcatgtgcctgaggatcaaaatgagcacttttagggttttattactattatttactaaacaagtttccttgcagggttgtggaaggggcccatgcagaaggatctgtctagaggaggaggctccgcatgtgtacaagggaaggacgtgtgcccttgggactggctggggcacggccctagggaagtgtgtgtgtgtgtttgcgggggtgctctggtcatgtggccccttccctgactgaaccccttgcagggccccatgccacacagcaatgctgcgtccgttgcagaagcagacacctttggctcctgctgtgtgggaagcaggtgtgcattagtcaaggtggcctcagtggtcctgggtagtggggcccccgcagtgagaaaagcagagacctcttgggcccgggggtgtaggagtcactctccctgatctgctcccaaatgcaggtgcatctggttccatttggagccggtgagctggctgatggtggctgtctggggctcctggggctgagcagccaggctaagcttagcccacaggcacttcccagaaactggtggcactgtcacagtgttggctggatgctgaggagttggcaggatacagtgcaggaacagcaaataggttttatctgggtgtcaagttgaaacaattggtaccagcttccaggaggactgtgttgggaaggattctgaggtgttgtctgagctcaatgggaagagtgccctgattgattcatgaggtctatcttgggcaggggaaatggaagagtggcaaggggtttgccgtccctggtgtagtggaaaaaatacagagagcctagatttgatcttaggtgagtggccccagttttttttctctctctttttttttgttttttgagacggggtctggctgtgttgcctaggctggagggcagtggcacaatttcagttcactgcgacctccacctcctgggctcaagccatcttcccacctcagcttcccaagtagctgagactacaggtgcccgccaccatgcccagctaatttttgtgtttttagtagaggcggggtttcactatgttggtcaggctggtcttgaactcctgacctcaggtgatccacccgcctcagcctcccaaagtgctgggattacaggcatgagccactgcaactggccccctagtttcctcatgtctaaaatgagggtaaaaatgtggcccttccaagccttattgtgggcgctgagtaagatagcagagcgaaagccctttgtaaaatataaaaaagcgatacaaacccagagtgggggttttgttgttactgagtctcccaggaacctggagtgacttcccaataataacatctgccccactggggactactccatggtctgagtgcctgagaggcctgacaggatgtgtgaccggcgcggtgcccggcacccaggcctttgacaccaagtgtcaacgaggtgtttggtcatgtttccaactctaagtcacttcatttctgtctgactctctccctggcttaagatttagagactgttttcgtgtctaatgaaagaaggacagaaaatctctctctagaaccttgtctcttactctccattaaaggtagcaaaattgctttataaagtctaaaagcctgacaagaacgcgtactaataatgcatgaattatgcaaatctgtgtagtcacttgatttgcataatggaggggctggaggagggttggggaggggaaggagtgagggtgagggcgtctgcccagatctgtgtgtaacgggggacattcatttgctcccttgggtggagtccccttctgcaagcccctgctggtcccgagggtgtgttctttggccttcccctgctggcctggtgtctgccctttgtggcctggctgtgcagccccccctcctactttcggggcagtcaccgaggcaggggcaccgcaccctgtgctggactcttgtgtagaactggcttcattaaatctcacagccgcccctccatgtccagacagccttccctgaaagtcccctgggtcattatttctccaaacgtctgtcttgctgaggcattggacttcgttaagtgccgtctggaattgtaactattgccaagtgcctttttcttgggttctgtgggaagcaagggtgagaaggagtctccgggagagaactccccacctaccccgcctggtttctctctcagcgtttctcactgttgctttaaaaggtttcagcctctgctgtaaggggcctcttgcttttctctcccagcctccctgcatactcgctaaccttgggacttcagatttgatgaggggccgggcgcagtggctcacacttgtaatccctgcactttgggaggccgaggtgggagacttgcttgaggccaggacaacatagccagaccccatctctattaaaaaaaatatttgatgagggctgaggctgggactgaggatacttgaggcttgagctcagtgggtgctgcctggaagcccggggatgtgggctctcaagctgaagggacgctgggaaccagctgtggagagccaggcagctggcttttttgtctagaacctggatggggcagcttcttgttctggggaggggaactgttctgcagggtggatggatgcagggagccagccctggttgggaggtgggaggggcagggaccatatctagctcctggagaggccaagcagaccgtcaaggctacaaacaggctggggttcagcttatttcaacatacttcttcagcatctatgtctatgggctgggcttgtgctaggccctaggtgtcagagatatgaaggcactcatagctgtcatttattgagctcctattataagtgtcaggtccttcgctaagccacttatttacacgtgtcatctcatgtaatgtgtatgacaactttatgaggtcactactcttactgccccattttatagatgagtaagttgaggcttggtcacatggcgaggaagtggtaaagtggggctctaagtgaggtcttcggactccaaagccccttctgcagaccgtgatgctttgctgcctctgttgagtcaaaccggactcttcccttgaggccctgatggtaacagcagtgtaaacagatggtgagcacagtgtagtgtaatatatgcaaggggagaggttggaaccaggcacagaagtagcactgagcatttaattatgtcagggagggccggggaaagctcacagaggaggtggtggggggggggtccctgaatgagccacaggagggaaaccagattctgtctggcacttagggaagcagccagtggaggctgcaggtcagtgggctggggtgaggggtaggggctttaaatcccagttgcttatagcccccttctgccccacttttggggtgcgaccaggtgatgtgaagctcaggaggtcatggctgggacactcaggaaggtcaagtgtggggtgctgccccagggcccctctcctcggcctgtatgttcaataggtgcactggcctccctgtcttggccagacagctctgagagccagggctctgtgggtgcctgaactgtgtgtggaccctgcctgggatgaggccacagctgctcccacacccgcacctgctcacacccaagaagggggccgccatgatcactgtggaggccagggtgggagaaccctctggaccatagggtcccaccccattgcagggcaaagaggggatctgaggcccagtgactggaagtgatttgctgcaagtcacacaggcagcaagaagtgggtcaatcccccaaggttctggtttggagcactcccgggggtctcccctcaccccttaccctgggctcgccctctccaggctgtgtgccatcctcaccacctctgtcgtgccctcgctcacccacgtggctacactctcgcgtgcgtttccctcacacctggccatcctcttaggccaggccaaggctttgctctggagagaacttaaatggcattgtcagatgaggaaggagcagaacctgccgatcccatgacctcccaataggccatctgcacacactcagcccgctctccccagccctgcacagccccttcggctcgcacatctcatccttactcctgctagcaagcaaagatgtctgcaggtgctctcattcggggatggggatgtagtagggagacaatacctggtagatagagctgaacaactttctgcagaaagtttggagtgaggggggctctgtgatggaataacaggcatgaaccagaagcctaattctattgcttagaagctgtgtggctttaggcaagcgacttaacctctctgagtttcaatctccttattaataaaacaggtacgaacagtgccttgctcagtggtcccctaacttggcttcattttggaatcccctggggatctttaaaaaaatgctgatgcctggctcccagcttctgacctgatgtcaccgccctgaggtgcaacctgggtgtggggattttaaaaagctccctgggtgatactaatgtgccgcaaagtttgggaaccactgtcccagggtttgttggggattaaaggaagaatgcagacacgtggagagcgcttactaaatggaggtgattatttcagtgttcatctccctgcctctcactccatttaatgtggagtctgtgggactgaggtttttatttttataccacagtgggtttgccagagtgctgacctaagggggctgtcagcggcccatctttacccggaaaagcccctcccttgcgccctcaccatctctgcagccctagggcaggcctcagtctttctgacaggccccagggtcctgattaggccggggcctgaccccgcaggggcaggcctgcccctggtctccacctggtggctttgggaatggaaatgctggttcccacaaaggcttctgggagacagaagcctaagatggcagggtgcggtgcacacactcagtctggattcggtggcctgacctgggggatccggggagggcgttggtgggggcagaggcgtgggaggggctgcttctttggagctctccactctgctccctggtactgtctgaggccctgcaaacctgagcagaggctgtgagggaagacacatttctccagattcctcagctgtcctgacaggaagttgtgcatcactgggctgacaggaaggaaatggctctgctgtttggaaagaaatagagaattctgactggggctgagggaaaaggtgtctgcttggagaagccgttttgtcccgatatgaggactctttgtctctgcaggcagttgctccctgtttattttcctttgaatgacaaggattggcttcagttaatgaggagcggtgagaggaaagtgagaagcggcttgtgagattttgggacacggaagccttcgcaggaaacctggccctctgcttgtaataagcatctttctttcccagctccctgcttcggggactgtgaggtgacaaaggattttgtgatctcacacgccgctttttctccatccaccaaccatacctttgcaaatgctttgatttctatttctttttaccaccccaaaaacacagtggatcttttaatagcacaaggccttttgaatctctaaccaatcagtctccaaatcctatccaaagtgcacttagaatagacacttttaataaaatatattgcttttaagccagtgtaaacctgtgaaatttgtacatttcttttagagcatctctacaaattttacattattgaaatcaccacccagtgaccttttaggaaatactagataaattgcaagagacaaatagacaaaccaaatggagtaagtacaatttccagtgcctttcctgctaggttcccagtctgagtcttagaaatccctgactccctgtgcccctccccccagctctgtgacctagcccctgctctgcaggcctctctgcccaccctgcccctggcaaggagctagcagctggggtgtcatctgagagccatttgcagctctgagaagcagctctggtatgtggctcctggcaccttgtcccgtctgtgtttgtctctgcgctccatcattcaaaacacttccaccagtggccagggcccccagaagggctcttgggggtggctgaggactgctttagaaaggctcagatgctctgtggccgagtctgccccaggcgaggtcctcagccttgtcgagtgagagctgagcgggggtctgagtccagcaaccctcactcactgtggagcactctctgtgcctgggtcagccaggtgtggattatccactttgtggattgcctgtagtgtcttttccaaacccaggtcacgttcgtccctgctgctgtctcactgcatggggacctttcctccctatcagctggtggtgcttaggggatgtaaatcaggtgtcgtatcttgtttgtattttgtacagggaaaacagaatttggaagacagatggtctctaaaatcacattaccagagcctccaaagggtctcctggaggctcagtgctcctttgggctatgggatctgttccccttctggtgtaggtacgcagagccttggagcagtgatgggggtggagggagcacaactgcgccctgcttcctgaggtctgcagatcgcaggtcactcgatggtggcgggcacgtggttatgcactcatttcatggataagtgaactcagtcaccatctcagctgctttgccatcgctacacagcgacctgtgtcagcaccacaactgggagtgttacttgggtcccctgtatctcagttgctgtttttcccatggagtgacccgactgccctccaacatggggagggagggagagcagaaggcagatcagcggttagagatgtcctgagtggcactggcccttctgtaggtaaagtagcttcgggagaaacaaggtactgtcaaagctgcccaggcttcattcactccttaatttgataattaattccacaaacattaatggagtttttctcacattccaggcactatgcaaggtgctgggggtgggggagaaacagaaagatgacaaagacttggttcccacactcaaagagctcacagcctggtaagcagatgctcaacgcacttagaattgtctcccgaagaggcctgaagggacagggtggaggaagcgcagaggcggaggcagctctggagggtagggtggtgggagtggagagaacggagccggtcctgaaggttgactgggaacgggaaaggctaaggcagggaggttgttcccggcccagcaagcacatggaaaggttgagggaaacgaaagcttagtgcattttgaaggagtgtgagcaactcggtatggctagaatttatggtgtgagtatgagatatggggctgtagaggcaggcaggggtcagatcatgccttgcttagggggtctgccttcatcccagaggctgtggggagccgcagaagggatttaaggagtgggatggcacgatttgtgtcttaaattacttgctatggaatctacatggtatagcagaaggagcccgggagtaggggaaggagctaggctctagctctaaattctagatctggatctagcagctgggtgactttggccaagtcgaggcctcagggtcctgacctgtaagatgcgaagactctaaggtctgtcttagccctgacgttctccacacccgtggccgccttcctgtttggcccccacactctctgttctgtacttgtccatccacctctggccgcctgacccctgtcagctggctgtcccaccgtggtcagcagctggtggcagctggagggagaggggtgagtcctccaggaagcatgtgcactcctgccctcgtaattcaggcctgcctggcttctcctcttccagccctgcgagagcgccttcctccccgctgacctcagcacacctggctccccacggcacacagccctggctgggcccagctgtgtctcttcagtgagacagttcacccccttgggccaaaatccccacccacctggcccccacgtgacaagaggcagctgcttcggggttgccacctggtagcccgtgacatctgtgagatgtctgtgcatttggctggtgtgagctttttcctttgctctgacccaagctttgatagctcagtgtgtcatcaccggcagtggatgcctgggagccccagactggctcttcctgcccagggacccccagacccacttctgcaggacgccttgaaacagctgtgggtggaaagccaggttttcccccataagcatcactcgttctgctgccttcctagcttctgtgctctcgggcccagagctcctccagggtgaggaaccaggaggaggagttggctgggttggctgttttcctaggtctttgatcacagctgttacatgtagataggctgggcgcggtggctcatgcctgtaatcccagcacattgggaggccgaggcgggtggattacgagctcaggagatcgagaccatcctggccaacatggtcaaactctgtttctactaaaatgcaaaaaaaagaaaaacacaaaaaatgaaaaacaaacaaacaaacaaaaaactagccgggcatggtggtggcgtgcgcctgtaatcccagctattcaggaggctgaggcaggggaattgcttgaatctgggaggcagagattgcagtgagctgagattgtgccactgcactccagcccagcaacagagcaagactctgtctcaaaaaaaaaaaaaggcttaaacaatgggttctaagcaaataagtatctgtttagtcagtggaacgaggaaacaaaagttgatggagttctccccacaattggaagtgttgttccccacctagatgatggggcctgcagggaagtgattttgcacgattctcctcttcttgggaacaggccatagggtagcatcccttcattcattcatcaagtatttattgagtgcctactgtgtgccaagtcctctgtgaggtgatggagcagagagacagaaaggaccccgactgtgccatgaagcagccccgagcctggaggggccactcagagggagcccaggggcggcggctctcgggctccagccgagtttccttcagacctagcccctttagctgacaatcttaaagcctggtcccggaaaacaggaatagtgcgagagggatgaaatgtgggtgaggagagtgagacaagggtggaggtaagaaagagggatggaagaaaagacgcagcaaactttcccgtgagagaaacgctccagacagcaccccagttcccagctgagactcccagccacagtcagcaagaacccacaggaggggaggcccacgtccctgctcagctctgccctggcaagtggggtcggagatggggcattccctgcttggggtctcagtctctccatctgtaaaacgaggctttggactaggggagctcagagatctgtttagaactaatattctgtaaccggtgcagggcaaaatagacggggggcaggagcccaaattaaggccagtcgagtatcaggtggggtgttcctctggctcctcctattacaacagcaagagggacccaggggtactgtgggagtcctaccatctcctcacttgtacgaggtaccttctggctgctcttccggctgctcaacactcaaagaaggaaggtgctgggtgtccttgtttgcatatttttctggcacggacacattcttcttggagtttcttgacattagggccacttgaaatgctcaaggtaagggctgctctgcctggcagacatgcgtcaggtgcctttggctcctccctggcaagtctgcctccagacgccctcagatcctgtccccatgcctggccatggggctatctgaccactgatgccagagggtcacactcatcagtctatacagaagacttggaaatgttttggcaaccctgtgttagaagagtggggtttcctaactgtatggctttgggtaattgcttaaatcctcccagccttagtttttccatctgtgggttaggagtggtcctctctacctcccagcatcaaataggaaactgtgcaagaaaatgctttgtaaacaggaaagccctaaactgacatccaggacacagtgactcagtagcaaatatattctgatattcagccttttccatggttacagcctcctctgtgccaagaaattcaagtcaccaagggttaaagcaagcaaggcacatggccgtgattgtccataattgatgaaataaaccttaaaggagtgacatataattaattgcaattaatccaggcactgtgacaccaccttgctaaaaatactgtctactaacaattgctttgatccagcagaatgatgtctgcccatgagcctggcaaagtgtctgctaatggagtgcacatagtgggtgtggaagctggcaggtgtgggggcagagggcgggaagggggccccaattctctcagaccctttggcagcaaatactacatatatagggtgatcatatgattcattgtctaaactgggacacttttgagattattatattaatgattaccattcatagtaataattatgccagataacaggcatacactggactctcctgggtaaacccgaatgtatcgccaccctctgcataggctgttttaagcccgtgggaaccctcgactgggagagtattttcacgttcattatctgctcttcctcacaacaaccctggaaggaagaaaggattttttagtctcattgaatagatgttaaagatggtgatggtgtcaaacggtccagctctagtctttggcctggcttcctcggtggctgaccccatgcaggtagaggacagctggtcaggaccgggagttctggggatgtggaaacaagtgcagctcagggggaaagaagtagcaaatctggcttcagtggagcaggaacaagcgacctcctccgtgaagagctcagggtgtaggtctcagccgggactgtgctgcggtccttaccaatcctgggcttggaatcagaagctgtgtgtttcaagtctggctcccacagttcagctgtgtgatcttggcaaattgtataatcattccgtgcctcagtttctcatttgtcaagtggggacagttccttcctgtgaggattaagtgagagtttatatgaagatggatgggtagactcagagcctgtcatataacaggtactcagtaagtccttgtagagtttgaatctgtggagagttcctagaggcaacacctgtaggggaaccatggagatccttctgccttgaaatggctctaacttgaatcaattagtgtggaatgagctcccgccttgagatggggctgcctcatgttcttggagaaagaaatggaggaaataaccacatggaggaattgggaggttccctgaccccccctagaccatggatagtctacttgggagactctactgcatgccccgtgataggcaggaccagcacccaaggagtctttgcatcttgcagtttccttgaagccctgtacaggctggtggcccacgttggtgtgtggcttccagccttcctccaggctctcagatgaacatgcttggacatgggcaggcagtggggctcgtgtcgtgccccattgctggaattcatggcacctcaaagtaaaaggtaggcaggttggcagcagtctggtgccagagagctagtgagagagagaaagaattatacaagtgccatgtttggtctattaatagcctgtgtttggtctccaccacttctatcaacatcgtccatcacatccaaacaattgaaaaacctgtgccaaatgttaggaaactcacggctgtgctgtttctgaaaaacagcatttctacttcttatgccgcactgagatgccaatagttccatgccaactggtttttatttttccagaccatttccctttatttatgtttaagcttttgtattgttaagccaaaagaagatagagaacctggagtaggtaattattgtttctcctgatttgtccttgaatgaggcatggaggaaatgttcactccccaaacctgaattgagtagctgcagaggggtggagagaggactaagacaggggcctgtccctttcagacagtgttcaagctggtggatgggcagagtgaggatgtggcagaacaccagccccacccttggaaggcttagggcattatcagccctttctgttactggtgtgtggccttgggtaggccagagtccctctctgggccttaatttgcttgcctatagaatcggggagtcagacttgatggcttagaaggcctcttccagctaagtcgagtgttgggtggaggactcactgtctcacgtttgttggcaaggccgtgggtgtggaaatggaaggaaggtgatgctgccctcagaatgctggcaactccgggaagcctggaagcatggctgggaaacacggacgaggctgttctttatctgggaaactccagaacagcctccagagatgtctgtggagcctgcaggcggttgtttttctcaccatatgtgatttctgggtgtcttaaaaattttcatttggcccaaacattgccggggttgggggatgattttgcccagtgtggggatggaaatgggtttgcctctgagcatcaggtgggtagtagtggttttctccattttggaattctctgacgaagttggaaggttcagctggggccctagtgttgcagcagcttctggtgcagacagaggcaagggctggagggaggaaagggggaaggccaattggaggggtgataaggctgagagacccagggtggggagttgtctgtaggccttgctttgtgtctttaaaacccacatacctctctgtggctatcaggtgatgaaaatcaacattatttcaagttatagccatctgaaatgaatgtagccagttccctgtaattagctgaccacagctcctgcagagaatctgggaatctgttgtgcgtcttgtcagcgatggctggggcaggatggggaaagggaagcccaggcctgggacaagcccagctaggctggtttggttctagtcagcaacccagtctaacagggagcccacagctttctgtagagcaaagtgatttcctgctgttttattcatttgggagccagataggttttactaagagaaagcaaaactacttcaaagcaagccatccagaaagcacaattatttgtttcaaatattctagaacatttaagaaaatgggggttcctgcaatctggatgaaatatgggggccagatccttggcaggtggagcagtaaatatttgctaggtgaacccctcatggtgatggcaaattgaccagcgttctgggaggcgctaggagggtgaataaaggttaagtgtttcactgtaactctgtacaccctggatgccaggacagatctgggggctgggactaggaaccttcagtatgctatacagttctcctgagataaaggtatggtgtcaggaccttcagaacctgatgcatagtggcaggtacgcattcatcaaagccagaggaggctgtagggacttcttgacaccacaagagtaatgtaattgctaactggccaagagcactcacattccacaagcagaggaggctaaaagctcatcaggagcccatttttttattggagaaggaaacagtgactaagtgacagtcttggaggtgacttccaggatagggatacaggcttttggagaacagatgaattcagggaccggttgttatatttccgttagtatgaaaagcagggtgggccgggctgcctgcccctgtaagcataggccgggagccccaacacctgggttctaaagttttctccaagccaggatgctgtatgatgggggcaaggcagcctcagtgtcatcgtggagaatgagggttggggaactagctgatctcctggtgttctgtacgttaatgagtgtgtgtcccagggagaggctcacttgtcaaagtcattgacatagacaccgggatgctaaagtcagagcaggtcttcacagaggcatttgtttcactgggaccaagcactgcaggcagatctttgaaaaagagccatccaaaatagagtctctccagggctacattgagaggaagtgagtttccaacccctggagaaaatcaagcagagactggatggccatgtgccagaaatcttaggagactcatggggcactgaactagatggcttctaagctccattgcttgtgtgtatgactgtctgtttcacagtgtctcagagctgtgagggcaaccccagcctcctggcttctttctttgtgccccagaacagcaattctcatttctggcccgcacattagattcactgagatctttttttaaaagttagtgcagagacctcacttgcagagattccaatttaattgctctggggtggtgccaagcccctcagttctacaaggacccgggctattggtgcttgatgggcttccatcccacctccatcctccctgtaggggtggggagttacaaacccttctgctcccattctgcctttgtatggagcccaaaggtttaagtctgtatttaccgttccatattcatttacccaagaaacacttgttaagtgcttgctttgtgtctgcaagaatcctaggtgggccagcttttggctacctgaggagcagcaaggaccaaactgcctttaaaaaggcctcatcctgtatgtttccacctcccgcacagtgcctggcacatggcaaacatgtaataaaaagtttgattgaatcgcatggaatctttgccaatattgtaagtggggcaggaaaataaattataagcaagcatgcagtagagaattcatgatatgccagttcccctctgcccagaccttataaaggaaaccatctccttaattggaattatgtttgtggcctgaaggggtgccccgtctgacttgatattttgggagcgtggtctcctaaatgacctttttctgccttccttgggacatcacacaatgggagagccagggcctggggaggatcattttctcttaattggtgtcctggtcatcatgctggcttcactaaaaattagtaggccaccctctgctcagacctgaatgcccttgttattaactgcatgatgtccctcagacatcaggttccgtctccttctgggagtggcaacgtagagatccagggaaatgctccagggcaacttgactttatgagttttgtgtcgagaccactggcttccttcacgccacaagtattatctgcctagtttccccgtgccgggcccagtctgcagagacggtgaagaccccaagccctgagctcagtctgttcaccatctatcacaccactaaagccacacaactgggggcttcttcagagagcaggtgggaccggtaagggcagggcctgcaagggtgatgttctggcaattgccatcctgtcttcctgaggttccctctggatcagtggtgagagcacaggtttgaatctagcccccacctcttcctcatccagggacggtgggaatgtgaccctctccaggcttcagatccctcatctctagaatggggccatgggttgttctgaggacctaacgaaattagcacagtacctggcctctggtaagtgaataataaatgttagctgttactttcatcacctctctttagttttgatgaatttggaaattcaggatggaagtgtctacctgcttgacatatctcaaaaattttgctcccttccttcaaatattcaacgttcaactaatatttattgacttactatgtgccagaccagtgttctaggcatggggctctaggagtgaacaaatgcaatgtaaaaattccctgccctctggggttgacactctggtgggggtgtgagaacaacatcagtgggaaaatggggtcagatggtgaaaggtgctctggtcaccccagctgggcagtgccaatgggagacaccaggcatggccagcctcgggaagggtgtggggcccagggcagaccagcggggttcctggtgctgaggttaccctgtgtactattaaagcaggtaatggctcccagcttcgatggtgggtatatggaccccgttcagggatgggggctgaggagggcacaggaggactgaagacagggctctgaggagccacctgctctcgggtctaggtcagaccccgcatcctgatgcgggtcagctggctcatgatgcctggctggctcctgggactgagaggagagtgtggatggtcttgtctcagctttccgcccactggggatccacctcaagcatcccctggctgtggggttgaggggtgggcccagaacagaagcttcatgtaagaaggtgactgggctggagaaaaggtggcagtgaggtttagccccatctccagcccctgggacctgtggtaaagatgtcctcacccacacagtgggctcaggcaggcaggaaaggttcctggagcttggcctctaatatccattcttgagctctgccgtggagagagctggtcactcgagcgcaaaggaaccacttgtgggttttctccctcagcctgggcttcctgcccattcctggctgtcccagcctgatgtgtcctccagggccccctgacctgacccttggcccatctcttcttgaccttgcactgtgggcaggacagagaggccagggagagtgtccaagagggacaggatgggatgtcaaggtgacggggcgatgatggtgcagagggcagcccttgggatgagctcctgggagctcctggatgggattcaggctcagcaggttggggttggagcgggtggggaatccctggcatttggcaattgcccagcacagtgcctgggcatggtaagtgctcagtgaatatatgttgtatgaatgcacaagtgaatgaatgtttggctatgcggattgcaaaggtgtctttctgaaatgcctcagggatatctttataaattattgcagccataaaatgctgatattgggggtgcagtgagcagctccggactgaggatcagctgcatttacctgcactgacatctgtatggcaagagaaggggtgtttgactacaagggaatgcatgcttctctttgtgtgaaaacagaatgagatttttcgtatgcatgatctcatctcatcccctaacagctgtgagaaaagtaagggtagttcttgtttgcagagaagaaaccagaggcccagagaggttaaaggaccgatccagtgtcacacagctagttagtagcaaagacatgacttgaactctggccttttggtttcaaatcctatgttatttagaaagagacaaggaacatcttcgttagcccccccatgactaaaaataggaagcttgccttgttgtgtttgaggagaagatggtgtgagtgggttttgtggctgaccgtttcacacccaacatttcatcacagaaatgcctgggaaaagaaaactcctaagaaaaaaaaaaaaaggaatgagtgttggacatgtccctatgacctgtttgtcatggcatgtgtgctcggcgccttggtcatcaggcttaactgaacttcggagaaggttctgtccaggagtctcattttactgggggctgaggcttaggagaaggaagcaacttgtccaggccaggcattcactatggaggaggctgagactcctgcgccctcggatgcacaccctgggcctctgttccagagctgtcttggctagcaagtatcaggcccttctcccttctcaggctggtcagaggtccagctgccctctggagtccccagagtctcccttcccactgtgacagcatcggctgtctctcccggtctcaggttggacagtcctgggagagagagggtctgagtgacttcattctgtcacttcattcattagtgactgaaacaggattctgttagctgacttctggtaggagccaggttgggaagccgctctgaggatgctgggagggccaacagctgcaattattattattattgttgttgttattattattattattattgagacagagtcttgctctgtctcccaggctggagtgcagtggtgtgatctcggttcactgcaacttctgcctcctgggttcaagccattctcctgcctcagcctcctgagaagctgagactacaggcttgcaccaccatgcccagctaatttttgtatttttagtagagatggggtttcaccatgatggccaggccggtcttgagctcccgacctcaagtgatccacctgccttggcctcccaaagtgttggacttacaggcgtgagccaccacgcctgggcttgcaattaaattagggtgctgcacctgggaggaggaggctgtgctaagataggagctgaggatgatgggtaagaatgaaagatcccaagaactggacagtgtgagattgaggaatgaggaaggccagggcttggtgctgatgtggagggaaagaagcctcaggtctccatggagaacagcgaccagtgatgcggtcttccctttagcggaagaggggctggtttaatttgcatagcattaattagcaagagtatctaattaggacaaccattacagaaccacagtcataagccgatgttgaatatcaatcaattttggagcctctccatgaaattgaaggaaaagttgaccttattagatagaaaagatttctaaatcaattatttcccagattgaatgcacaaaacatagtgatgtcaggcaggcacatcagaccttaattcagaaattatgaacttcagatactatcaccttttccctttgggggtttcagccagtgacagaaatcgtgaatggaccacatatgtgtataaacacacacacacacaaccatacacatatactctttgtgggtaacagcttggttggggaaggagcctgcgcatcattatctcagttaagctaatatttcagtttggttcagtgcccctccaggtctctgtctgtaagcatagctttctcctttttgcgatgacccaaacaataaaatacatttagaacttcaaagtctctgggaagatataccataatcattacagttctggcctgtttttggaagctacaaggcaggccaggagagcaatttatgtggctggctcagaagctggggaacacactccatcaccctctgcacagcctcaggggaggaaaggctggaacagctctaagaagcctcgctgcagatattggagggccagcaaggcgtggccgccagagcaggtggggtgctgggacacaggcggggcaatggaacctggaggcagacagatctgggtgtaaaacctggcttttgcaaatcctggctttgccatggtgagaagttaggtaacatgcccttggacaagttacctaacttctgagagcttaagctttctcctctgtaagagtgggttgacaatgccatccttgcatggtaggcccctatagatgtgctttattacagattattgtcatcaatgagaaatcacagatctgtgaagggctggctcgtggcctggagcagaacagggaccacatggatggaggcagctcttaggaattctattgacatattttcagtctttttctacactaaaaaagcttaaaaatgaaataattggaaatatactacatatcgttttggggtctgagtttatcacttaatattctatcatcaaccattctccatgtcttcagatattgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgatctcaaatctacttaaccacttgtaaaatttgtgggcatttaggaataaatgactttaaaacatgactctcagctgggcgcggtggctcacgcctgtaatcccagcactttgggaggccgaggcgggtggatcacttgaggccaggagatcgagaccatcctggctaacacggtgaaaccccatctctactaaaaatacaaaaaaattagccgggtgtagtggcgggcgcctgtagtcccagctgctggggagactgaggcaggagaatggcatgaacccggcaggcagagcttgcagtgagctgagatcgtgccactgcactccagtctgggagacagagcaagactctgtctcaaaaaaaaaaaaaaaaaaatgattctcatcaaatgggatataattcctaagcattcctgtgtgttaaggattgttactctgtgttgaaaagttctgagtcacggggcagaagggttgaccagttgaccgctggattccctctgttctacaagccccttattggtcctcagataggagtgagtgggggcaatgcgtgtggcaggtaccctatcctgggatgtatggcagcccggtgtcactgccatcccccaaggaaccatatcaatttcaagcttcactgatgttcaggcagcaaagagaagatgctaattcaacattttaccaaatagaaaacattcctagttcagccagacttctttgacatgttttccagctattaaaagcggttggttaattttttttattgacatgcgatggagaatgcaaagaaatctgtaagatatcgagagtccctgttgatccagcacacagcttggtcatcccacggggctggagctggccagggaggttgtactggccaaaaccaagaagcaggtgggagttgcctgttcatgtaaaggttttgagctttaggacaaaaggaagaggcccaaaggagagagcatctggcccctttcccttcactgcttcctttaaaatgatggaaatagacttggattctgatgtcaattcattgctgccaaaagaaataaataaggggctgaaatgtgcagctgatcccaaatccttcccggggaggtgtgatgctcccagatgctttcagacccctttgaaaagaaagttatggtcatttctggatggaaaacattgtgagctgtccccagttgatccccagttgattgatgtagggaggtttgttttaccctaatacagtctgagtgttcctgaattcaccatttgctcttttcagccccatctgggtcttgtggttgggtagcatttcaggcaccaggaagtgcttgtgaagatcaaaatatttttgagggccagcactgtgttctgtccttctctgtgcttatgttggaccagaacagcaccagccctccttaggcccccatacatgtgtgctgagtaaatgattgcaggctgctcttatggaactgtggaacatgaagaggctaaaagaagactggcttatgtgtagatcatcttatgcatagcaaataatggagaccttttcccatagttggacgaccccatgcaatgtagaaagtcagagttagtgaataagccagatcagaagcttctggtgtatatcactgtatatatagaatctagcacactgttggatatctagcaagtgctcagcaaatgagaagtggttgaaatttttgtgaaagagtgaatgaattagttactttattagttttctttgtatctccagtgggcctcaagaactgtaccaattaaatgaatggggagattaatagacatcagggagagcactttcattccatctcagcacacagagtggggccgagagcatggacctgggcacttggaagtcctgggttcgagtcccaagccctcctctcattcttgtggttgccatattggacataccgcctcaccccacagatctcagctgctcctcacatctgcctctgaaagctgtctctgacccatccacagtggcctccctcctttgagctcccctagctctactgtaggtttcactctggcaattgatcatactctaccttaccttgttgtcttaagatgtcatttaggtctatttaaatggatgcttcccatgtttctaagttgtttcccattggagagtgtgcctgagggcttgtgggcagtgctctgtactgcgagtcagaggccttgactttgaattctggcacaagccacccaccctcctctgggcctcagcctgtaatatctataaggtaaaaggccgagggctgttgtgaggatggatgagaacaaatacgtgaaaccaccttgtaaactgtaaggtgccttccagaaatcaggcatcattcttctaatgaccagctccctgaggaagggaatgtttcttttgtggcgtgcaccactcaggaccaagtgcagggccgccatacacacagtcactgcttggaaatgcttcctggatctcatctgctgcctttgctcagggctgtgttcccgccttcctttggaactaggagctatctctacttccagcttcgaaatgcccagaggtgcaccaagttccaacccagacaccctgatttgtagaggatgcaaagtaaatgataagggtagttaacacttacttggccaggcactgttctgggcactttgcatacattaactcctttattttcacaacagccctgtgaggtagtccagaatattatctccatctgacacaggaggcatgctggtgcagagaggtggagtgggcgttccaaggtcaggtagccctaaatggctgtcgcagggctgggacccagcagtctggccccggaggtcatgctcttaaccacacttctcggtttctctaagctgccctgggactgaaaggctgcagtggaggccacggggctcacctcccccacctaatccctagcaggagggaccatcagggtacttctcctgccaggacccctctctgctcctgtgcttcctggcttctctctccagtagctcctctgccgtccctgcctccctcccctgcccttggcctaagccaggagatgagagcagctgccgggacattcaaattcattcctgaaagaattctgcctccgaaatcctctggtttgggtttaagagaaaacagaggcccaagctggcgtaatattgatgcccaaaccatgtaatagcggcacaacaaagaatgacgttcatatgagttatgagcatggaagcacaaattctaaataacacatcagcaaactgaatctagccgtgtataacaaacataatacatcatgcccaagtagcgttcatcccaggaatgcaaatacgacttagcccgagaaaacagaggctcaaagggggcagctgctgagacagagccggcccgggcacagcccaaggcttttgtggggctcaggctgactttgtgctacacctgctcctaggaggggctggtaacagtccctcctgtgtccccaccccttctcttttacacagccgcagaataaagtgagacgctcctttccccgcactccctaattctctctctccattgttcctgcaggactccatgttttcgttggccctgaaatgccttatcagtctgtccaccatcatccttttgggcttgatcatcgcctaccacacacgtgaagtccaggtaggtgcccccacctcaccccttcatgcagcggctgatcctttggccttgctctgagccgagcccatccccacccccaaaacccactcccttagcagctacttgggtgattttacaagacggtgcccaagatcgtggctcttctcttctggtttggacccaaatgggagaggaaactgcgaggccgccctgtggctttcgaataactgttaagttgtcttcaaagtggggatcccagaggcaaacatagggcttcatgttgagcgaggctgccgtattcgggaccctcactgagcaccatcggaccgggagagcccctgatgcattgctctgccttttgtgtctcttgtcctttctgaacttgggccactcagttcatcccttcagtgaggcagacctgccttgtgtacccccacatatgctgcaccaaactccaccaaggagtctgctttttgtgaatggtgtggtcttcacccttgtgggtctaggctgggggtgtcattttctagacagagtaagagtctgctgtggccgagaaggcctctgtttcttgctgcccaggagtgacttggtacccagagaaacattggctgggcctccagggtgcacttccagtttggctgacatagggaggatggttcaacccgggccaggagggtcagacaggagagaacagatctgaagcatcttctggtgacaatgagcttcccccagcccccggcccttcaggctgacctgcactgctgtggacctgagaagttctaaactatccagatgtttttcctcatgtgcatgtgaatctggaaaccatcccggtcctttggctggaggagcacagatagattcacatctgggcagcaggcgagagattgacgaagaccagagctcagagtcagaaaaactggggtcaagtctcggccatgaccttttttcttggtgtgtctttggccagccctgtgaccttcctgggtctcgatcttctcatctagaacatggggcctttattccagctctgctgagctgttgtgaggatgggatgaggagcgcatgggagagtgctttgtgaagcgctatttaacaacaccgttcaaatccagtcccatttgttactcggcattttcagggtggagcagcagtgcggacgcaggtgggagtgcctcctcctcttagagagccttggctttttgtctgaaggtcaggggccactgtggctggctgggacatggaagccttggctccaggccaccttggcagggctgcattctgtcaatgactagaggatactgacctggatgctgggactcttcagcctctaaagggttgcagatgcttggacaggggctgtgcctgtgccagatgccaccaggcagcttccttcatggagtctgaattggacagagtggtggactttaactcagaccattgtccagtcagccccagaaaggagccaggagtacaggcagggaggactagggccacggaatcgagacaggacagaagttgacagtctgggctccgggcctggttccaccccacccaaagccagccgcgggatccaggcagtccctcagtgttcatgttctcatctgtagggagactgtattactatgtgtcaccctgacctgtgtggggaggtgtcacacacaacaaagaaaaaaggcagaaccataaaactcagttatgacccaggcttgaggaaggggaagaagaggagctgttctcagcctcaaccccacactatggtggtgctaggcctgattacttcctctttctgctccaggcattggggtgggtagagccaggtgtccctccctctgatgctcctgaggtccttgttcccagtccagggcctgcagccctagctctcagcctgttctggtccagctgcagcttgactcagttccggcctggtggcagggtcatgttgctgacagcccagaacctggctgggtacccattgtcccatgtccagctcatggccaatctctgtttcagccctaatcatgggcagtagatgatgctattgggggtcattcattttggcctgacacaatttggagaaacaaagtgaaatcagttgtgttgaatcctgactctggggctcagtttccccatctgaagtatgggaaccacatcacccactttgctgaactcttgcaggggttggaaacagtgtagagtacagagtgggctttcacagaatggaaactttggtccctttcctgtgacctttgtcccactgcttctagctgggccttgcacttaccagctgggtccaccaggtggtcactatcacgactgcctggtactggcaggtggctgggcttcctcctgctctggcccagccctgcctgtaccctgagctcccaccacccagccccttatcctccctgcagcctccgtcacttgaggaaagtcaccaaaaccggcttcctctgtgcctcttacctttccagtaaagttctttctgtgcccagctagaccttctcttgccagagggaaatgggaacagtttgggcccagagagtcagtgggagggaggttcctacggagcgcccttgtatataccgcactgggccatattgtagttttctgttgggtgtctttcttccctacctcagggacagttatctttgcattaatctttgcatgtccagagacttatagtgtctgacagtatactcttctcggcagagtatagcacgtttgtagcacgttctttgaatggaaagcatgctgagttcaaggtaactcttttccaaagctggtcgtaccttgacttagctttttggtctcgggcctcagtttcctcatctattacttagccccccaatcttgtaattctctgatttagatctggctgctcagccagctgcggaacctgcttcctgcgagtggaggaaggagttatcccaagtgtgactgatgaagttatgcagaggggagtgcttagcaagcacccttccacaggcaaaggccagctgctgctcacctgttgcgaagcaggcagggcagggggtggctgccgcatctcccctttgggtgatgtcaggacctttgctaggaatctgctcacagctttcctcatccacagtggttcctgatcacctagctaaattttagcagggaccagatgatcatgtccccgtcttccccagccttgccccagaagctcacacccaggacccaggccctgcccagcacacatgtgaggctgggggagtaccttttagaacagtattcttacttgttcatttagatggcttgagtttttcaggaagaagaattctaaaacactgttgggtaactctcacccaagctgggtaatttataaggaacataaatgtatttctcacagttctggagatcgggaagtccaagattagggtgccagcagcttcagttgtctggtgagggctgctctctgcttccaagatggcgctacgttgctgcatcctcaggcagggaaggcaggaggctgagggactgaacactgcatggggcctctttgatacaggcctcaatcccattcacaagggaggagccctcatggcctcaacatctctgaaaggccccatctcttggcactaccacattggcaacatctgaattttggaggggacacgtttaaactgtagtgtccacctagtgcaggaaccccagggcctctgtgtgtgctactgtgacggagctgctggcccccctgggagaggctgccctaccaatgtctttagaaagcccgcccttctgccgagaagaggcagcctccctggaacttgccccctggcctggttctgcttctggagcagggaaaagaaggggttggtttcccgcatggtagcctccattgttggaagatggcaccccaccccatctctcctcagtctccctctctgttggcgttttggagcacggacctttcaaagactcaggcacctcttttcctcaggccagtgtgtccgggagagaaatgaaaacacaagaagcaatgcattttgtttatttaccaaaactctgactgaaaaccatgctctcccttggagagtccatttacttctgtggtttagctctcaccaacagctctcagaccgtgctaatcccctccccaggctgcaggctcacgttttacatgccaccggcagcccctggctccacacacaaaacactgaactcctcttgctccccagtatcctctcctcctttgcccttgatgacccaccaagtgcagtcattggttcagcatctatttaataatgttcttctaggtgcagagcccaggacaggagcccagttctctagatgagaaactcagaattcaccattgcttctcccaggggtcatcagccttgagtgaatctatggctctaatgaatggccctggtgccatcctggaaggcaggctagcaggcagaatcataaaactcagttatgacccaggcttgaggaacgttctctactgagaatgtagacttcagagcagcccagcttggcgcaaatcatgctgtttgtcacatttagtgtgtaggtggcctttagcaagttacttaatccttcttagtctatttcctttctgtaaaataggactaataaccatactgtggaggccacagcaactccatcttggatgctgatcctccatattgacttccgattaacccagtttcgggaaagcctctaagatttctcctttatctactgtttactgtaagtcctgcccttaggcaaattgcttctgaagcacatatacccctttcctctggtatttaatccctgggactagggggtcgtggtgcaggatccaccatcttgtcttactgctgccagagactgtggcttttgttcataagtccctattaaatgcttctttctgagaaactggatatgtcagcccctttcttcagcctttcagcttcctcagcctttgggggtaggtttgaatatgcctacccacccggaaccagtacctaccagaaagggttattgtacagattaaattagataatatatgcagaactccttagcttaagtaagaatgtgtttgtctggctgacagagtggaaaggataccccagacagaggtctcagagtaaacaaaggctctgagatggggaactgcagagcacactgggaatgtctcaaggacagggtcctgggtagaggggcaagttcactatggagggtgggaaggacccgtagggacttgtttgccttgctgaagggttttggaatgtcctgtaggcagcagcagaaactatgagaaggtttcaagctggggacagagatgatcagatttacattttagacagcactcttcatctgcagcatgcaaatataggaaaggccaatttcagaggcaggaggacagtgggaagcacgtcatcatgggccaggtgaggggtgttgatgcccagagctggggcaggagtgaggaagggaggatgggagggatccagtacccctgggaggaagtgcctggctcagagccccaggcatggaataaggggtggggtgcagacacattcacatccggaggcgtggagcagagcctggcatccttaataaagttgcagggatgggaggtgccgtccctacatccaggccaatgccgggcacgtagcaggtagtcagtgaatgtttattgaattaaactgaagagactactgtgacccaggatgggatacagagcagtggcagagttcatataatccagtcccagaatgggagcttcagagatcattaatttcaaattgtggttcttggccatattcaaagtaaaaggcatcaatcagatcaatggggtggagatccactcttgcctggggatatcaatcccctcaagatctagcgttggtctcagatgtttccagtctttttcaaactcaacagaaacgtaacggtagtaacaaactatgggccttcaacctcatgaatttgaaatacaagggaccaaaaaaaggggaggcttttaatttattaggtatataaaagtggatattttcattaaataccaatagagttctgagcagacagggaaattacttgaaattacaggacataaattataggaagcctcacttcctgtggcataattgctctgtggatgggagtgtcctcctgggtgcgtgtaatgtgctgtcacagggacatgggtgtctgtaatgcaggaggtgttgctggcccaggtgctttggggtcccaccgctaaatgagttagtggtgtcttcccctgaaagaacagacaggacaactcacgttgcgtcttgctctgtgccctcaccctcccttctccctgtaaaagaaagcaggctcaagtcacatcctgaatgtaacctgtaaggtgtcctggcactgagagacaaggtataatagcagagcacgtactgacctctctaaattttccaaccctagtacagtctataaaaatggtgagtccattcattcgtttacttattcaacaaacatttattgtaggactactttgtgctaggcattgagaatccagaaataaagcagacctgattcctgcctttggaaattggtttgtcctagacctttatccactgtgacccagggtcataagtgccataatatgagggtctgtgaaacaccaagtggccacggaggagggagtgatgcatttctcccagagaggctgggcaggtttcacgcggagatgatgctgtgccctgcattcgccaggagcagagaccttgtatgctcaggacaaagctggcccagagcgtttcaggagaggaaaaaaaaagagaaggaagctgtgcctgtcctccgaagggaggtggaggctgcccaaaccccccaggtaggggctagagtccccatccttcttcagacacctggtagaggtttcctaagggtgtctctggctggttggttgatgaattagaaataccttcattgaacctccgagatcttgagacccccagacagacttctcagcctggctaggtttgagcatgtcagctccttaactcaggtgtgatgagcagatggaaggagggagctcgggccactcgtactgaaggggaggagaccttgacaaggaaattccagatgggggcctcctctgccaggtttacatccctctcctgtcccactttcatgagtgtgcccctggatgatcacagcacacaagggaaattgaaaatggggaatgtgttccagagaacagcgactggtgatggggattcactggagcgctgctcttctttgggcctcggcctcctgcctggcccagctgtgcacagtggggctagaaagaaagggagaaatagagagaggagctacaccaccaactgggcccgagaagtcagaacaccatggaataaatcctcgtcagactacactttgaagacagaaagctcagagctgatacattagcaagcgcctcagagacgatggtgtggccacatcttgtctagcgctttgtattttttagagggttttcacatctatgaggccttgggcctggccgccttcacctttttgccttttaggtttcagcatagatatttcctcctccaggaactctctctggccatcgtcccccttccctgaccccagggtgccccttctaggagtggacctagcaccagctcttatagcagcggctcttacttgtccctgcgtgtcttatgttggttgtgaatactatttcttgcctgcaactcccttctctgactgtgggctccatggcagtggggactgtattggtttcactgttggacccccaaaggcatgagagtgcctagcacatagtaggtgctattcaatgagtgtaggctgaataaatgaatgaatgaatgacaaaactggggtaggcatggcagatttactccctcctcattctaaggagaaagtagagcctctaacaggctgagagcctgacctgaagcccacagacctggcatctggcccgtgctttctgcatcctaaggggctgcgggtcccagcaggttgcccagtgagctggccatgcccaccatggccctccctgccactctctgggaggcccacctcgatcccagcaccttttcacttggatcggccgctggccatggattgccatggttactacaccagccctggcagtctctgtgtgacattttggttttatttgctaaacatttaaacacttgggcttaaccctttctgcctcagagggggctttcctgcccctgctccctgtccctcaggtgtgagggcccccggctgctctccctggccctggctggcgtctccgatggggtgggtgtgctcgtggtggcagcaaggcttgtttctcggctgcctgtattgactttctgttttgtctctggggaatgtcatcctggatcatgctctcactgggtggtgctgtgtccattaacaggtgtgaaaagccctgctccgggcatgttaaggcttgacctccccgtcagctggggttctgttgacttccaggcaaacgcctcttgccaagtcctccaggagcttccttagctccaggagttcaggacggggtggggaggggtcatctgcccttgaaccctggcaggaggacagaggggagactggtttcgggaagagtccgtgtttgtgaatgggaaggcggtgcgtcgcctggcctcccacgcctcctcccctgcgggcttaagatgaagcctcccaggaagaggaggcggcccgggaggctgaatccacccagctatgtgttaccttggaaaccacacacttgtcctcgccctaggccatgtgaagtgagggggccgtggacacgcttctcaggaagcttccagtgtaactcaggatacaaaaaatcacagtcccagcatgggcagctgagagaatgaaaatgttcaaaaaaaaaaaaaaaaaaaaaagcagcctaacaactgccctgcccaaggggctcccaccccagcaaccctctgcccattctacatgggacgagaggccagggccagtttgtctgggatgctgatcacttgtgagcttggacaagctacttgttctagctcaatctcagttgtgttgtctgtaaagtgggcagattaggccagaggatctctgagaactctgattgtagccagaattccatgtctgaggggcactgcctgacaaggagaggaaaatgtcgggagagtggctgtgagcggtttttggtaacaatgactgacctggtttgtgttcaggaggccctttgtgggactgtccgaacaacttctgtcccttctcttaatagccttgcctctgcccagtcacagagctggctgtcccctaaacacagcctcaaacttgacatagaaaacaataataaagacagctctttggctccaacatcttaaagtttaaaggtgactcctcttgagtctcttacacacaggagctggtcagacagcttaaagttttcaggataatagagtaagtggccaagtcccctgccttaacaatccattccaaactccttccatgaacgcgcactcccacttctccaaagtcatggggaacaagtgctcagcttaatagaatattctgtttctccatcattctcagcaaactatcgcaaggacaaaaaaccaaacaccgcatgttctcactcacaggtgggattgaacaatgagaacacatggacacaggaaggggaacatcacacaccggggcctgttgtggggtggggggatgggggagggatagcgttaggagatatacctaatgtaaatgacgagttaatgggtgcagcacaccaacatggcacatgtatacatatgtaacaaacctgcacgttgtgcacatgtaccctaaaacttaaagtataaaaaaaaagaaaaaaaaagaatattctgtttctctgagagtgccaaggtgtgtcatccctgactttttcaaagttaatccgttctatttggttttgttgttaccatttttcaatgatgatcatttcccccgtggcagcggttctcaatcaggggtgtgcctcagatcccccgtgtcatatctgggtcctgcataggcaggtgaaccccactgcctgggaatgtgtgttttgacagcaccgcaggggggccagtgcacactcttattaagaaacatggcactcaattaagctcagggaggccagcgtcttcccaatcatccctgcagccacccctgctgtgcctaacgaagagcactgtgcatagtaggactcagtgactcctggggtaaggatcattgactctctgagaatttgtaaagttggaaggcactgttgaatctttagtgtttggaggcttctatacaagtgttgttgcattgtgctatcaagaaaattctgataattctagtttcctgttgagtacaaatctagtaaaatgacattttcctgtttttaagagaaaaaatggcaaaatcaccactgctcaaattctccaaaacccaacaattggacgaggaaaagagatgaactgccccgatttacctttgaattaaagaattcgatgcaattcaattgagcagttttgtttcctccaaaggcatctcccatacaaacctgtcctgttagcatgatggtgggagagacactgagcctgcggtccgtagacctgggtccaagttgagacttgttcatttaaaacactttttaaacttgtggtaaaatatacataacctataatttagcattttaaccatttttaagtatatggttcagtgacgttaattgtctaattatattcttatatatatatttgtatccttattattgtatatttgtcaccaccatccatctccagaactgacttttgtcattttctgtgtggccttgtgtgcctccaccaaggcttgtggtgagctctcttcgcacatcatctccacaagcatctcccactttgtcagcccctaaacttacctttaccctgtcccatcgccctaacgtcacgggccggggttctgattccaagtttcgattggggaagtggttggtaatcccacaggtggtaatagtgtcgcctccatctgttgatctcttgtgtgctggagactgtgcctttactttatcatctcagtgattcttggcgacagtcccgtagttaggctctgtattcataccccctttatagataaagcaactgaagcagagaaggtaagagatgtgtccacagtcatgtggctggtgagggcagagggttttgaggtcaactgtttgagttgaccatctccaaagctagccaggttgccctgcctgggggagagaggcccgtcctcaaattaactcttctacccctggttcctacaatggctagaagcagcctagaaggtgggctgagtcatggggacttccctccaacaagggtgaatattaggaagcctagggctgaacagtaacccagtgttggtccaaccttgcagcagctctggaggccctcatcccagccacacccccaccttggctgtgccttgtggtggctcctctgcctattaaaatcccttccttctcctggtttccctattgtcctccccttgggtccaaggcttgcctcaaggatgaggcccagcacccttggggaggtagaagggcagccatctcagggtaacctgcccagccatcagaactgggacccgcttcagtttctctgccttgccttctgatcccaaggaaggctagggtcttccttgaagcctcactgagccccatactgggtcttgttctttcttgcctccctgccttctgaggggctgacttctacttctgctcgcctggagtcacagtgtccctgatagtccccaggccctcaggatcagacctgcctctaaccccaagccatcatctgcctgggctgagtctggtctttcccttagacactgtgccttgggctgccagtggcctgggtgagtcaggcttcagcagctcttcctgtttccccgcccatattctcccctccttctgcccgttcctatggtaaggtgccagcagccttccacccaaactcccctaagctggacccaggacttccctagattaaatgcccccacttccctgccataatcatgtcaataatcctgtttccaccctgatcttgctactctgaacaggatctgcttggtccacagcagcccagggatctggtgacacactgacccttacacaccactgggatcaggtcagtacagaaggcaccgacctgctttctcactttgttactgcagccaaagacagccagtgacttttagctttcatggtagcctgttagtttatattgaattgaatatttactaaaacccctctgtcttctcatgagctgctaagcagctccccaccctctgccccctcaatctcccatccttcctaataccgttggctttttaggtgagaactgtacctttcattttcttctgttacgtttccctgcagctgtttcagcccttcattctagtctgtccaggccttttagcatctcactcagcaacatgtatttgggggcctcccagcttcctgccctcccacatgtgatgagcctgagtataatagcttcatctaaaccattgatacaaatgtcgaaccagaagtcaaatctgggaggtaaactttctttggttggactaaagacaggagaagtaaagaagaaacttcaaggatttgcaaatctttttcatcttaaaagttttgtggcctcctgtgaggttgtagttttatgtgccctcccaccccagcccccaaataagcctgctctgcattcatagaacacgtgtttattgagccatgctctgtgaggggcacggtgcctggtatgggacagagctgtgaactacagactggacccggtctcgtgttactcacagtctgtgaaatgaaagcgtggctgctggtgctggggcttggctgctggggctgagtgttgagtctgtgaaatggacgggtgaagccgtacacctggtcactcggtgagatcacgttgtgtcacaggagagtgctgaggcatggccaccgtggctggacgttctcagagacactgctcagccacagcagctgggcctggctatgaccactgacctgtgactacatcaggcacagccacaaaccagagatcagtaaccagacacggcggagccatccagtgggcgcagagcagccaccgcctctgaactcagagccacgaggcggctctgcgggagccgcccgacacctgcctgctgtgtgatcgccagcagaccctgcccctcactgccctcagatccctcacttgtgcatctggggaggaagctaagggctctccaaggtccctatcagctctttatggtgcttcttgctagaatgtgctagaaaccatatcgatttgagagcaaagagaaattgccaccagtgggtgtgtatgtgtggaatgggaggcgggggagtgggcagggcgatatttgtcttcctgctgctgttagaaatagcaactattctctcccctgaggactggacaaaaggtgattaattcattcagcacagagctattgaagggctgttctgagccaggcaccgtggggacagcaaggtccctgccctaaacaggcttgtgatctaatggagagataagcacgcagacacacacgccttggctgctggtgctgaggacaagggtgtggagggcacggcgcacagttccacctagatgggaatgaggacgctgctgtgcagggcatctgagatggtcatggggtcagttctagcaggtgcaggtgggtcgagggtcctctaggggaagggaccagctccagcagctgtgaagaatgcagaagctcagggctctgcggaatgggaggcatgcagctgatcgtaaagggaatgttgaaaggtgagaatagaaagaagggctggagccagatcctggtgagcagcagctggagcgatgaggcacccaggtctaaaatggtagtagccccattctatctatgagaaggggttgggggatggcgatctgatggcgggagagggaagccagggaatttgtcttcaggttgcacctgcaaagcattttatgtaagatggagagaatgtcaatagtctgtatcaaagactgagaggtaagaatggggatgggagacgggtgtagattatggtacaggttgaacccccctcaatcactgggacctgctctgaccttagagtacagggttgggctagaggaatggtggatgaatctccctccttgggagattgttaggattaaagatgagagccacctggtacactcttgtttaagagtcagaggaatggaaaaacacccctcccaccccaaaacgctgaggttctgatctcactgactgaacaccacccaaccaggagccagggcttgagggcagcccgagtttgtcttgctctgtcggatctttttggatgtttagcaggagcgacactgatcagacttcacaagaaccttaggattttacaattttgctcttcccttattgttcacaaatcaagcctatgcctaaaaatacactcttctccagcagcctcggggacttagcttctcccccaggcagggagtttacatccttcctttgcctgcagaattcaaccttgcaggtttggtggggtggctggaaaccgccaccatcccagagcaggcttctatccccagggcctggctgtcacccgcagcagcagtgacatcacccaaagccgactttgtgcggggggcttctgagtgttaagtgggctcaaaaggttgaagtgcgggggcaggtaggaggagctgcgtggcttgggaaggagcagctggcgctgtagagggaatgacttgccccagctgctgttgggttacgggctcgagttgtccacagccaccaggggacattttttcctcttctcagttcctctttgaccctgcgctcagcttcaccaaaaccaccttgtctcaccttctctgtgtgtcctcggcctctcctttcctgcttgcctcagtctttcccatctttcaaatctaaacatgtggtgtctgttgctgcgggttgactgcatgtgtatgtgtggttttcaagctgaattgacagggctgagttttacagccaatactgcctggctctggaagaagagaaagaggaggacaatgagggacaggatctcttgtagcagagaacattctgatccaaatgtcctttcaggataaatttagttcccggggctgggaccacattctaatttggtgggagtccttgggcaccctggtggggaatggctgcttccttcctcacctccctggtcgatttcagggaccgcaggaaacccaagccttatgaacattatacagaactgcaattacaacaatcctgagctgacataagatttattcattgggcaccaaatttcctttaggcccctttctagtttgtagtttttgaagctgctacattttttatggctggcacatctcaaggaggaaatgcagattaatagtctgtactggctgtgttctcatgctctcaggattgaatcaataatgactgcagtattaattaggcctttatgaaaagaaaatgaaatatggtatgacatggaagattctagatttagaatcaagagttctaatctcagctctgctgccgtctaatgggtgacctcgggcaaatcactgaatttccctgagtctgtttcctcctctgtataaacaggtcataatgctggccacatgctgatgttgtgagcatcagctgagagagctgggttaaagggcccaccagggcctggcacaaacaagagacttcggtgactttaattttggactctccttgctaaggagatcaccactgcaaatccagccctttgctggtgcacagtggtgcagctcttgcctgttcttggcagcaggtggggtacccaacaccttgagatgaactctccaaagtccttgctgacaatgtccacggtcccttcttagctggtgaccaggaacactccctaggggcctcccttctcaaccttccacttctcctacccataccccacaacggccccatttcctgttgtttctcatgaatagagtctggaagtagaaacactagttcgtgcagtgttcacggacatcacggggctctaggaagcctcacatcacatcactctgacactgactctcctgcttctcttttccatatttaaggatccctgtcattatgttgtgcccatctagataatccaggataatctccctattttaaagtcaactgattagcggccttaattctatctgcatccttaattcctgcttataacatagtcacaggttctggtgatttggacacagacattttggggggccattattctgcctaccacaatcctctatttgtagatgaggaaactgaggctagggtattagatcacatacccaaagtcacacagccggtaagtggcaaggttggaatttgaactggagctgcacaatctgaagtctactactaccctaaagggccccctagaaacccagagaaagctcattcccacagaatggccccaaacagccgaccacagcgggagaagtagagatcaaaagagcccacccattggaatccccacacaccgttttagttcataatgcagagaagagactggtgaataatactgcataaactctgaaccagtgcttctcacatttggattgagaaaaagtagtttgtaattgccctgggagctttaaaataatactggtgcctgagtcccacccctagggattctgatttaattgctcaattgctcaattgctcaggggaggcattgaatagaggcgatttttccaagctccccaggtgatttgaaagtgcatcagaatgtgagaatcattgccctgaactaacccatggccacagccattccccctacctgacaattgtgtccatagtctgattagaccatgcccagaacacacccctcccaccttttgggccttttccctgaacgcccaggtccccctgtttcctcttcaccgcctcactcgaaccctgactgtgtgccgagcagcattagatgtgtagagaggaccctcccatgggaaatggggcatattctctcctctggcatctctcacgcccctcttgcatggctgtctgcagaatagaattgttttaatgtcctctttgtatatgctatatttctatagagtctttccttgaaaatgtaattcactatgttttcggtgtctgcatcagttcagcttgaaaggcagtgtgtgcagagggttggaggtctgactctggagccagactgcctgggtgcaaagccgaaccctgccagttcctgactgagcttggggtgaacgattctagctttctgtgcctcagtttcctcatctataaaatagggatcagaatagccgttacctagggttggtgtgagaactaatgctttcatatatgtaaaagggattaggactatgtatttgctcatgttaccagtattgctactactcttgtcttcaccgagatctgtgggattcagttaatttcagcagataccgattccctactcagtgccaggatgggaaagaataagatgtgttctctgccttcaaatagttcatggtcttgggagggagagggctggtaaggagaagggaaggagtcaaataggtgaacagctaattaatgatataatacagtgttgacttggaaccacgttgctgtggaataataaagatggggacatcatgatgtggggattcaccatggtcgtgaaggcatatcatgaattctaagcactaataaaaaactcttagtgcgttttgtcctgccatccatccgcatttgcgaagctgtgggctgtaacaccctgttaagccccttagactcatttcatgagttgtgaattcgagccaattgtgttagtgtttgtgagtgaacgcattaatctgaaaggtgtcagtggcatcccagttcctgctgcaaatgcccctcacagggagaggaacggggtggctttctccaagaaaacagccagtctcttcaaatcctagccctaccctcctttcaaggtgcatcccagagagcggctggagtccactgcagagggtggtaaaggaggacgtgtcatgccaacaagggagcaatgacagcaatcaaaagggacatccaaggaaaatgcagagttgcacggggagacggggtcttaaaagcccacacaggcagggattggaaaatgctcctctgggaatgctcatgtggtaaggtggccatgggtgagtgggaaaggagggaggggtgaatccttggtgtgtgaggctctgtagagagaatggttgctgcctgggcagatgcctccttcctgtcccctccagccaaatggtcacacatctctcgctcagattaacagcttgctggccggtgtggcgggcaactgtaggaatctccgtcagctgtgggaacagctgtacactgcccagggccacatcacaccctggcatgtttcccattccctcttggtcaaacacacttaaaaacaggactcaacgctccttggtttctaactgtaaaatatgccacgtgaaggatgcaaactcatgtctgcctggggactacagtggggcaggcaaatgtttgatgggcttgtgagtttttgtgttttgaagaaaaacaactgtctcaaggcagacagatgttgatgaacgtgtttatttataaagggcttactgagctaataatgacaccagatcatccccaaatgacaggtgtcactgctgacctatagctcagagtgtcactgcctctgttggagcaacctgctccatactgctggcctttttcatctgcagcccagtgttgcttgtggcaaaatgtttacagtagcctggggcttgcgtgaaagccttgctaacccatccctgtgccctgctagtggtcagaaatgtctgtttttgtttctaggcttccagagtcactaggactctgggcagggaaggagggccctcaggctcattggtgtctagggcctgggggcatttttgagccacttcacaaagcctggccacagtctgaagtccagtacatacagctgcagcccaggtgactccatggtgaattgctccatccctaacataaggcacttggcacagcctcagtgagctatgagagaggccagagtgggaaggtgtcatgcacggcgtgaaaagggccctcacaaagacagagagcctctcccctccaaccaggcagaacaactaagtagaaaggctggtgcagctggagaatatggccaggaaaggagcctaacagtgacagccagaggaaacccaggccgaagccactgggcctgtgtgggtctgcctcttggatggggctccatgcacacccatgttagtaggtggagctgtgtgggaacattcaggtccctggggttaagtctcatgcctagccctggctggagggttttgatgaatggatcttttttttttctttaatagtgtagaaattgtattttgcctcatattcttgggttatccatattagtctgcagctgttggtcttcctaaaccatgactgagtaggtcatcctctgttcaccactggtgatttcttaccatctggtgatttctggataatgctgagcccctgagcttggacatcaggctctacagcagggctgggctccatacttcccgggccctgcccctggccagctgccctgaggtcactgaacacctggggtgagaatagatcttacccacccctgctccctgtgttttttcaaactcccctccttcctggctctggagtgagctcctgggtgcggggtagtggcttgagctccatgcaggtttggtgccttgctcatactgagaagctcagtaagcccacatcaaccatttgtctttctctagccaagagtcaaatagatccacgtttaaatcccagctctgccttttattagctgttggactagttgtttaaacctctctgcctcagtttcttcatctaatatcagtaccttcctaaaggggttgctgtgcccattacatgaaataatgctcagaaagcagtggtacagggtaggaattcagtatggtagctgctattgtttttgttactattattatttcatctcacccctactgccagtgccccgcatgcagtaagtgctaataattgtccaatcaagaaacaagtgaacaaaggccatgttcttattcccttgctcttgtgggttggccccttcctcttctgctgcctgcatgcccactcccatcagactgctgagagcgttcctggcgcgccccgacttggtgctgacatcagcaaacagagccccggaggccgagtctttcactccggggttgtgcatcctccgggggtgtcagctcttcaagctcttccaggtcctgcagctgttggctagagatgccagctatggaaacagctgtgcctccaccatcttgcctcttcctccccctggattcctgctatccctttggcaggcaagcgcacttaaaaataagtggcaaaagttgcacttgtttgaagtgtaagatatgtcactctcagaaagagattttgttcttactgaataaaggataagaaatagattcctagttaaagaacttttttggctaactcttctttcagggggtgggagcgagcatcctttgtccttttggcgtaggctcttggggaagaatggatgttcttgcttcagagccgccagcacaggctctctgggctctggctttctcattgatctatttccctctagtgaatgggttttacagaagctgcagagagattttcccctaatgattgtggatagaaaagaataaaaagtgactccgggggtatcttgggaccttaactgtcattgcacgctgatgcttcatttcagaatgcaaacggccttcttctactttgccgggataaatggttccctttagctggggacagtgagaaaagaagcagggctttccaggtaaaattgaacggcctcctgtgttgggggtgaggctctcccccccacctcctttcctcatctcccccagaatcctaaagaaaggaggacggaggctggagtccactggccagcttggtgtatagaatctttttctttctctttttgagcgggggataaggtctggttggagggaagtggcaccatcttggctcactgcaacctccacctcccaggctcaagccatcttccgacttcagcttcccaagcagctgggactacaggcgcgcacaatcatgcccggctaatctttgttctttgtattttttgtagagatggggttttgctatgttgcccagcctggtctcaaactcgtgagctcaagccatctgcctgacttggcctcccaaagtgctgggattacaggcgtgaggtaccatacctggtgatggatacagtcctaatctgtttcctcctaacaggcatctcccggtgaagcctggagtctagggaaggaactcctgcttaatgggcccccaggaagtcactttctcaggctggctggcatcagaactggtgcccaggtaggaggtgccagtgtcagtcttctcagggtggggtggtgtctgcttttcctgtgggtctagcatcctcaccaggttataacaaggccagctcggagctctgtactgggatctcttaacaatcaccggccctgagcacccatctcctgggtgagggtttgggccagaaagatcctctgagccaattctggactccttatctgtgtcctgtggtagagcaacagctctgtgaggacagagcaaagctagggggccaccgccgtgtaccaatatcagcacaggagcttggccctggtgggaaagcaatggaaatccatctgcgatagaatggatgggtgaaggaagaaacttacaccttctcaagcaggggcaggtggccctcatgattccagactgtggctgtgatctgggacaagctctcccctttatttccaagtgagctgcttatatgtcccattctgtaagaacacagccaatgaatcatcacaacagcacaatgacaatgatgactttgggatccaaaataagaaaatcaaactcccttacattcgttcaggaatctacagttcaacgaggctgtttcccatgcatacgtcacacccttcgcctgcatgtgagtggatgaatgtggcctccgtttacaggtgaggcagctgaggtgctgccaggtcaagggacctgcccaggaccatgcaggcagcaaaaggtggggtggctgcctcccaacgtgggatgcagagctgcagttgccccagcacaaagtcagtttcatgctcagctacagaactaatctcagtgacctttcctgggtcccatgctctgctgccagatctcttgtgggatgaggccaccatgctgaccaagaagctccagaccacgatcagctggctgtccgctgtaggggcacaggtctccccaccccagggcacttgcggattcaggaaggaggcagtggaggctctccttgctttcagtaggagctaagccttttcaactgcactctagggcatttctagcaaattcctacatgaccctatgcaggggaggggacacaaccctggtggcttcactttatgggttgaaagtctctgtgggctccaaaagcgggtcagcctgccctcgttttctggagactctgtctacgctctttggacagttcacagggataatctctagaggtgccctggctagaacacggagatgcctggcactgctgtgcattcatccaatgagtgacagtgatcttgagcccttgacctaatccgacagtgtgacctaatcccacagtatgacccaatccatttggcattaatgctggctgagactggagaccactgacctcttttcctttcagtttgatcatataataagaactgtgttagtataaatcattatttaaagtgtgctttaggccaggcatggtggcacatgcctgtaatcccagcactttgggagactgaggcaggcagatcacttgaagtcaggagttcgagaccagcctggccaacatggtgaaaccccatctctactaaaaatacaaaaattagccaggcatggttgtgcatacctataaacccagctacttgggaggctgagtcaggagaatggcttgaacccaagaggcagaggttgcagtgagccaagattgtgccactgcactccagcctgggtgacagagtggactctgtctcaaaaaaaaaaaaaaaatgcaataagtgtcagtgttgtgtaattgactgttagttcatagcaatggtctcaccagtctgcccacagtatagtgaggtggtaggatggaaggcctggaactagagactaggatttgaattttggctccaccacttcttagttgtgtaacttcacacactctgtaagtctcgtgcccctaatctgcaaagtaggtacagtgtcagtgcctactcattgagtttttgtggggacaaaaccagagaatgcttgtgatgtgtttgtcactgtggtccccattacccttaagaaatgtcagctcttttctttgctcttattactacattagtttaaacaatgtctcccatagaggctgctcctgaattagtagtgtattcttgccataaattacacttgggaatagcctgattaatagtcagagataagaggcctagggtgtaaactccaccaaattgttcaatgtgtgagactttgagttagaaggcttggcgaatgtcctgcctcgctatttgctgccttcatgggtataactaatgtaccttctcctcatctgtgaatggggataatgatgttcctgagctatggagaggaccaggcaagcactgtgcgtcagagcacctggcatagggcctggtacaggtcaatgcccacctattttctgtccttcctttcttcctgtttgttcaaaccaggtctgaggctaacagatgtgtcttggtgagtccaagagggtggctgggccataagggttgggggagtggagaagtggggctaccagttgctgctggcaatttgcaatatctaccctgtcccaggaattgtaccctggcctctcgggatgatttagtatggcagtcatggagctgaaagttacaaatggaggctccagtgatggagctggatttcctgttctatttagtccagagcccatgtggaggatccaagacaattagagccagagagtgctggagaaggcctcagtgatcatcatcagaccatccttcttattgaacagatgaggaaactgaggcctagagagagaagacacctaaaagtccacacagcaagttacagagacttgctcaggcagagccacacccctgtgtccacgcctctggtccttctaggtctctggggtcacactgatcagaattcctccagcatctgctatatgccaagctttgtgtttctcattcaattcatttaccaaaaattgaaagagtgcttacactgttcctggcactggggacacaataatgaacaggacagatatgatccctgccctcatagagcttccaggctagtgggaaggcacagggacaggcaataacaaggaatcaatcaaataagtccgtgtaaattcagatgcagacaaagaacggaatgtggcagtgatggggggtcatggaggaagaaatgaattagggttgtagcttcaagggcgacctctgaaagttactttggtattgtgagatttatttctattaatacttcctttcgctatgtactacagtattatctcctcaggaaagtgaggctcagagaggttaattaacttgcccaaaatcacacagccagtcagtggaggagtcagaattcgaaccctactctgcctgactccgaagtccaggttttttccaccatccttgattatctacagaaattaggacaacctactacagaatgtcaggtaatatggtaaccattagtatgagcattaagggaccccaaggccagacctgtgagcccagcctcactgctgtctctgtctcctgttctagggggagggacgaggtggatattctagatggtcttaccctctcctctccttcggagactggcttcattgggagtgagatgacactgtcgcagggctagctttttgtaggccactagttgtcgcaggctgctgatgaagccaagcagatcacccccatgtccacaagcacaccgggattagatacatttaagtcctagatcccaaacgcctttttcatttctggttttgcatttgtttccattctactatcttcatttggaaaaccctttcattcctcaagaaaacaagccacacaatcaaaaaaagatgtgtcttatcctctgggcgctgcctcattgcctgccccattattgaccaatgccaccggagtgccttgcacagcttggccagcgttcgctgtgcacatcgaccagtgagctggcatgctgacagcggcagaggcccccagcttcagacacttctgaacccagctgctttacggacacaatcggttgaatcggttgaatcatgacttgtctcccaaaccacaaatttgtaactagttcaccgtgagcctatgcagccagatgaattgtaacttgggcagtccctgcacctaaattttttttttacccaataaaaaatgatatctagacatctctgtgtgcatgaaagcatgtctgtacgtgcgtgtgtatgtttggcaccaatgggaaatacagagacgtggaatgccagctctgccctcaacctcttcccagacgggtgggagatgatattctgtggactgtaattcaaagaagacagactaataacaaagagctatggagaccaggggaggggcaagaattcagatctggagtggagaccaggaaaatggtcctgggaggccagactcttggagaaatgtggacctggcaataagaatttatgagctctttctcagtcactgctgagtgtatatcttccaaggtattttccagtgggcataaattacctttcgattgcagtattcgccacctccactcatcccccaacaccaggtcttatgtggactgttagggaagcctctaacttgtaccctgcctcctcaccctttctgcaccacctcacctcatcgtcacagctgtgaggaatccaacagacacacacactggaccttgtccttgtctgaaaacttttggctgctcctccttgtccttagaatacagtctagactccccaggggggcagatagagccctccagaattggccctgccctgctctgcggccacatctgtgccatttcctcctggaacactgtgccagtcaacctggagtcccctgtgcccattaccctggagtcccctgtgccccacaggtccacgtctctgggcctctgcatgtactgctcctccttccaagtgctgttctcatctcttaagcctgagctgtcctccctgacccacccccaccaactttcagtgcccccacggagcctcatgcatacagacgtctcttgctgcacctcttatatgcaatatattcctctgtttacatcactgctcatttactgagttatatgagggtggtccaggcccgtgcctctttgagtccccatgccttatacagcatctgacagaagggtggctcagggaatgtgtggcacagcagtgaatgatgtgcagcttccaccgtacttccagacatgaattgatggtcctggaaccttcagagaagccttaccacgttgtgatcagtaggtgggggactcgacactaccactgcagaggtggctttgtggggtggcccctgtgtgcgctcttatgtttgcaaagtgcgttctttcacgcagtcagcctaccaatgggtgaccagattctttcttcagaagccagtcagaaaagggacttggcttcccagattacgcaaaggcaatctaatcccagaccttcagtttttggttagccagcggctgcacaagtgtcacagaccacaggggctgggcgacgggcatggtggtccctctgctttcctgggcacgttaggatgtcattctctcacaggactcgtttcagagaattttccgtgtaaatgtgaaagacctaaatttatgcctgtctcagtaactaagtataggctacttatggaaccacccagctatgggaaatccagccatgacaactaactgtgaagaaatagccccccttattacacagagcagacatcctcagggattggatgaaaaagagctctctaggaagtcagtgaaaacgagctccctgcctcctcagagtatgcctggtcaatgtgtgacaggctcgctactgggttcccatgctgcatccataacagacataaccaatcgatcccagcattctttctagatgggctcaaagtccttcctccctccagtgccacctccatgcacaatgcctagcctcaggcatactgctgctcctgcacctctgtgaatgagccctccacagaggtccacctttggtccatggttgatccatggaccaaaatgcctgttccttgtgggcctcaagacagctgaataatctactaattcaaagggagaccagaaaggcaatagtcaaagataataaagagcataacaatagtctaccctctataatgcaagttttttctcctctcagagggtccctgatcccatcagaggactcagttcttcacaagcaagactgatcttgcagcagagggctgatggagtcatttacatggagagccaaagagagtctctcccaccaggaccttgagctcctttgaggtgtgcctcattttttcattcatcaagtgtttattaagcatctatgtttaagggcaagctctggggaaaacatggacatagaaacagacatggtctctgtcctcaagcagcttatagcctcagaacaggccagacattagtcagataattgcacaaatgactgtaaaattacaactgtggtaagtactccaaggagcctagattgatccagtcagaggatgaataggattaacttgacatagagtgaagggaagaacattctaggcagagggaacagcattcggaaagattgtgtgtcaagaaggagatgagcacaacagccttggtggtcctgggaagaggatttgtctacattctacgcacaacaggaaaccaccaggcagaacctctagccctgggacagtgctgtgcacattcgagggctggatgcatcagtgaggaacaaaggcatgcatgggggaaaggatccagtgtgatggaatgacggatgctctcccacccagattatgtgcaaaccctggaatgaatccgcctccacactgactttggagatctggggcaggtcgggtttccaactgcaggtctttagtattccttgactaagtcagcttagtcaactacgttaacgaggtcaagtcaagctaagttaactactccagccattcttagaggtatttcactgcaggctttttgtgttctatttctgcctttccccccacaacagttgggtaacagtccccagcatagtgaataagttctataagatttaatattgatttgttggagtttttaaaaattgaaagtataattaatgatttattgctactttgcagtttgcattaatcactgtcattaatggtaatccttttaggtggtttataacttttaaatggagtctgttaattcccaagcctggtggctttgtctctaggctgcattggggtctgccaccctcccatgcccccgacatccctccccatcaccccatttgctttaagatacagggatgaaactccaggtgtaaacttttcagggtcagcctcttaccaaggaacagacatttgggtaccttcctggccaagaggaggggtggtgcacaagctggctctgggcctttgctgtgggcagagagaaccaggccactgctagctcttcaacccactacttcatttacaactctctgactttgtattccctggtttgcatgtctgacacctcacttggcacatgatttattacagcttttcaatagcccgttctttctgattgacctgtccatctccatttggagtggaaagattggcttctaggtgtttgtggtgagaatattcctgagtgcgatggtttggggttaggagcttcctgctcttggtacagaaccgaggaccacaactaaaggaactcccctttctctggctgggaaatgaaaagggtggggaaatacacactagaagttgcctgagacctggctgaaggagagaaactttctgttttgccaacaccttcagggatagaaaaaaaatcaaacttctgcctgcatcacaggcaagggaaggcagctcaatggaaacagcatgaaaagaacttcggagcccatataggtcaatcccctgcttctggggtgggcattctctcccacatgaataggtccagatttcattttgaaaacatttccctgggaggaatcttccctcaaattctctctctttccgtctctacccttcttcaaggtttgacaatctctctaaccaaaatccctcttgctgtagttagagcctcttagggaccagttaaactggaataagggatggccataacaaaacatgcaaattccttttccttttaaagagaaatatgtctcctggatattacctgaataaacccatcagcttgctgttacttttctgggattatacttgatgaggatggttgcagaaagtcctgtaaacatcttctatagtctgtatggggaggacaagtcccacctgtttccagtggaacattctgattcctgttgttactctatatttacagagtgggctccactaagagcccacctccttctgtcactggtggaaaggctatttaatatgatcccaattagagggaggaggatctgggatggttgttggaacatggcagacaggggagacccggagggaataaaccaccccaggatgctgtgtgaccacctgaccctctgcaaagcagcatcgtggcactctgttccctttcaaggttcccacagtgagtgccacccatttttaccacaatggcaacaggatttatgctcccacccactctcagttctgaactttctatggctttgcccctcattggtcataaaacacgtgtcacctgcctctctgacttggcttttcttgcaattacatggtttcctttgcgatcttcctggccagtggaagcagaaggatgcttttacagacagggtattatagatgggttggcagatgaggtgatttctgagggcctggcacaatgcccaaagggacgtgagtcagctctcagaggaggtttggtttttccttccaaattcatacaaacagcagtgaagtttaaaagatcctcaagtggattacaacccccattcatttggcagcagaggagcacaactgtcaaaaagtccaggtactttaagctgtggaagaggcacagagtcactctcaagttggacagggcttcaagctatttctaaaattaacatcggggcctttcgttccctttcgaggttcctttgaggaatgggtgaaagccacctcttcttgaccacagcagtgactggatttatttttgtcctgtcttcctcctccacattctcagttctcgaggctttttattgtttttggttttagccaggcttgggctggttgcttactctccggtgtgcagggcttctagaagtgttagccacagccagcgggaggcagccgatcacccatcccacctgctgagctgtcgcgggcagacatctgttgagctcctccccagcaccagccgcaagaatgtacctgatgtggtctttgctctgcaagagctctcagtttagagcagtctttttgagaaaaaaaaaaaaaaagtggtatgatacacgtaatataaaataccatcctaacttgttttttttttttttttttgagatggagtctcactctgtcacccaggctggagtgcggtggtgcgatcttgactcgctgcaacctctgcctcccaggttcaagtgattctcctgcctcagcctccctagtagctgggattacagacatgcaccaccatgcccagctaatttttgtatttttagtagagatggggttttaccatgttggccaggctggtctcgaactcctgacctcaggtgatccactcacctcggcctcccaaagtgctgggattacaggcgtgagccaccacacttggcctcatcctaaccatttttaagtatatagttcagtgatgttatgtttactcatattgatgtgcaaacaatctccagaactcttgtctcctgcaaacctgaaattctgtacagtatatacatgggggatgtgttccaagatccctggtggatgtctaaaactgcagatagtaccgaatcctacagagagagatagtcccagatttaacgatgatttgacttaagatttgtcgactttatgatggtgtgaaagcaacacacattcagcaggaactgtactttgaattttgaattttgatcttttcctgggctagtggtatgcggcatgatattctcttgtgatgttgggcagcggcagagagccccggtcagccctgtgatcacgagggtcagcaactgatacagtactctaccgtttacagtgttcagtaaatcacatgagatattcaatgctttattataaaataggctttgtgatagatgattttgctcaaatgtaggctaatgtaagtgttctgagcacacaaggcaggctaggttaagctgtgacattcggtaggttaggtgtattaaatgcattttctacttacaatattttcaatttacaacgggctcatcaggacgtgacccatcataagttaaggagtatctgtaatgctgcaatgaacatgggtgtgcaaacatccctttgatactctgcttttaaaagcaagtgttcttggctgggcatggtggctcacgcctgtaatcccagcactttgggaggccgaggcgggcagatcacctgagatcaggagttcgagaccagcctggccaacatatatgttgccatatatgtagcgaatcctcatttctctactaaaaaatgcaaaaaattagctgggcattgtagtgcatgcctgtagtcccagccacttgggaagctgaggcaggagaattgcttgaacccaggaggcagaggttgcagtgagccaagatcgcaccactgcactcctccagcctgggcgacagagcgagactctgtctctcaaaacaaacaaacaaacaaacaaacaaaaaaagcaagcattcctaacctggggcccgtgaactcccagaaactagctgcaatacatggtgtgtttctgtaaatgcttcttgttctagggaaagcaaattcatagctcgcatcaggttttcagtgggcttaggatgtcaggagggctcagtctagagagtaacaaaagcagcacctccttcggaatcccccaaggccctgcctgtcctgagtgccgcctctccgatggcagggcaggtgtgaaggagcaagtcattcacttcttggttcctgtcccagctgtgccatttactacctgggtgacacttggcagttcagctgacgtcttggagccctagtcttcaaatctgtaaaatagaaataatgacaacgtcttcctaggattgttaggaagattaaactagatttagcacaatggtcaaaagcataatgtggtaggctgaatcataatgcccccccctgccccaccgaccaccaccctgccaaaatatccagctcctaatccctggatatcctggcaaaagggactttgcaggatgtggttaaatgaaggatcttgagatggaggagagtatcctgggttatccaggtgggatctaaacgtaatcacaagtgtctttgtgaaaagggaggcagaggaagctaccgaagaggaagcaggacgagtgatggtgaagcaggaggctggagtggtgggagaagaggctacgaggcagggaaggcaggccctctctggaagctggaaaagcaaggaaacggattcccccgcctgatcttcgggaaggagccagccctgcggacaacctccacgttagtctagtgaaactgattccacacatctggcctccggagctgtaatataataaatctgtgttgttttaagtaatgtgttacagcagcaataagaaatgagtgtacgtggactctggggccagactgcctgggtctgagtaaaccacttaccagctgtgtgaccttgggcatgtcacttaatctcttcatgcctcagtttcctcatctttcaataataaggcccaccacaaaagggctgctatgaggagtaaagaagctagtatgtgtaagtcattgagactagcacccggaacctagtaaacgctgtgttaagtatttgttaaataaaataactaaaaagcacgtgaaggtggctggctcacaggaggctgtggggtgatgcgagtggatgctgacgggtttggcggcgtgggctgtgctccgtggagtcagttcaggaaggcaggggagtatttggtgcctctcaggaagactatggtaatcttcatgaaaatgaaccatggatgcttgaaggaatgaaccctccattgtctgttacactgaatgcctcacaccctgcatttcccagtgttccttgaaatattaatagctgttacttcaaaacaagagtcaaggtcaaataagtttgagaaactgcatttcaaagccgacttgttttcttttctttagaagtctcagaagctttaatatgctaatgagcctgatgaatctctgagaagcatttttcaaacatttggccactcaaccactttgtatggtgcttccaacatggccagcactcggcagaaggcgcctcagagcaagcctgtatacctgtgcctgctacagaggtgggtgaaggtgggacaacccatctgagaggcagtgtcaggggcctgtttgcctgacctcagaactaactagaaaatgcagctgctgctgctcctgtcattcatatcccagacagtcagaaagggttaccgacaggcccatccatccctgtttccttcagggcctgggccagcctccagtggaggcgcctagaccctgaggccccagaccctagcatgcccctctcttgcctccctcctgacccaatctaagaccctgagggcactgtggatgccacagccctcagatctaaacttcatcctgccccctcctccagctaccccttggctgcttctcaggcttagggatgtacctaccagcagccagcgtcagcctatgggaggacagagaaagtggcagcgtgggccctggaagcaggcctggggcctttttggacaggggactctgggcgtctggatatccaaacgggggtttagaaggtggaggcagacaaggcctcttggccctgtgggcttctgactccacggggtgtggtgtgacttaaggaggggtcaagcagggccctctagtgtgggggacccagagccagagctccaggtgtctggatccagggcagtacctgtgggcattgaacacacagcagcacagaccccgaattgcaaatagtgcccccagtcaccaaactggccctctccatagccatatctttgtttgcttctgcgcatctctagcagacacgcagttctaagctcctggttcatcaggaacttgcatcctgatctccgctgtaccccacgggtcttggcattgtacctggcacgctgaggccagatccgcagtgacctctcaccagcagcagtcgctgtggtgatggtggctgccgcatgccctggccctggccctggccctggccctggtccctccctcccaaatggagggaatggtggagcaggtttcctttctcaaccgtggggagggccaccacttcccacagggagcctaggcctctgccctcagtgggggagcggagtgggccactgactaacgcggctttcagtgcctacgataggaattcacatggagaggtggccttgaaataagtgccttgtttaatcttcatgccctggaagtatttttcacaaggtggcttagttagaggggctgtggatctggtaatgaggctggccttggagggggagacttgtgagaggagctcagctatgaacacttctagcagggctgtattcataaaatcctgggggctcccaggggatttgaagctctacacagaaaattacagggcaggaaaggacctgggcaattatttttcctccaagaatggccatgcttaaaacatcaccattaggcgccacaagtggctttctccatgacagctcttttaaaaaatactttattgggtttttttaaattacaaaagcaatataggcttcttttaacacagaggtgtgttctcattatcaaaaggaaaaaaatcaataggttccctgattcccatctccctgcgtccccagtagtaccagtgttaacaatttagtgtttagccagaggtgattaatgcaccttttgtgtgtgcttatacaaaaatgtaccaacatgcatacacatatatgggcatttttgtttttatgtgttggtgtttgcttttttaaaaaagaggaatcacactatacccattatgctgtaagtttctctttttacttagcaatatatcatgaacattttctaagtcaatacatatagatccacttcatttttaaaaacagctacataatgttccccagtatgagtaccataatatattcagctgtttccctattgatgtgtattcaggttgtttccagggttttttaaaaaattataataagcagttcttttaaaatattctttgatttctttttctatcttgtgcatatgttacaaaagactcttttgccttaggaggattataaaaatggtgaacaattaaaatatttctttacagtcacattgatatagttttgacaccttaaaccctttatgtattcatttgggtggccctgggcgctgtgcctggcactgtggaggacagtgaccaaggagatgtctgtcctcaaggacccctgctttagtgagggtgctgacaagcaggtggacaggaatgcggctcagatggacgatcaagaaggaggtttcggccagaatggaaacttaatagatgagagtgtggcctcttggtttaaatcctgtctccaccacttagttgctatgaggtctgggggatgttcacttttcttatgggactattgtgagactcaaagagttgatgtaaagaaaagtgcttaggaggccaggtgtggtggctcatgcctgtaatcccagcactttggaaggccgaggatggctgatcatatgaggctaggagtttgagaccagcctggccaacatcgcaaaaccccacctctactaaaaatacaaaaattagccgggtgtggtggtgcacagctactcgtggtagctgggtactaatcccagctactcgggaggctgaggcaggataattgcttgaacccaggaggcagaggttgtagtgagccataatcgtgccactgtactctagcctggaagacagagtgagactcttgtctcaaaaaaaaaaaaaaaaaaaaaaaaaagaaaaagaaaagtgcttaggccccagccaacaagttggactcaccaaatggcttgttgctgtttgaagtgctgcccccgccactgggagatcaggaaaagctccccctgaaggggtgacagtgcagctggcccttgggaaggaggtgaagggccttttagtcagttggggaaaaaacaaacactccctgcccaccaccaccacctggtcctgacctcagttcttcagctccctaggctgttcaaagatccaaaaacctatttatttttagttgctaaaaatatcccctaagccagggttaaagaatttctcccttagtggtaaacaggtgacttagaaccaatcagggcccagcagccccagtgatgatgctgttcctcccctacccccaaacattcagcaggatcctttcatgtgtcaaaaggaaagaaacttatcagaaacttcctgttgagaaaacgatacctcttaccccagacttagcagatgcacagaaacctttgactcctggatctgccaaggcacacaaagaaccagaaacacctattggcctggcctgggataggcaaacactggggctcagcccaacaagccttcctagcacagcctggggcagcacacacagtagtcaagagagctgcctgccctggctgtagagcctaggtctgccccttattaactgtatgacctgtagtaaattatttagcctctccgagcctcagtttccctgtctgtaaaatagaaataagaatacctgtctcaaaaccctgttaaggactaaatgagatggtgcctgtaaggcacacagcacaggacctggtgcacagtgaggctgcaatacatggcccctgctgttaccattgttaatggagaccgccgccctgctccctccgccccctgaaacgggggctagcactccccaactgtctggccatccttctccagctgccatttggggattggctctgtgacaagcagggggcacagggcctggggaatactggaggaaggcacccagccccacctgggagtcagaagggaccagcttaggcctgtggaagggtgggacgctggatctggaggtctctggtgaagaagctgagaagagggagtgcttgtacagaagatggaagggcgcaagcttaggggttactggtaacttggtttagctgggatgagacaccgggtgtggcaggtgatggggatagaggggccagctggtgccaggtgggaaaaggcccttttggccaagtgcagctaggagggtggacactctgggttgccacggaaaggttctagaaggggaggtgacatgatttggtttgtattttagaacatttgctctggcagcaatgtaaagatggctggggtggagcacatgatgagaccaaggtgtggccacagcaacccaaggattggccggggtcacttggccttactgcttcaaatataattggttacaaactcccaccccacacaggaggggacccggtgtctttccactggtctctgggggcttggaaacttccatttctctcttgacagctcatctgatgccaaactctttctgctgaattctccacctccatcctgtacttagtaaccgctttaggcacccttcctgttcctgttgctcctcgagggacccatgaccaaggcctctaggttagctgacatttccatggatctggagcaaggggaaggggtgaggtggtggtggcacaacagataagacagcgctgaacgccacatgctcctgatcttacagtctcagcactgtccctgtctcatgggtggtcaagtcctcagtgggctccggcctccccctctcatgggactggcccaaggtgctgcttagccagctcccctctccttccagtcccacagctcacaatcccccatctccagtgttcctgttcatttctagggcacatatattaagccctgtgttggtctcctctgaccccaccccaagcctgtccagaggaatcttcttcattagcaaacatgctggggtgcataagtgggctcctaaactaagatggtctcttcctcgctagggaccccatcaccaggtctccatagaggcctgttcactggcgggaagaggaggaagggaaagatgataaatggatattgtatctgtggaaatgaaagccgtggtcttagttccacaaacatagcccagtctagattacagataacgatgtgggtttcccaggtggtgtggacaccagggatagaacccagtttattttaatcatatattgattctctggtcagcaaagattcttctgagaatgagcatttaaagggtgggcttgagttttctttcttttcttttttcttttttttttttttgagatggagtctcgttctgtcacccaggctggagtacagtggtgcgatctcgactcactgcaagctctgcctcccgggttcaggccattctcctgcctcagcctcccgagtagctgggactacaggcgcccaccaccacgcccggctagtttttttgtatttttagtagagatggggtttcaccgtgttagccaggatgttctcaatctcctgacctcatgatccgcccgcctcggcctgccaaagcgctgggattacaggcgtgagcctccgcgcccagccgagttttctttagaagacaaagtaaagcccaaactggccagcccccaaatagagtgcctgcttagcaggctggcaggtgaaagggcgtgggacttggaagacacagaatgctgcaagccccaggcaattgattgaacctgtcttggtttgggtttcttcatctgctaaatggatgtatgactcccttacagggacattatgagatggcaatgaaatggtatgtgcagaatcacctggctcggcccacagtctggcttttgggtaattttgacacaaaaggaaatagctatgaactgaattgtgtctccccaaaacgcatttgttgaggccctaacctccaatgtaactgccttggagaaagggtctgtgggaggtaattaagtttaaataaggtcataaggatgaggtctagtcctataggactgcagctctaggagaagagaaaaagagagatccctctccctttctctgccatgtgaggacacagtgagatggcagccacctgcaagccgggaagagagcctgaccgtgttggcaccctgatctcagacttccagcctccagaactgtgaaaaaatacatttctgttttttgagttacccagtctatgatattttgtttcggaggcccgagctgtggtgcatatttaacctgtgggcagtgtgttttcagaaagtggtgacatggtgcacatggccctggtgggagtgggtctgtggtctcctgtcctttgaggaagctccttctgtgacatccaaggtcccaatgatctgggtcctgctaccttcttggtctcacctggtatcatccctcacttctttctcacattggtcttctttcttttatctctccaactctctaagctccatcctgccttggggtttttgcacatgctgtcccctctgtaatgcatacctttgcaaggctcactttggattcagaggtcccttccatagagagccctccctgtcctggctgtctgggacttctctcatttcctttgccctgtcttattctcttcctggcaggcatcactctctaaaattaaatggtttacctgtttaatatctgttttcctcccctgaaatgtaagctctgtggggacaggggccttgtctacttgtcttgctatatccctagagcttaccaaggactgtcacataatgggggctcaactcatgctcaatgaatgaatgagtgaataagctgatcggggcaaagctccctgcctgtgcatcgagcacctcttgaaccagaccccaaacacttgatttccagcatcacaccttgtctctccttacaactagagaccagctggtccatccaaaggatttccagtcaaagggttctatggagagcatggggtccactacagagacctaggctggaggaggaggtgagtgagttgatctttgaatgttcttctctaccctttcaactacaacagctctgaatttgtctgtttcccatgttgggcgtacatgaaaaatcttatgaaagaaatggccccacagcccagagaaaatggaaaaccacaaattgcatccaagtcttcacattacactgaggaatctgaggtccagagacttgccacacacagatggccagaggtgggatgctctatccctagtggtgacgtgctcagggatcaagaaattcctgctacgtgagtaaaaaatagtggctcgctcaaatgccgaaacttggctttctttctctgagaactgaggacaggggaaaggatttatgatcaccactggtctctgttagtcccaaacaaacttcagactccataacccccatgagtggtcattacacactgcaagagaccaaaagtgagctctggcgaagcgctcaggagaagcctatcctggccggaccaaagagccactgtgggacatcacacatggcccagggagtgggatggtttcagatgaggacaatttcttcttagacacagagcggggtagcgtggaccccaacgccctaagcatcttgtttatggtagaatcatagacttccctgacaaggcctgttcactggctggcctcttttagagccaccatttttccacctttgcttcccaacccccacccgcctccctttcttcctctagttccatggagcatttgctgactggtaattttaccaaccattgctgcaaacccagaagttcatttcgtcactggcaatcagctcctgtccgcagggaaacctaattaggtactacaggatttttgatgttgcttccatggtaacccccgtagtaatggtgtacatgcagaatatatgctccagggtgtttaaatttatatatgtatatatatatatataaaatataaaacatattgtatatataaataatatatcttaagaaaatctgtaattttttcttcttgctttgtttctgtgtcgtttttttaaatgatggaaattttcccggaagttcttctccccacagagagagaacagtacacaaaaaggctttttccattttctctcccttaatttagagaaattcacagttgtgcaagagtgaaagtttttcaggttggtcagaaagtgtctaagcaggaatacgctctcctccctgatagctgagaacattttaatgacagattttgcttaaataaaaaatcagaaaggtctcaagtctttcaaaatagaatgggggggaaaacgagtgaatccaatgaatcgactctaaacttatcctaaaaaaaaaaaaaaaaaaaaaaaaaagaaaaaaagaaaaaaggcaagcttccctgcatgcctacccctttgcaggaaatgtggggaggcctcgcaagtctgaagctcgggctgtgccatgtggctgctggaggcactgggtagtgtccttgtctccttgtcaaggcagcctgtcccaggccctgcagagattgcagctgaacggccctgtcctgaggtgtccagatggccttcagcgttggccttgtggtgagctggtgatgacatctttgcttggcgagacactctaaccagggaaaggtcagacctggactccctgaggtgcaggtgacaagggagagggcctgtgacacacccacagctgaaagccaagggcttctgaagaatccctgaataactgaaagtgctttctgtactatccctcgctggccgtccaaggatggaatgccatgctgacctctttgttagctgccagcgaatccatttaccctcagcatttgccaacaaggtccactgctcccagactccctgctgtttttctccagcggcccccctgcccattaattctgttgtgcccttgttccctgattcagtctaccagctgacttcctcacatctgagaaaacactttgtatgcaaaacaactaaactgcttgcaaaataactttttaaatgctctgagttattctttgatatctcaaatcatgtgtccatggggagagtggggatgggggaatggccatcaaggaatggcccttgaccctgatctcctccccatccagtcacccagttacttgagaaggactggccagcaaatataactgagtggagtgggaaggtggggacgggtgagggttcctgctaggggctgtggcataagaatctaaaaggaaaatgttgggcacagtaggcacatgacctggcttttctaatatgtgccaaatataagaattagttttgttatatattagttttgttgcataacaaagcacctcaaaacataatggcttaaaataataatttaggtcacgtttctgtgggtcagtcatttgggctgggctcagcttggtggttcttctgctggtctcaccttgggtgagcttctgtcatgcagctggtctaggacggcttctgatggctggcagctggtactggctgcaggctggggtgaaagggatagtgaggccatgtgtctatagtgagcctcatggcgatgacattttttaaacctctgctgtatcacactttttaatgttccactggccaaagcaaggtacatggctaagttcagacggaagggattgagaaataggctgtactggccaggcgtggtggctcatacgtgtaatcccagcactttgggaggccaaggtgggtggatcactggaggtcaggagttcgagaccagcctggccaacatggtgaaaccccatctctactaaaaatacaaaaattagccaagtgtggttgtgggtgcctgttatcccagttactcaggaggctgaggcaggagaatcgcttgaacccgggaggcagatggtgccattgcactccagcctgggtgacaggagtgaaactctgtctcaaaaaaaaaaaaaaaaaaaaaaaaagagacagagagagagggagagagaaataggctgtacttcttgattggaagagaggcaaagtcacatgtacagaagtaagtgaatgggatgggaggaatctgtggccttttctgcaagctgccccctctggtgtgtctgatgcatgccttccgggcgctgctgaagccctatgtaacccaagaagcttttcaaattgcatcctaatcatgcatgtcttttgctagaactacttgagattgtgcactgattcatgggacatgtgtttgattcagatttatatacccacaatggcctaaccttgttgattcttaataattattatattgaactgagttgggttagttctcctttttctctaattacaagctccttaaaggaaagtttggaatcactgttgcataaaatctccctcccagagctctcagaattatactaacggctgaaaatccggcaagttctcagaaccaccagttaagtggtagagggattaggcctagagccacctctggacagagcaactatctgaggaaagaatggaattttcaggaaaccagagactgtggtactgacacattgcatcttcaggtcagtcataccctcaatgagtgaaatcacttttttaggcttaggaggcagaaagagtcagtgactcgaagaatgtggctttccttttcccattcagggaagccagagtacaaggagcaaacctatgcctcatcaggaagagactcgtttgtcagccctgggcctctgtggcttctcctgctctggaacaggccagaacagaccacttgagggcccacggtactccctgccccatgccacactctgtccacatcacctcagtacttctccagaatccatcagaggccaacagtcaagctggtctagaatcagggctggatgactgagactaagccctaggggaggatagtcctttgtggagccacatacacactccccgagcccctctggtccagtgctactcaagatcctggttccagacttgctctagaactttctaaggcttggaggtcacctgggacagtttattccaggttgaaccaccctttgggaataagagggtgtcccttcccatggtgtgagatgaattgtcaggtcctttgtgagtcacaggcttaggaatggattttcaacaggaatttccattctgggtggttaacaagggccacaggcaatctgtccttttcttcatatgacacagtcatccgcctacacacccctttattcaccaagattctactgactgcccactctgtgccaggcaacgtctcaggcatgggagtggggtgagatgagccaggcacggttcctgtccctggagagctcaggtgcaccgagaacacagatgaggcaggaggtgcgagcaagagggtctgtgtagaaccacagaattatggcttcttagagcaggaggtaccttggggattgtctagtctattccctcattcctcagaggaggacgctgagcccaagagagggaagattagtccaggggcacgcagtaagtgggagttactaattcactaaataagcatttattgaacacctactaagtgctaagatctgggctaggctctggagatgccacagggaacaaggaagacacagcgcttgtctctttggagctccaactgtgactggttggggggtcccaaccctggttacattttagactcacctgggagccttaagaagaacacccgtgccagggctccacccccagagattctgattacttggcctggggtgggcctgggcctgggcatgggtatttttgaacaagccctccaagtcattctaatgtgcgacgcaagtaggttgagaaccatgtctaaggggagagacagcaaaacctcacacatgcaaatcaataattgggattgtgctttgttaggaatgaatgggacccagagtgaggaaacagcagggttggggtatctgctacttgctctgaatcgggagggagcgaggccacacttggagagctgtgattccaagggtcagaaggaaggaagcatagagtgtcctcacgtgggacagcaatgggatcttctgggacacatcccaccctgcagatgcagaaaaccttgcagcggagccctgtctagcagaagcttttaacctgcagcctgaaaactctcccccaccccctactcaaaacacccgctctttacacacactgtttacgagtgcccccaggccagccagcttaataatccctcacatttttagagcagtgagtaaagcactgtccaactttttatctgtattattggatcctaacactaaccccaggaggcaggcagggccaaggtcagtcagtgttcccctgttggagatgtggaaacaagctcggagaagtcacgcacggcctgagatcacatggctaatacctggatgtgggggacttcaggctagctctcccacctccagctccactaccccatgtggcccccaccttccctgcaccagcaagccacaaccaaggcggggcacctgagaggcagctggggaccagcaccctcccgtctcgctgggcagagctgccggtgcattctccccttcagctcttacttacaatcccactcctcatcaggcaatcaaaggaatctgttactcgttgcttccattcctgcccagagtgaacccagttactatagtaaccagatgcgattctttattacggagtagatggttttaattttgtatttgaagagtttggccaggcagtcacgttgccatggcttggcctgtcgggcggcagttagaagcagagggaaccctttgagcagccattagggctttctaattgctggggaaaacctatgtctggaaaaacccaggctcagctgcactggggaaggaggagggtgagtctccagctggtgctgtgctgggtactgtctcctgttcagagatgacagctccctgattagagccaccaggtgagcctctcagccagttgctcccatagtgccctgtagtttcccttcaggatcctcatgggtgggtgggtggggggctggctgctcagagggccatcaacacatttttgttgaatgaatgaatgaatgaacaaatgatcctttgtagtttattaaaccctttcaatccattgtctcctctgctctccagtatggctctgtaagggtacggagcagggagaaagagaaactgaggctcggcaaggtaagagacttgcctcctagtgctgcctcccctgtctgtgcctctcagggcccatgaattgcctggaatgttccccttgctgcagaaacatatcacaggtagatgctaaaagcaaggcaagcatcgcccgcccacaccacaccaggcctggtaccataggtcctctcctgggtcctcagttcttgctgaactgtaaggaaggcagcaaagtggagtgagaaagctgcttggtgactaactttgaagcagagcagaagcttcctttggcccagaccatcaaggagacagttgggtggacagaataaagggctcctcattccctgatctccctgtgcaagggaggaaaggaaggcttcactcggctttcagccagcccccgcaaatccacgctgatccagtctctctgttacgctttctgtgctgagggtgtatttccaggttaaataaaacctccacccaaccctggccccaacattaatttctcctaacccagcctagtttcttccggccttgcagctcaggccttcccaggatgcatgcatggcctgctctcccagccaggaggtgctgatgctggtacccttcatcctgagctcatgttaggccacaggaccctgctagctcctccttaaaggcaatcataaccagctttggagagcagcagctctctgtggctgttggtggagcaggcagcatgtgaggctggagtcttgagtgggatgtgttcgtggatgagctgggacaggcaacagccagatctgctggagggccaaggacccagtaaagagagggcatagtgtgatgataaacattccactacctcccagaagtgaggtgcctgcacaggaggcccacaccgaacatatgcccggatctcaggcctcaccctccaagaatcaaatcatcggagctggatgagactttagaggcttctcatttcagtctcagatgaagactgaggccccagaggggaaggatgtgaagtccctttcacagtcatcaaatatggtgggactccacagtgggacttaccggaagacaaaggctggacacacagcaggtgctcagtcaattcttgtgagaacagccatcctcatgaggtgacagcaggaagcatcttcgtgaaagtttagggccagaaggaagtttagacatcactgagcccaactgtcattttacagaaagaccgagaccagatccattaataatgctacaaataagaatagctaatagttacatagtgtgctgggtgctaggcaggattccatgcatgttgcatatacgaacccactgcagcctcacagtgacctctatgcagcagttattatcatcatccccagatgaggtaactgaggcacagggtggttcggtaatttgcccaggatcatggagccagtagtgttaggatcaggcaatctggctccagagtccgtgccgtgaacacttcactgcactgtctgagagcacagtgctgccagcaaacacttgctgcccccttctctgagtggggagaaggaatctgtgccagcccttgtgagttcactcatgcaggaaacatgactttttcatctttacatccccttacagggctcagctcaggtctggcaggggctcagggatgtgtttctaatataaatgagttgatctttctcaccatcgtgaaacagccaatttggcacctgtgtgctggaagggaccttgggaagtggctcaacatagaacacttgtggtcagcaaaaaggagggggtggttcccacacaccaagcaattctccaatggacactggctgagtgtcctgcaatataactcaagcctgattgtccgcctggagttagtgttggctcccacaggttgagggctcagtcccaccacatttacctgacttccgatgctagtcaccagccccaggttgttttatctgagcctctgaccaagtggctataaatcagggattcccaggacgcccttctcaggttttcattaattttctagagcagctcacagaactcagggaaacacatttactggtttattataaaggaccttacaaaggattcagatgagcagccatatgggagcgaagcaaagggcagggcgcatgggaaggggtggagcttccatgccctctctgggcacgcaacactccacgtgtccagggacctccatgtgtgcagctatctggaagctcatcgaaacacaaagaggggaacgacagacactgagggtggagagtgggagggagaggatcagaaaaaataactattgggtactgtacccaatagtacctgggtgacgaaatcatctgcacaacaaatctctgtaacacgagtttacctatatagcaaacttgcacatgtacccctgaacctaaaataaaagttaaaaaaacaaaacaaaacactgtctttttgggattttgtggaggtttcattacaccgacataattgatgacatcattggccattggtgatcaactcaaccttcgggcccctcttccttctcaggaggtggtggggtggggctgaaagttccaaccctctcatcaccagattggttcccctggcaaccagcgccatcctgaggccaccctggatccccaccccgaccgaccccagccactagtcatctcattagcatacaaatgacacttatcactttggaaattccgagcgttttgggaactgtgcctaaaccaggataaagaccaagtacattatttcttattataaatcactatatctcaggcagcgatttgcagaggaggaaagtgaggccaagagagtcaaagtgtcttagccagggcttcccaggtagactgaatccagctctccctactccacatacagggctcttgccacatagcaaggcccctaaagagcatgctgaggtggtcaggctgacctgagcccagcagcctgccccagcctgccccacctgtcctgcctggaccctgctgtgggcttcctggtcctggccacactaatggactttctgctcccaccagctcttcgtgatcgacaacggcgcggatgactggcggatagccatgacctacgagcgcatcctctacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtattccacatggggctttctgagtacagagcctgtgctgggacagggaagggaggaggagtaggggtgccaggaagtatgtggtctgatggaggagacaggcatgtacccagacacctgaaaggagacaatgggaaagaggggagtgctgagttggggttcagtatgagctagaattgcagcattggaaccaaagtaaggtgggaaaaaggcacagaattttcctgattttctgttccttctttgcaaaccaatatatcaaagcattctggttacatcagtaactcacatataacacattgcaacttactcctcttgggtattaataatgcttattagcattttaaaggctctgagaagtcctgaagtaatgaaaccatttatttttgtttggttcagcctttcttaattgtatttgcctgcaaatcctttttattataaagcactattggtaccttgctactcaaagtttggttcacagaccagcagcactggcatcactgggaacttgttagagttcccagaatctcaggccttagcccagaatgaatgaatcagaatttgcatttaacaaggtcacctggtgattcatatgcaccttagtttgagaagcactgtactgatggaacatactttgggaaacattgttttaggaggctggtggttgggagtcattcagagaagctactcatgggaaagaagggagatgtggcctgacagagatccagggctgtagaacaaaatgccaactccttggaacagccatcaacaaggctcaagggcaggactgaagccacctccttccaccaccctcgagctgcctttaatgactcttctccttgcaaggggtcctggattttcattttatttatttatttatttatttatttatttatttatttatctgagatggagtctcgctctctcgcccaggctggagtgcagtggcatagtctctgctcactgcaacctctgcctcctgtgttcaagcaattctcctgcctcagcctcccatgtagctgagattacaggcatgcgccaccataccaggctaatttttgtgtttttagtagagatggggtttcaccatgttggccaggctggtcttgaactcctggcttcaagtgatcctcctaccttggcctcccaaaattctgggattacaggcgtgagccactgcacccagccctggatattcattttaatctatttgacatgtggagtctaaatctaggttagaaaccgtgattctgctcctaagtagctgtgagacctagggcaagttacttaacctctctgggctacagtttcctcattttaaaatgaggatcacttgagatagaatgaagctatgtttgcttgagatagattatttttattatgttgggaggtatggtgaagcatcctgtgtaatttacacaaatcctggtagtcgcccttaatttgtcaacacttacgattatattgccaaatcttccatgcaccagtgtcctagcagagatcaaacaagacaaagaagtctggagaggagttagcctcaacacaccctacatgggtgccttgaatcgtatctcctacctatttttgagacattctgtttgcagacatttctttcagcgttttggccaacagacacacggtcaaactgagagggcattctgctgccgcagaacaagggttcaggctccaggatgcaggttcaggttctgagagccagtgcagtgttggaagacctttctcacacacagagccccagggacacaccatgctcacctattcagaacctcgccattactcagcagctgacattgcaacatctgctctgagtgggaccacactgcacagggcttcatgagccttctctggtaagcagacactcttcccccaatggagaaagcatgtgcttgggttccgaccccaaactcttcatggtactgttagctgagcaacattgtgctggtcgcttcacctctctggacctcaattttcttatctgaaagctggacacaggatttattgttagagtcaaacaaggtgtatatatgcactatgtactgcaatccaatgatggtgaaagttaataataatagtgcagatcccttgataactcttgggaattttgtgctgccttcttttaattagaacagcccaacttgtaccatacatgggcctatactcttcctgttttcctttctaaatgatggaagccatgttgtctattaacatagtaattgaatttgcgtagccctttaagctatttgaagtctttcacttcctcagatgctctctggcatgtatttcagatggctgaacatgcaacaaagtacctgcaagtgagtttcgtagtttattgaacctatcacaagaaggggtgactatttttcactggaaaataagcttgttttaaagaatgtagtttgcaaagtacttagatgatgcaccttatttgatattgcatggccttccatagcttccaagctgaggctgggttagtttggtccctggtgggccactgggtctctctctctctctctgcagacatgggtcacaagcccccgctaagaccaaggcacagaggaacaatgagcaaatcggaaattctctgaaagttcccttctcttgcgaaaaggccatttgaccaaagacttaggtataacatgaggtgtattaaagcatggtggatgttattgttgcacccctgtgctagttctgtgtaaaatccatgtcatcccagcttgccctcacaatagatctatgagagaggtaccttgcctgagggaaggagagcccgggtcctggaggggcatttgggtgaagcaacatgtcatccactacatggatgtgtttgaattggacatgaaggctcatgggagagttgaggaaactgatagaaagtaactggcccgaggtcacagagctattaataataagcgtggagccaaaatctgaactggtttctgactctgaacttccatgtgtgtgtcaccaacccaggctgaatcctgcacatacgaggaaatcttggcctctactctactggcaactttcccaatctcagagtcttaaggccactgagactaacatgtgaatcccagtcttgctgttttctctgcctctgctgcctatggtcttgaccatgttatcatactagcctcctgggctgccttcatgtccaattcaaacacatccatgtagtggatgacatgttgcttcatgtcaacatgaaggggacagatgccccctccaggacccgggctctccttcccttagctggggttgtgactgagtccctctcttcaggtcaaaccccttgcctgggggcagcaagctcccgaggggatttgtcagtgtgggagttcaaaggcctaaccccgtttgcttctagtaggacactcagccaggctccagggtccctgagggatcgcctaaggcctctgttaccactgcatccgggaacttcctctataccccagaggtattgatcctgagagcagccccagtaaaactcccacccccaaatctcagcatctcacagactgtttcccaggaatctgccccgttaatatattgtttcctaaacaggcaaagcacttctcttaccaagactaagcactatttttagaatcaagcttaaatgatcattctgtttcccaatgtcaaataataagtaagattggcagaggccttcagccaggacttattcagccagagactggacagaagctggaagcaggggaagctttggggaactgaagcgtcagaccagggtagtgtggacaggatgccttgatctctctcagcctgatctaatgatgattctatcaccttaggcatcagagagggtaagtgacttgcccagggtcacacagcagcatgacaggttctagaaaaatccacagctgctgatgcccagagcctgttcacattccaggtagctttcatcagcctggacttatctctagttgtatacacacacttctgaagttgctatggaaatctctctacagcaagatgtattttaaaagacagttctcatatcttgggttggtttttatgtgacaacaaaggtttttcatatttcctcctcccaaggagagaaagtgggatcataattacgcagaacagccgtgccatggggagggcagcgcctggttgctgggagggcagtgacaacagtgggcttgttttccttggcccccagagaggcattacatcatgggttccgaggcctgacagttgtggcactctgcattctctgggattctcctggctgcctgcccacctccctcagggaggaacctcctgattttacactgtcaagtgccaagcagctttactggtggagagaccatctgaggccccgggtcctcactgcggcagcaggttggagagccagccttcctagcgtgccttgagcagtgcagtggcctgccagctcacctttgtatgtttatctccttgggaggagcaacaaggcctcccataacattgatgaagtggggtgagccttgctgtcacagccatgctttataaatgaccttactgtcctcttgagtggattcccttcggaccctttggacccttcactttggtccctcctgaggctccaaattctgcaacaggctgtctcagtgtcccaggccttccagtctgtcaacaggttttttattttgctggttaacttttggcatactgatattttaatgagaaattttattctggagatctggctcctaaagcaggagaaaaacaatttgtggcccattctttctctcattaagagagccaccactcccattgtaaggagataaaaagaggcttccttgctgtactctcttctgcccctgcctcagacacccaggcctgcacttgccagcagcaggaagcaagaccacagctccctcctcctcccatctccttcccacaacctcctaccccctccaagaaggggtacttccactccaagaaaacagtaggaatggccaggctcggtggctcacgcctgtaatcccagcactttgggaggccgaggcgggcagatcacgaggtcaggagatcgagaccatcctggctaacacggtgaaacccccgtctctactaaaaatacaaaaaaattagccgggcatggtggcacacacctgtagtcccagctactcgggaggctgggacaggagaatggcgtgaacccaggaggcggagcttgcagtgagccgagatcacgccactgcactccagcctgggtgacagagccagactccatctcaaaaaaaaaaaaacaaaccccaaaacaaaacagtaggaaagtggtcattacagggatgaagcaccctacatggggttgatggaagcctgcaagctaaaccctgtaggctgagcagaactgagcagagcctgggaacagtggggccaggcactgtggttcctcatggactgctttggtttgagttataacctccaatgtggggcacacgcacagtgatccatgggactattgggagaaatgatcagaacttctacatatatatatatatatatatatatataaagcctggctagtatttaataaatggatagagagcaatacatgtctgtaatttataataaatatatgtataatggaggagggcatgctcaaaaaatttttaattggtaggagcccatgattttaaaagtttgcaaaccactggtttatgatatcagaggactagttagagaggataggaaagtagcctaccacatgggatgaagcctgctagacccaggaaccctgccctctagctggagaagtgagaagttagcctcctgtagggaaggagcagcctgtagcgatccccttctggtgccaggcggagagatagatggctggggagggggaaggtggggaggcgacagggatcctgctggaggcctttgagaaaaacctgcagcattaaggaagaggaaaataatcctgaagattcctgaaaaatgtttaattatgaaaaacaaaaagcaacattagaagagtcttgggtggccaggcacagtggctcacgcctgtaatcccaacactttgggaggtcaaagcaggtggatcgcttgaggtcaggagttggagaccagcctgaccaacacagcaaaaacccatctctgccaaaaacaaaacaaaacaaaacaaaaaaaaaccaaaaaaaacattagccgggagtggtggtgcatctgtagactcaggaggctgaggtggggggatcacctaacctgggaggtcaagagtgcagcgagcagagattgcgccactgcactccagcctgggtgacagagtgagaccctgtctcaaaaaaaaaaaaaaaaaaggaaaaagaaagaagagtcttgggcatctctaatagggtgccagaatatatatgatccttatgatagagaagagtgggcagatgtgaaatgaaaatgtatctggttcacataagcacagagttccagaaaactaaaattgttttagcaaaatgaaaatccacattgatggcactacatttttaaaaatgtggaatgtggagacaaacttaaaaaatttaaagctctctcagaatgcagaagagataagagaaaggatgaataggacagaactggaggctataggatccaggtgaaatctaagaattagagttatttcagaggaagaaatgataataatttggataaaagcataatcagaaatatacgcacagtaaacattttcagaattggcctaggtaaggggatgttgtgtgtggggatggtagatcagagtaggcagatcgaaacggattcctcttttccagttagaatgtgggggacaggaggagccacccctagacataccccaatacattctttttctggaaaatttattgaatcataaggtgaaacaatcctagaggcacacaggcatcccagagctgactctccctcaggaaccctaaattcagagtcattagaacagttccacagtattttaaatttggatccaccctgtcatttgaatgaggcaaccaaaggggaacaaaagtcattcttggagtttacttttggggggaactcgtttgccagttgaccaaagactgaatcacaattaagatcttaataatgaaatgttgtaaagaaaggcagacattggttcacacaggcaaacatgaaatcaagactaaacttacgcgtagttgcaaaactccaaattctaatgtcaaggaaaaagtagattctggaaagagtggatgtatgaaattaaagcaataattcaataataattagagggttgcaaatcctcagattaaaaatttgagaggagaaggctagaagggattagtaaaagcatgccagatgcgttgtcctatgtagaggagaattttaaaataaagccctattactcagttttagcaatcagagaaatattttttttaaaacctaaaggaaccacaggcaaaattttatgagtataacaagaataacagtagcatcagccatatattgtttcacttaatccataccatagttctatgagactgtatctgcattctgtatatgaggatgttgagacacagagaggttgagcgatgtgcctcaggccacagagccagcagacttgagactccaacaccagcctgagagccttttccctaccctgaaaacatatacctcccatgccacatcagagcccacatagctaagacagaaaaaataaaggaagcaggaaggaagaatttcaatacaaagtatgaaagaagatcagagaaaaacaaacttaaaatttataacaatcaacataattgtgtttacctccttgttaaaagtaaatgtctcttagatgagatttaaaagcaaaatttaattgcatgcaatttacaaaagaagtacctagaacagaaggacccaaaaataaatgaagagcaaagatttattaggtaagtacaaatcagatggcaaacgaatagaaattctcattttaaaccaaaatgaattcaaaacagaaatcattaaattgtccaaaagaaccatttaatatggataaaagtgctatatacagtaaaactgtgaattttatacaaaaaatgagattgataatctgaatttttaaatgtttaaattaattgagcactttgtagcctataaacaaacatcttctttttaagcatccagggaacactttaaaaaattgatcaacttcttggtcacacatttcaaaacatcagaaaagttgctcgggctgtattctctgaccacaagcctataaaactccaattaaaggacaactttttggtgggacttttaaagcaatctcctcaattacaacagagaattcaaaactaccgttaaaggctattagaaaattacaacaatgatgaccctgtacgtaaaaactcaggatgtgaccaaaggtgtactcagatgaaaaacatccttaaagtttttcaggcacaatggtgtgcactgatagccccagctacttgggaggctgaggtgggaggatcacttgagcctaggagttcgagccagtagtggactatgattgtgcctgtggatagccactgcctcagcctgggcaacatagggagaccccatttttaataacaaaaacagaaaaaaatgaacagagaaaataactgaatccattagaagaacaaaacaaacctcaggagggaagattaagtttataacaaaggcaaagataggaattaatgaatttaaaaaccagaaaaacataatttataaatccaaaagataccaacttctaaaatataaatttaattgagaaaaagaaaacacaaaattagaaattttaatggagaataactactgattcttaggatgttttaataaataagtgagaatagcttaactttttttgaaggagaagaccattgagggggctttctctactagatattaaaatgtattataaaactgaaagtaattaagtccctctggcattactgaaaaatcaataatgacagatcaatgaaacctaatggaaaacactgaaataaaccctactatgttagaacccaatatacgagaaagaaaaccaactgggaagcaatagattattcaataaatggtaatggagaaattggaagcttggatgaaaaatcaaattggaaccctagctctcaccagccaccaaaataaattccaggtggattaaaaagtcagatgtaaaagaagaaaccatgagcaagctccagaaaacaaagtgaatatttaatcagccctgagaggagaaagaactgttaagcataaaatctcagaagaaacatgaaggaaaaaactggtgtgtttgattacatcatacacacaattttagatttcagtccctcaaaaaatatgaacttatttaaagagcaaatgttatgctagaaaaagtatttgcagcaaacatgacaagaggtaaatatccctattatacaaagcagtcttagaaactaatcagaagaacttatctccccagtgaaaaaaataggctgaagataaggccaactacaaaggaagaaatacaaaaagccaataaaataaaacacacaacacatattcagtccctctaatcaaagaactgcaaattataactacaaggagaattactttttcccctctggagttgacaaaattttaaataaatataactcagtgctggagaatcttcttattgttggcggtgggcgggcatggggttgtcttacgctgagggcaagaaggaaattagaccatctttctggaaaacaatttaacaatttgtcacaggagccttgagtttgtaactttgatccaggaattctctttctaggaagctattttaatagaataatcaatttacatcaaacctcttctgcatggtgcagtttataatagaaaagaatgagaaaccaagtaaacatctaggatttcaatggctaaacaagtatggcacatccatatgatgggtagttagcaagaattttaaaaaatcaaatcaacgtgtttgttttcgtttttgtttgtttgtttgtttgtttgttacttcgttgtttgtttttgatgcggagtctcattctgtcgcccgggctggagtgcagtggcgccatctcggctcactgcagccaccacctcccgggttcaagcaattatcttgcctcagcctcccgagtagctgaaattacaggcacctgccacaacgcctggctaagtttttgtatttttagtagagacggagtttctccatattggccaggctggtcttgaactcctggcctcaagtgatccacctgcctcggcctctcaaagtgctgggattacaggcgtgagccaccgcgcccggcctaaaaatcaatcttttgaaaattacagtaaggtaggaaaatattcatgatgtaatatttgaaaaaggagcgtacaaaatagcattatgtaggatattaccgatttatagataggtgcagaaatacctggaaaatacatagaaacattaagttgatttctttgtgttacatgtaatatttatttatttatgagatagagtctcgctctgtcatccgggctgtagtgcagtggcgcaatcttggctcactgcaacctctgcctcctgggttcaaactattctcatgcctcaccctcctgagtagctgggattacaggcgtgcgccaccatgcccggctaatttttgtatttttagtagagatgggttttcgccatgttggcctggctggtggtctgcagctcctggtctcaggtgatccgcccgcctcagcttcccaaggtgtacatgtgattttcatacatgtaaacattaagttgatttcttatgacgttacatgtgattttttattactttttattgtattttcaacaatgagaatgaatatacatatataaatttttaatggaaagaggtagcatttgtttttacacacttgacgaagcccctcatcttccataggaactcatgttttacatcaacgcggggtggaaagtaaagctgaatggctcagtttttacacataattttctctaacaagcgcaatgcaagttccgtcttgaagggctctcttccgacccgtcggccagtggccttggtggacagggccgcggggcgcctttgcggggccggagtgcttcttcgcgggcgcgcgcctcccttggagcccctctgcggccggccgcttatgggagcgcccgagccggcgtgcgggcaggtggagctccacaggggacgtgtgatcgaggcaggctccactggctcttcagtagcctcccgggcgtccccgcggtgttgcggggtccggtggggagaggccgcgagtccgcgggtggttcccgcgcggccaggcggtcgtggagaggccggggcccgggagaggccgaggctcgctccgccagggggcgcagggagggccaggtgggcggtgtccccacctgcagggactcgctgtggaggagcagagcgttcaggtttcctctcgctgtggcgacagccggagcggcttcagggctgggccggcggctccagggctgctgctagctcctggctcctgtctcgagtgggatcccattctgatttcacctgcgtgattcacagtctccagtcccactccgcggccgctttctcgttctgtgatctcgtattcagccgttctttcctcttcctcattggcagtatttttgtgccctttgacacttaaactgctcattcgtggctagtttttttcgtacttttatattaaataattatacatgacttagctattataagtaatggctgatatctcttagaaaggagaatcaagaaatagggaaattattagccagcgtggtggcgcgcacctgtaatcccagctactcgggagactgaggcaggagaatcgcttgaacctgagaggcggaggttgcagtgagccaagatcgcaccattgcactccagcttgggagacaagagtgagactccgtctcaaaaagaaagaaagaaggaaaagaaagagaggagaaagaaagtgggagagagagagaaaataaaataaaaaagaaactggtaaagcaaggaaaatttccataaaatttgcattctgaagcactaagtttgggactgtgggtgcaaagtgaaatccatattgcattgagaaaccattccattttttcagtcaagtcaacccccaaattattccaaattatttgctgcattacaccaaacctgggtttcccttcactctcttctgctgggaagtcaccagtgtcttttgtctccaggatttttgccttagggagacccagttaaatgccagggttccttctttaactggggaggactatctgacctttgtcactggaatgaattccttcccaagtctgccaaagatggtacacagtgacagttagtgccatgctgggtgtgtaggagagaagtgacttcctttcctacagcggatgcctaagggcatggggcttcattctcacccgctcccccacccacctccttggaggggctgaggtaaggaaaaggaaggggttcctgtaagtgacgtcagccacatctatttgtgggctgacattagtcaagcaggaaatccatattctgtcagcttttccatccttcaactttggggttgttttgtttgcccctcgtgatcccattgtgccctacatttccggtgcagacccctccctcaaaggacgggcacctcagctccacagggccccttctccatgagtttggtgtcctaggctggctctcaggagcgcagctcttcacccccctgtgtttcccctgccctccactgccagcttggggcccccgcgccaggctggggtaaagccctgcattcctggctcacatagcgcagctgctagaagggtttttaaaaatgtgattttttttggccgggcatggtggctcacacctgtaatcccagcactttgggaggccaaggtgggcagatcacctgaggtcaggagttccataccaccctggccaacatggcgaaacgctgtctctattaaaaatacaaaaattagcccagtgtggtggtgagcgcctgtaatcccagctactcacgaggccgaggcaagagaatcgcttgaactcaggaggtggaggatgcagtgagccgagatcacaccattgcactccagcctgggcaacagagcaagactccatctcaaaaacaaaaacaaaaacaaaaacaaaaacaaaacgatgttctccttccatttaatacagactcctctgttccctgagacttggccccagtcccccagaggctgagctgagagggaatatgggtgagacatgccatattccttgagtaccccacctcgttccattcggtctggatgcctgcttgccccccactgcacagagagtttaagggcagccaaagtcccctggctgcctttgagtagtggccctggaagcctgctggccctaacacacctggtcattttgttttcccaaaaggcgcctgggagccgcctggtaacacagcccctgcgggccctctcagacagggccagacatgctgcaacgggcccagatgggctctgacactcccacaatagagggggcacagaacttagtaaaactccttttaaatatcttaaacatgtttcagctgagccaaggggaaaacacctagtacacagtggcaatcgcaccagcacaggatccatcctgtgatcaggactgcctgaactcagggtggaaaaactcggtttgacccctggttctaccattaaccttgcacttgtacttaacctgaccagagtcatgcagcctcttttgaacaccctctgggacactactttaaaagactatccaatccatttgcagacagctctgacttagaaatctcttcctattattggttaatattggttaaaacgtgtagtttctgtcttgggtcctaactcagttctctgggtccgcacgaaagaagttcaagtaccataggctggcggttaagccattgacctctgggaagatgtgagcgtggagccttgcttatgctcttactagcaggtgacgttgggccaggaaaggggataattcacaaaaagcccttagcacagtgtagaacatttagcacacggtgagtacccagtgaagcagccaggtatttctttttctactgaaggtcccttgagtatccaaagtcaggttgaatcttctctgctccaacccagtggtctccagtcccctcaaccattgtcacaggacttctggtcagactccaccctctcgctcactctcctcccctggtcatcagtgtcctcatgaagcgaaggccccagaacgaacatagtgccccaagtgttaggcatcctcccatttcctcggcattattttccttttaatgcagcctgagagtggcccatattcttagggcaaagggctcccaggcataatggcctgggaattagggagcgagacccagggcccatctctgtttagattgggcactcttgacagttccattctatagccccatgctctattgttaacttttcttcaatacaattgtaagggccttgtttagcctgaatcctgcagggagcaacttgcacccttgttccacatggccactaccagataagagccacagctcagtaaggccagaggagtggttcagccacgtgggaaccagccaggactcaaagagacaagaggctcctgtcctgtttccagctttagcaagggagttgagggctggcctgaagtccatttctctctgccttagttttcctgctgataaaagcaatagttagtttctcaggctcccgcagatttctcaacagattgtttgagcactgaagttgagatctctcctgctctctgcacacatctcatactgattccccccataccctatttcctacacaggtctgtcctttacctggacattctccctcctctgccgtttcccttcatcatgcttgctcccggagaatgcaggcactctcacaggaatgcatccatgcatcccaagtggagcattgagccacgcctctctctgagctgcagtgctctcatgagagacttgctaaataataatactgttatgtataggtatggagctctgctattcaccaggcactgtgctaggaattaaatatatcttaaagcataaaacacacatgattttttccctcatgggcttacagtctaccagggaagacaggtaacaagtaaggaaacaaaaagtagataatttcaaatctatgacatatactgtgaaagtggaaaaaagaagtttgcaatgattcttttttaaaaaaaaatttatggcattggattgggatcctactcatctggggcctgcttggaggtgtctctggggaggtgatgcttcagctgaggtctgaaggatgagaggaaatgagcccttcacagaccaagagggtgagccttctgagaagaatgagaagactgcaccaaggccctgagctggcaaggagccggggggaaggagtcactggaaggagagtaaacagatgaaggggggtgtggcagggactgagccgcagaagggggcaggaggctgaaagtgaagggccctgagtgccatgttgtggggttgaacctaagtgcagtggaaagcctttaaagagttttatctttttatttacttgttgtttcttcttcttcctcctcctcttcttctttttcttcttcttcctcttcctcttcctcctcctcctccttttcatcgtcgtcgtcttcttcttctttgcctttgccttcttgttcttcttgctcttcctcctcctctacctccccaacccctcctcctcccctccccatcctccacctcttcttctcttcttcttctcctccttcttcttcctcctcttcctcctcctcatcttcctcttccttcttcttccttcttccttctttccccctcctcctcctccttcttcttcctcttcctcttcctcctcctcctccttttcatcatcgtcttcttcttctttgcctttggcttcttgttcttcttgctcttcctcctcctccacctccccaacccctcctcctcctcccctccccatcctccacctcttcttcttctcttcttcttctcctccttcttcttcctcctcttcctcctcatcttcctcttccttcttcttccttcttccttctttccccctcctcctccttcttcttctttgccttcttcttcttcctcctcctcctcccctctctctctcctcctccacctctcctcctccttcttcttctttgccttcttcttctccttttccttcttcctcttcctcttcttcttctcccttctccttctccctctctccctctttcttccttccttcctttcttctttctttcttttctttctttccttccttccctccctccctccccctccctccctcccttctttctttctttctctctctctctttctttctttcttccttccttcctttcctttcttcttctttctttctttctttctttcttcctttctttctccctttcttccttcctttcttcctttctttcttgtctcactttgtcacccagactggaatgcaatagcatgatgacagctcactgcaggctttaactcctgggctcaagcaatcttcccacttcagccctctgagtagctgggactacaggcataagccaccatgcctggctaaatacaaaaattttttggcgacagagtctctctatgttgcccaggctggtcttaaactcccagcctcaagcaatactcccacttcaggttcccaagtattaggattataggtgtgagccaccatgcctggtgcttttgaagggttttaaataggagagtaatacaatatggttgcttctaaaaatattactttggcatctttgtgagtaaattggaggtggcaagaaaactactaggaggactaaaaaggctactgcagcaggccaggcaacagacaaaagtgacttagaagggcggtggtggcggtgtagagttcttgaatacatccctgcaccatgccaagttttatatacatcttctcctgtactgatgtcccacgcatcaaatctgtgatcaaactcatcatgttgcccctaaattctctctctgcttctctgtttgtgtcttctttttctcaggaactttacccgttagtattcgttttaggctgcaagtgataggaaacccaaaacaacaatagcttaaacaaaacagaagttctgtctgacgccaaagaagtccggaaaggtgtctatagcaggtatgctgctctatggcatcatcagggacgcaggctccttctcccttgttgccctgccatcgttggtacgtggcttcttcctcatacttcaagaaagctgctggagctccagccatcccacctaccttttagccatcaggaaagagaaatggacaaaataaggttgtttctttcttgttaaggacatttcctcgaagtaacacatgtcactttcatttacatccgttggtcattcacatggcgggaaaatgtagtctttattattggtaatcattgctccttcctgggcgctcttactaatgaagaagaggagacgtgctgttgggctgcaaccatctctcaggctcaaatcgttccccatccttatgccactcccagccccatttccagccctctatttaggcaccaagctctatggttcttattctgcggtgtcgcttgaagtcatctcttcctgctacctccctgacacagatccctgtcatcttacaccagtttacagaagtagcttttctggcttccagttaccgttcctactattacccctcaaaaaccttcaattgctccctctagaagattaagtccatatttttaaatttagtgaccaaggccctccatcatgcaattccagtcaacccatgataaaaccggtttggttcaattttagtaacatcagcaacaatggtaataatgatactttgcattcctacatggaaggttttattgctcacagaagggacagcacatggcccctggagtcagaaacgtgcgctcatagcctggcttgacaacggaccagctgtgcgatcctgggcaagtcacctgccctctattaaataagcacctgcgactggctggttcctgataaaccctgagccctttcctttcctgggcctctttcttgggatctgtagataggaagtaagcctggtctacctgcttcccaggggattaggaagttcaaacaagaggagacctgaacagctgggggaaacataaaacactggacatcctcttctgtttttcaccacgaccctatgaagtgagcaggcaggacggggaacccacggtccctatttcgtggatgaggatgtggtggctcaaggaggctcatgatctgccctggccctgacttgtagggcagtggaggaggcctgggcccttgggaccccgatcgcctgtggcagggcttttggggtatgtgttccactggggaggtgtgttacagagtgagtctgtgttgagacaaaaggagaaagaacataagacgcaaagtttttctttcagcttggactgtgcagtcattttctaatttctttgaggtcatgctgtttggtacctaggaaaggaattgtgattggtgttctagaaaaacagtgatttttagggggaagccactgcctattagtaagtacaggcagaagcggctcattgtccttgaatgccatgatgtctgttttcgaggggtggggtggggtctggtgactggctagacttttttggagaaaatgtataacaaacttaataaagtaaacatctatgttgtcaaacttactgagttaagtagatgtgaatatagttaactgagtagtagctttagaattattttgtcaagtttaacatgtgaaattgttcccacttagttaccagtattcttaaattgtcttgtttataatttaaactgtgcattttatttagagagtaaatgtgtctggaggcttttcattatttcagaaattagaggatagattcctgaggtgcccggcctgtccctgaggccacgtgatgcagaactggaggcaggtgagtctgagccgggtgctcggagcctagtcaagggtgaccacaggccgagggaggagaaacttctgacatgcagtgtcctcataggaatgctttgtggtgttatctccatttccctgatggaaaaactgaggccaagagcagtggggcaactcccccaccatagtgtggagttgcttaattgcctcgcccccagcagggggcatgtctgtgtgataatgtctgctacagtgcccagcctctgtaggaggctaggaattgttttttaataaataaggagcactatcttcgttcatggccattcattctacacaggttctcctctgtggcccagcactctgtgaagtaagcagggcaggagcaattttcccattttagaaattaggaaatggaggctttgggaggtaagcgagccagggtctcactgctggcccggggctgctgcccgcagagtcctccacctggagcactcccattctccgaggttcccttgccagctgggcatggctgtccagactgaacatcactccttccttccttcatctgctcagtgcttgaagatcccagagcccaaggtcacttcagctaacaagctgatgtccctatatttgggtgagctgatggtgctaatggcagtgtagatcttcgttttagaggataattatgttttctgaaagtctgtggagaattgtgccattgcttgagggatatctaataaaaatcacgcactggataaaagcagaccagagttcacctaaggaatcatcatcgtcatcattgtcatcatcttccttatcaacagcctcatctctactcatgacagatttggccaaaaagaaaaaaaataaaggaggcctttcgaggacttaacacccggaggactttcctccatgcctcctctctctgtctgtcttcctaatttcagtgagtcagtttttcctccccatctgtttgctttctggcactttacacaactgtctgggctctttcattttgccttctgtggttgctcaactccatcatttccctctcgatgcttctcctttgttccctggcaggctcctctcatctgccagtttccagtcctatgaagagtcagaggtgggttttagttttcaggcagcatttttgttgcctggcaacgtgtaacaagcatcttctgtggtggctgcttcccttaaaacagagccaggctggggatgcagtggacgaaggagtctctgggagcttctctggggtcatggggaggagtcaggggagggggacagacagacaggttggcttccatggtgactctgagtgttgccattcttactcttttataatagccttggcactggcacgccctctcctgccccatttcaggcaccccaggtgtccagtggtgaaaagccttgggttaggagccatcagaagttctgtgtaacttgagaggcacctgctgcagctccctgaggcatggccagcctggatgaaggctgctaggtggtttccactggtgctgactcttgcttcatcttgtctgcacgggatgccacaggcctcctgtctggaaagacacctggcttttgcctctgcagtcagcccagctgctagttgtcccgagaatgggagtgggagagagaagggggacagaatgtgatccaaaaaaacacctgacttagagctggagggggctttagagcttctttagccaaatcctcatattgtacacacgaggaaaccaaagcccaaagaagggaagcaacttgtccagactcacaccgcgagttgggcgggtctgagctcccagccaagggtctctctcctgggactggactctgccgagctcacacatctgatgccctgtggctagaaagaggcagcatgtggtgagaagtgcaccagatgcccagttctccgctttctggcctccatttgcttatctaaaaagaatgaggtgaactgggctagagggagccccaagactcagtgactctgatggtaaagctgacacagcaggcaggcccctgctgcccaggccttcagccacgtgtccagggctgctctcaccgccccaggaaagctcagaagctgagggggtcctgggcctctgagctgatgctccccaggagaatcccactgtatgcagagaccccgagcacagccacgacacttgtcaccatgaggctgatttagggcaagcctcctgggcatctgtgtcttcaaagatggtctcttaagacccttatcaaggatcagggctgcagctgcccactcccctacctaaccagctctccatctagtgtgggaaacgggtaagaaaacattctctgagaattacagctccttagagctggaaggggccctaatgcacatggacccagccccccacccttcccagatgaagagagggaggcccagagctgtgagagttgatgcgaagggggttttgctctattcccttcagaccccacaggtgagaaggcatctccagatgggtcatctctttatcctgctccttcctttccttaagtaagaatctctcagttcaagaggcagagaaaaggattgctgaaggcaatctgtctcttcatatctctttcattctgctcctggggccgaggaaatgggtgaggaggggtgcaggaggcccttggcctgagcaccaggcctggagccttcccttccagccgctgctctccagagcttggggtgcaccagcttcgaggctttagaagcttctccagcaagaaaggcccttctgagggaaaagtgtgtgcgactggctgtctccattcctttctccatatagtgttgaccttcggaattagctttattcctgacgtgtaccagaattttcagttaatcatgtaaaccaaggctcaggtgacttggctgtgggcagttggggccggaccagcccctgagaaactactcccatcccagacttcgtgacgcttcacttggccagagcccactcccagaaagcagggaaatgtgcctttctgcgtagcccaggcctatggaaagaggcgagaggtcagggacagctgcactccctgggcaggctgcttgtggtccgggagcatcccgtagtctccccaagccccacggccgtggggaccccgggtcagggcattattgtgcatatccctgtcctcaggcccctcatgctcaggccagaccctcacccaggtgcccttgccctcagactcctccccttccagccattgtctctgtctccatccctgtccctctctttctctatcttcctctctctctgattccctgggggctactttgcaacctctgctgagtcagaattcttcccactcgccctgacgtcccaggctcctccttggcaccctgtcttctctgtggcagggaaagacgcccaaccagagctcccacgtcctgccctgggaaccccactgctctgggaaacaaaaacaagaaaattccttcccagggtacttgttctgtgctgttcctctttgttcttggtcacagggtgattcccacgtccttcccacactaaccctgcctaggtgaggctgcagctttgtgtgccttccacaacatttgcttgcctggggagctgcctgcctttaattatctttggaaagcataactgagaagagcaagacacccgtcttttctttagggctcttgccaggagcactgcctatgcagcacttccctccagggggtgccattcacattgaagtcttcgtgactggcactccttggagttgcacagtgcgcaacctatgctgctgaacagggcagccctggctctgtcttactctcctgggaagcatggctcattataacacagatccaggatgagatacctgagagagagagaatccccaccagtctctccactcatctcacctccctttttaggtctccacctcctccaaggtgtaatatggtcaaagacagggctcctccaaggtgcaatatggtcaaagacagggctgtggatgcaggcaagtccaagcacacactcgggccctgccactcaattgatgttttattttgtgcaagtttcctaatctagtaattaatcaagtgatcctcccacctcagcctccagaatagctgggactatagacacgtaccaccatgccctgctaattttattcattttttgtagagacagcatctcactatgttgcccagtctggtcttgaaatcctgggctcaagggatccttctgtctcagcctcccaaagtgcttggattacaggcatgagccactgcacctggtctaattttccaattcagtaaaataggaagtgacagttatgagtcttgttttttgaggattaaattcagtaatgcgcataaagctttggcccacatggcacgtgattggcacttgagaaatgatagtgattattgttatctcttcaaataagattagcatccagtcttacctaccacacagagatagccccagaaataaaatgaaatgagaagtagatcatctctaagatctttgaggaagtattttgcaagaatcccaactactgttgttcttctctctgtatataaaaaacgatgaactgtgaagcccctttgcttccaagtcacgctctgtgactgatggcagatgtcgggaaaggctcaaccaggagagagaaagcttgcaggcgcgggcggcagactgagggccccgggcgggtggagctcaatgaaaaccacagacagacagcagctgtgagagcaagcagagacccagaatggctttaaacagaaagcagaggcccacagcagggagtgagatgagaccaggtttaaacgtcactttcccctaagtccttgttcattcacagcttccttcagtagctctgaccagctttctcagcacctgccgaccgacaaaccaaccaaccaatggaggctggtgctgggggtggagatggccaagagccggtggtgagaagtgagggagaatggggaagaaggggctccacagagggcacttgatccgggacggctttccggaggaggtgatttcctaggcctaaggggcctccgggcagaggggccagcatgagggaagctcggaggtgggggagcatggattggaggagagaataagcagttgcttgctggggtgtcataagatgcggcagtgcactcaacgctacaggagcaggcacgggcctttttcaccagcctaaggattttggaatgactcttctatcagccaacagtttccaaccttatttatgtacttgtttctttgattccagcgatgcaggagagatgatattcagacagccgacttctgctgtgggtgtgccccaggttataaatcatttccatcaggctagctggagtcccggcccttcctttccactgaagaaagcaaatcagagtaccagatagcgagagtgatattatcacaggatagccttgaaactgccataacaaaaaaaataaatcgttcacaaatgtcaatccttcaactactattagccccagagagactgtttgtctgccccagtgtgtcgctgtgcagaggctgagaacgtcccctctcctcttcccacacctaggagagggggagccactggtagattgggagcaggggagggtctggagtttcagaaagatttccctggctgcagtgtggaagggggatttgaggggaagacgggacaccagctggggaggctgctgtagtaacagaatgctgcccccaccacccctgggtacagtggtggctgggatgaagagcaagggcagttttgagagagctagaggagccaacctccaccggactgactcactggatgtggagtgatggggaggaagctcaggaacagtgtctggtgtcctagtgtggctggctggatagctggtgggactgcccacgaataggaggtgcaggaggaagagggccggggttgcaggggacctgggcagcagggagagggcaggtaatgagcagagttggggatcggttgagcttagtttacctgccacccctccagagatgtcccacgttggggggacccatgcacctactccagatgttaccctccccactttacagcacaggattctgcctggtgacatttgatgccatctgtatctggccacccagtgggtgcaaaatgcaagtttgctgattaagcaaaatcaacctgaagcaaacaaagactgatgtccccaagggatagccagctccttggaggcagaaaccctttccctctagggcagagcttcctctgtgggtcctcacaggggagggtgggagagagactgaacaagtgaaagggaaaacaagagaggagagatgagagggaggtggagacagtgcttcaaaggagaaaaaaagaaaaagaagcatgaaagagaagaagaaagaacagagaggggcaaaggcaggaaaaatagaggagaaggaggaagaagatggaggggtttggggcaagagtaacagtgcaggccagctgtgcctgtgagttcacggggttctgcttattaaaccccagcactggcaactttgagaagatgctcagagttctttccccgccctgcttctccctccaactcacctcagccttctcctgagcctgccactccacccgcagcactgtcatcccaacccatacctgctcctctgagatagctgtgtgtcccctgcgcagtggccccgtgccccaacttggcgtcacttgtctccattgtaacgcggcccttttttgccttggtgttgcttggtgtctgccttcttcctagaactctaagttcccaagtaggcaccaagccaggcacacaggagggggctcattcctattgctgaccaaatgaactcatttactaagttccaaaatttgtgtcaggcactatgcagagttttatatttttcactagtcccgtgcaaggttttactgcttcattttacagaagtgaagcccaagacacagagaggtaagcgccttccctaggccacacagctaacaggtggcagggctgggatccaaacccccgtctgttggactctctgcccatgccatctctgccacgccatctccagataccgtggaagacatgcttcccatgggaacagtgcttcttccaagcatattatttttctccattttcatgcattttattaaacatttccaaatcaggaaacatggaaatatttttttaataagaagaaagaaaacattgcaaattgagaaactgactcagaaggatttgccagatgagccatctggtttttaatttcaaagaggttgacagtgcttccctctaagaagaaaatggactgtggaaggaatggcagctggcttccctcaaatggtgcatccatttgcaaggtggagaagttgagcaagaccaagagacccaagagaagagaaacacactccaagaaaagcttggccagtgctggtgttgaagcttccccgctgaggcctgcagaggttgcatccagctgtgtgacaccagccagctgtcccacctcttccagagtttctcagaagcttctacaggaaaccactaatggagacagagatgccaccacctcggtgagaaaaagccacaccaaccaaactctcgttttcacagagcaagaacaagctgtggttgtttggcggcaagtcgcatttgtttgttggagccattgtgctctggtggtgctggttttctctccttttaaaaataactggaggccttgcaccatgctgttagttcttagggctggaaataaaagactagatttagagttgccttggaaagatccagggctgttaccttgaattacctggtagaggaaaacgtcgttattttcctaaattcaaagccaactcttgaaaaataggacacagaggtgaagtggatggaggggtggctttatacatgcatgtggtgtcctgggcacgtggtttgataggcttgtgatcagccctgagtcttcaaagccatttattttacattttaagatgtttataagggaaattgtttttgagaaaagaacgaactattttttttttttttttgccttaatgtgaattcacccactggcacaagcagtaatagccctgaagtcaccctaggccatttattcctcagctgcctttgaatttcaatgggattctttcacacgcctcaagcatttctgaaatgctcctaaactaaaggaactcataatacccttaagaaatgatgatttcaccccattttctccataaagctggaatcacatgccctagcatgctgaaggtacttgataattagaagttgattatattggggacctggacaaaggcagagctgggaatgggaataaaacccaggactccatgaaagtctctttcctttcataatagcttctaattcaggcttctaatagcttcgaatgccagtcacatacagagcctcccggccatcacctactggcagtggctgagcgggtattttgccaagctagaatggttcctgcccaggcacacgggtgctgcctccacgccccaccctgtgcccagctcactacaattgccatctttagcagccgaaaaaatacaggtttcagtcccagtcttttcgcttagttgctgtgagaagttagttaggtcagttacgcactggagctttgcattgattcactgtaaaatcaggtaacagctcttatcctgctggtcttgtcccactggcttgtgagaaagacgaagtggagccattcattcattcattcattggacaagtatttattgagtactagggatacagcagtaaagaaaacagaaaaagtcctttcctccatgaaccttatattgtaataggggttgtcagtcaataaatacaaaaataggccacatatctattatgtcaggtggtgataagcgctgtggagaagaatgactcgggagaagctggcctgctgggtgtggggcagtagtgcacttggagacagggtgggcgggtaacaccttactgagaagctgacatttgtgcaaaggcctgaaattatctgggataagagccttctaagtagagatgtcccgtgacttatgatgggattacttcacaataaacccacagtaagtggaaaatatcataagttgaaaatgcactgaacgtacctaacctactgagcatcatagcttagcccagcctaccttaaacgtgctgggaacacttatgtcagcctgccgctgagcaaaatcacccggcagcacagtgccctgtagaggaccttgtagagtactcatgatcacctggttaactgcgagctgcccagcatcaggagagagaattgcatcacagatccctaggaaaagatcaacattcagaatttgaagtacgctttccaccgactgtgtattgcttttgcaccattgtaaagtggcaccattgtaagtcagggccatctctgaaaagaacagcaggtgaggggctctgaggcaggagtaaagctggctgggtgaaggagctgcagaaaccccaggtggcagggccaatgggcgaaggtgagatgggctcagagaggcccccaggttgggggccccaggggacttcggctttttttctgagggatacaggaacttttgtcttactttttttagagggcctctctgactactgtaacaggactagcctgaggcaagcgtcgcccaggcagaagcagggaggccagtgaggcaactactgcagtggtccaggtgagagggcggtgctgatccaggtgagagggtggggctggagcaggtaagaggatgggactggagcaggtaagagagtggggctggtccaggtgagaggatggggctggtccaggtgagagggtggggctggacaaggtgagagggtggggctggtccagggtggccacagaccagggatgacaggcgctccgattctggagatattttgaaagcagaggtgacagaatttgatggagataaggggtttaagctgcaagtcaccaaatgaagagaaggggctgcagccacccagaagaacagcgaagattaaaaggagaagctgggaggagtttctgttttcctacacagcagcatctgctgcctgttctttctccacatccgtgcagctgcccttgtcactaggacgaagccccaggtgggaggctcctgcagaggctgtgacatacctctatctgtatcacttgctgaaggctgatggagcccgtgcacattcactcctcaccgcggcctcgcgaggcaggcaggacggcatcattacaccctgcttccccgaagaagcagcaggccctgagtccgtggagtgatctgctcaaggtcacagagccatttggcatgaaaggcagtctctgggctccagatcttgtgttctttctgctatgccaaggctaaccatagacacacgagatgaaaatagcacttttttttagtgcacctatgtgcccggcactgctctaatcattttagacatatcagctcctttaaccctcacagtaactctctgtgaggtggtacaagtattatcctcttttacaggtgggaagactgaggataagttcatgcagacattaaggtgcaaagcccggattcaaacataggtgttctggccctggaacctgtaggttcagctataccccagccagctttgcggcctttctgcaagccagtgtgtgggcagtaggtggatggtgctgatgccacgtgtgggagacacaggcaaagagctggggttggctgggtgggtcaggatgggatttgaagtgggtcctgaagggccagttagaaggcatcagggaggacagggcaggagtgacaggagcaagagagccatgtgtgcaaggcaagcttggagcacagcaaccctgaagcggtggtcagagcatgaagccaaggaggcacagtcgaaggcgggaggaaagcaggccagtgagccgctgcagatgccagaggagggcagtgttccgaggagagaggcaccggtggggtcagaggccgccagggggccaagccaggtacgtgttgttggcttcctcattggagaaattcgcaagcacagggttcacagctcagtgggcaggtctgactgtgtgactctgaagattgaccggaaggcaaggacgaagcagtccatttggctgctttggagttctgcagaggatctggctcaatgcctgcaaatttccaacaaacaaatcagacccaggacaaatggctagagccgtcatatcatgtagatccatgtgaaaagaatccttttttttttttttttacaaaactagttttaaaaagtattcaaattcttttggagaataaggaagaagaggcagtcatttcactttggcttattttctgtcaccctagtgctgtaacagatcacagctagtgtcatgaagctgagttcttattaatagtgagaactgactccaagctcaaggaatttggcagccaccttgacaaaggtttaatctgctgaagagaacagctgaaatcattttaacatgattcactgaattactgaagcaagcctcacttttgtagagggacaggaaaagcagcatgcaggccttagtcagtccacaagtattttagtgagcccctattatgtgctagaccctcagaaggtaccaaggaaaggctacagagaatactgtaatataacttcagggttagacaaatagaccaatggaacagaatagagaaccaagaaatagtaccacttccacatataatttatgagacagagggagcattgaaagctagtaggagaaaggatggtctgcacattaagtgaaactgagataattgcttacccatgtgaaaaaaatgaagttgtatccctgcctcacaccatatgcaaaatcaattccaggcaaattgaagacttagaaaggcaacattttaaaatatgtaaaaatgttacaatctcagggagggaatgatttctgcaaaaaccaaataactgctaattataaattaaaggatgataaagtcacctacagtaaaatttaaaacttctattcatcaaaaatactgtagagaaaaaggcaaggcacacactggaagaagatatttgcaacacacaaactgacaaaattcttattatctagaatatataaataacttttagaatcaatgagaaaaaacaaaaacaagccaatagaaaagtggacaaaagtcatgaatgacacgccacagaagagaaagtatgaatgacaaagaaacatatgaaaggctacttaagcttttatcatggaaacgtaaagtcaagtcttgatgagatcccaattcacccactagtgtggcagagattaaagtcagacaatggcaagtgttaatgaggatatggagaaacaggaactcttatccacctctggtggaagcctaattggcactggcatcttagaaaacaacttgacatttcctaatgaagtgaaatatgtacatatcctacaaaccagcaaacccagtcttaggtatgtgtcctagagaaactcttatgcagtgtaccaggagctatgattaagaatgtttgggctgggtgaggtggctcatgcctgtaatcccaacatttcaggaggtcaaggcaggagaatctcttgagcccaggagtttgaggctacagtaagctatgattgtgccactgcagtccagcctgggcaacagagtaagaccctgtctctaaaaatacaataacaataagtcaataaaaaataatgtttgtagcagtatttctcattagaggaaaaacccgtaagctatcccactgtccatcaacaggtgaatgaataaataaatcatgccatattcatatgatgaaatacaatacaggaataaaaatagactatagctacatatgtcaatataatatatatgttgaacagaaaagaagcaattcatagaagagttcactgtattagttatctgttgctacataacaacttgctccaaaatttagcagctaaaaacagcagacatttaccatctcagggttgctgtgggtcaggaattcaggtgcagcttaaatgggtacctctgcctcaagttctctcatgagattgtcaggctgtcagccagggctgtggtctcacctcaaggcttgacttaaagaacacctgcttctaagctactcatgtggtggttggcaggctgtgtcccttgccatgtggcactccacgggcttgcctcccgacatggcctgtggattctcccagggagagtgatccaaaagataactagtgagagatcacccaagacagaagccatgatcttaccataacctaacttcagaaatgaaagtctatcacttctgccatactctatgtgttagaaaccagttacttggtccagcccacactcaaaaggaaaggattgcaaaagtgtgtgaagacctcaagaggaggggggatatcgaggtcattttagaagcttcctaccatactcttgtggtatgatttcatccttatgaaggtcggaaataggaaaaatgaaattacatattgcttaggtaatcctgcctacatggaagcactatgaagaaaaacgaggaaatgataaacatgacattcagggtaatgatgatcctggggtggggggcactaagaatggagagaacatacaagtagatcccacaggttggagctggatggtgagttcatggtgcttattttctttctgtgtttcttgatgtcatttaatgttgcatgtagttttgttttttctctttggtttggtgttctgttgatatgatcaaagttacatgtgcatacactgtagagtcaatccttccgtggtatttgctgtcttccaccagctcttcccatttactgttctccagaggcagctacttttaccttcttttgctaattaattttagtatttacctccatgtctgtaagtaatatgtgtgtattgctaccttttgatgctttggtttatttaggtattatctattcccttcccactctgggagatgaaaatttagctccctttcctctcctccaactcttcctctcccttcatcttccttttataattacatcataattttggttaaagcagtaatcagtgtttacattactcagtcaacactaatttgactctattcatagttgagccttgtagtaaaaaatatgataacttttcccttcctgcagaacttttcatttttcctggagttgttaatgatcgtgtttgtttgtttgcttagttttctatgtattcgtcattaatgcaagtgcaaactctggcagttgtctaaacctcttttcaggatgttcaggcacattaagtttcctatcaatttcatctccttggaagtgtctcccagagcctcttgacctgctccagcccggacgggttgtcctccgcacctggtgtgcacctgtcctatgagggcctccctgtagcatcaccctgagctcgttacctttattccttgtcttcctccttggtttacttctttgttttggtgaagcatacctcctgtgtcttcctgagagagggtgcatgggaggcaaacccgtgacaaccttacgtatctgaaaatgtcttcgttccaccctcagactgaactaatactttggccaattcagatttctggtctctggtttggaattctgatttggaaataattttcctccagaattttgaaggctttattccatggccttctagcttccagtgttgctgtcaaaaagtccgaagctgttgtaatttctggttctttgtatttggcctcttttataccctcccccaaaacccctaaagctctgtaggattgtctcctttcccctggtgttctgaaatttcacaataatgtgccttggtgtgcatctattttcatccactgtgctggggacagtgagcctttgatctagaaactcatgcccttaagttctggggatttttgtttttgaatgatttttaaaataattacttctctccttctttctccttcttttccccccagttgtttctttctgtaacttctactgtttgaattgggagactgattcactaattttctcatattttctttccctctctctccttttaagagatgatgggggtcttgctctgtccccaggctgaagtgcaggggcacaatcatagctcactgcagcctcaacctcctgggcacgagcaatcctcctgcctcagcctccgagcagctgggggatacaggcacacaccacaatgcctaacttcatattttctttcattttcattctttgtctttttctgctttttgggagaattcctcgatttatcatcttccagcccctctaggaagacttttttcatacagcattccattcttgtctcgtgggtccagtatcttattttctctctcttacgttaattataggatttttccttcaagagttctctctgtgaatggtctgtatttgatccagagttccttctttttgtttgtttaattgactggtttgatctgtgtctttcatgttagagactcctgactgtctggggattcctggttgcctgtttatttttaaaagtaggagactaacaactttgagctgtaagggatttgagtgagcaaaagtagacatatgtctctaccatctttgccaagtcatacagtcttttgtatctctcatttatttcatgttaagaagtgaaaaaaaatccatagtccacaccctgaaagataaatcagtaactgtaataactacccttgagctcaaagaaaaattacatcttttcctcctcagcctttaaagaaaaacatggagctatccccccccccaaattttctattgcaaaaaatagcacaagattagtatgtgagtttgtgacatgtgtaaaccgctctaaaattgtgaataggtttagaaaccttttctccctcctctctactcccacagtcctgaatcaccagcccagccttctggctcatcacttcctgcttggtgagttgcatgtatgtcttatctccatgacgaagctccaagccactggagagcagggtgcatgtccaattcatctcagcatcttccgtagcccccaccagagaagcgatcactgaaggctgacaaacaacgaaggacactctcaagatcttcactcctctcctcagcacacacagttagcacgcacaggagtttattatggtgaatgaaaaaagaaacccacaagaacataatttatatgtaattccactttgatctctaatctctttaccttggcatcctcccacatatgaataggatggtccatgatcctaagggcagccaaacagccagggagcacgagtttaatcctcagggtttgcagggaaaggaggactgtggagacccacgtgcacaagaaaatccatgatgtgcacagagggcaggctacaaattaatcctaacttcatggttcggtattcaaggctctccattgcttctccctggacacctgcaaagcttctagcagcactgcttatctggggcctgacccctttagtcagtctttcatgtagaagaatcattttcagatactaagtatctcatgtcttttctttgtccaagaacttacagttgatttcttttgtgtctgtatcaaatagttctccagcctaaacttcaagacatcttcatgaatgcctcaccactccactgcacgtgtaaatccatgcccctgtatttttctgtctattgtttctcagactgataacacctgcgccctctcagcaacaataatggctgacatttagtgagcacttaatttgggtcactgtgctggtattgcttgtgggttattttacttaatcctcccatcattggataaggaaattgattgacagagagggcacgtcacttgcccacagccatggagctacttaactctggagctggagctccaagccaggcaagcccagcccagcccaagatcactggctcagctcaactcctcactgctaaactgcctcaaccacatttcttcagaccttacccaagacttatcttccaggaaatgtttttcggaagaactgaggaccctggctgtgactgtattacatttatgtgttgcaggcttgtggcgtggagctgcctttacgtcttctcccttctgtgtcccctcccacagtcactgagtcttgctgctttagagaagctaaagtctgattttccaccactgcctcagcacagggcctgaggatagggtctgccaccatccctccagccagaaagcaacctgctgggaagggaggggttgcattgacctgagggcctagcagggcagagtgagcaggccagggagacagctgcctttccaaggccacagcagaactgggagggggctgatgcgctgggtcacggtcaggggtagacgcaatcctgggaatcagagttgggagccaccagcctgtgctactcaaggatagccaggggagcaaaggcaggcccagcccagggaaatgaggcccacgcagccagccaggggcccctagggtggtaacagagcatccctggggagcaagtatagcagatggagtgggcaggcaaggccatctcattagcagagctttggggagggggtatcttttcttcagatgtccccagaagtaccagacacccatgtccttgtgcagacagccacaaaaaggctaatgctgtgccacccactgggtctccagttgctggccaaggactcaagtggggctggagagcccaccattgatgtgctcgcgggaatctgctagggccgggctccggtgggtgagaaaggctgtggcctgcgtctctgtcccagctttgcacacctgtttcttgcctggtcaccccacctctgtgtcctgtctcttcagataccctgctcgccacccgccgaccattcttcccagcaagctgtgttatcttgtcattcctgtgctcaagaacccagaatctcttctaaggcctctaagacaagatccaagcttcttctcccagaattccaggccttcctaaatctgacccctggtctctgaagccccctgggtcacctgctactggagcccaggtgctctcctctcactgaagcttcctcattattcccaagacacacgccagtcgcttttgcctctctgatgttgagtgaaacagtgaaaggagcatgggctttgcttcctgtgtgtccttaggcaagtcacccagtgtctccgtgcctcctgctgcttacctgggaaatactttaaagactgttgtgagatgagaatgtttgcgtacaaagtgccagccacacagtaggtgctcaatacatgcacagtatccgtcataccatgctcttgctgctccctgacttgatggccctgtccctttctgactggctgagctcctgtctccttccaggcccatctctagatgcatctacacatgcagcctgccctgcacgcctcacttaaggcgccaagggaaggaaaagcagcatttgcctatcactcgctgggcacagaccctgtgggggcatggagattcctgatgacggcagcgaatccttccagggggcttccttgtactaggcctgtcccggcacgttgtgtgcattaactcacggaagccccaatggtaactgacttccatagattaaggttcctaaatggcttttctgctctatccagcctagtaggtttggtctccctggccctttgttcttagctttccccatccagtggcctccaagtggttaagaggagattttatcaagaggtgaagccctacagtataaaatacagagtctattgtgtgttgttcaggctgatcccattagagaacggtttggaagaggactcaccttcaccagccctgccacccagcctgcaaccagctcccttgctgcactttgtgtaagccctgggctttcattagggttctctgcccagagcacccgttcctctgggcctgcctggaaaatgcaagccttgctcctctgtggcacctctgtggaccctcatgtgtttgggtcaaggtcattgccctctgcctccatccccagggcaccttgtccaccccctgattgcacccctctgcagatgtctgcctccttggcaaacccctctcttgggctgggtccctgagggcaggggctgtgtggtattcatctctgtatttcagtacttggcacagagcctggcatgcagcaggtcttggtgttggggatgaagggagggaggaaggggatggggtggaataggcatccgggcagaggaaatggtgctgatgtttccagttggttcctcccagggcggggcagctacaagcccctgtctgactcagaaagggaggcctctgtggacaccccagagccccctctagagacagctccacgagagccccaaccaccacagcttccctccagacccccgggagatgccagtctttgagatgcttcaactttcttagaggaaatcgctgaatatgtttggtaatttttttttgacattttccctgttcaggagcttgtgatttcagattaatcacatccacatacatttagactgtcggcttggaagggaaaatttgaattttattactgcatgatttcatccaaagctatcttaccaacactaaaaggatgtctacaatgaggtgcaaatcatgacaaaacattttatctctgggaccaagctcatggcgggaggccaacgggacggggggctgcaggtgggacctgggtgggcacagttgcagccccttcagtagcctaaagagatctgtgtgagccaccgtcactgctgcctcttcctcagcaaaatatctcatttccttccccgctctaggtttgcccacagcccttactcccaggaatggctgttcatcgactaactcctgtcttcccattggcaggtaccatgaccagcaggacgtaactagtaactttctgggtgccatgtggctcatctccatcacattcctttccattggttatggggacatggtgccccacacatactgtgggaaaggtgtctgtctcctcactggcatcatggtgagtacccgcctctccccattccctacccttaaaatgtggcaaagagctgaactctttcttgcaagcacataggggccttcctagccgcagagcggggggtggctgttagttaaccgacctgcatgtgtgtcccctacacataaaatgtcaggtgggaaatctgcaatggtttctcacttttcagttaacttttctaaggtaagaatgagacctggactcctggcagttaatggtctattcacagctccctcaaaatgggctgggtgaagctggtcctggcccaatgctctgatgcccaccccactgctgtgcagccacccagtttgctcacctccagtgagcactggagcttgcagtttattgtcctccttcctgttgccttggtcccactgaccttggcaccatttctgatcatgtttagctggaactcacagaagcagggactggggaaagagcactgagtcggcctttgggacctgagtcctggacggggctgtccacatggccctgggctggctcttgcctttcccaggcttctgcttccacctctgcctatggaggggctgggctctgagtgccaagtgctttgcagcactggcatttggcaaggctgtgatcccatctccaggtgcccagcaggtgtgccgtgccctttcaaggtgtatctctcctgcccagtgccctaccacccacactcgacactctcgcggaggcacacactctcacctgtcacatggccatcacagtgtggcttatgagagggatgtggggtctgagtttctgctcactgtggaccctgggccaggcactctgcatattggacctgagcatcctccaggggaaagtggagatggagggcctgccctgccctccccattggtttgtgcaaggaccaaatgcaatgatttatgttaaagtgctttgaaaacgagaagcggccacacacaggtcagtgttggtggtgtcctcagtgtccttcagttgcaaattggtgaagtgttccctgggcctcattgcactttgggtccaggacaggcagctgctgctctttggccttcgtcctggaatcctagaacagtgtcagaccagggttggacacttttttcagaggaggaaactgaggctgaaagaggaaagcacatctaagcctgggtagtgttgggggaggtggcggggtgagaagtggtcaggctgcttgtggtgtggctctgggtctccatggctggagaccgcaaccctcccaaggacagccccccgtccacagcccccctcacacctttgtgaaaatccttccttgcagtgatccctcagattccatttgtcacccccgttgcctccagaagagatgaagaccctctttctggaagggcagtgacccctttctgcagtgcaaagggagggccgcaggtcttcctgcagggtctgagtgaacgcctcacagcggctgggggctgcccccactccccaccccactccgtcttgttggcttcctggggctgatattggtggaccagacagtcagacccaggcttggggcagtcagcctgctgagcaggaggggccaggctctctcctcctttctgactccagtccagggcaggtccctattagcaggcaggtcctacgacagcagctaatgacaaaaagcttagcgctggggttgtgataaatcacgggtaagtgcaaggctttagaacaaatacctcccatcggttagtaggagtctgtcttggcatagcaccaactgtcatgaggaaaccggggaaagacgcttcttaccagaaaggaatgaaatgccactgaaggccaaatctttccttcttagagtcactcctggggctttgtgcctcagaaccagctctcagccagggctggcacagagcagggttgccagtaggtggatgggccctgccgggagcctctgttattttaaaataccgaccttttcccctctcagcacatagctgtccccatccaagaagcagcaccccaaagacctggcttcctggttcctggactccgcatctcctggctctactctggcacagctgagcggaacaggcgagaccctggccccacccctgcctctctttggggtccggaggctgtttgtctttcagcacccccttttgctgtctgggtgtgcagtgctcccccagagagagcgttctgttccctgtggattgaggtgtgatcaaagtggaaagaagaaacggacgatgaggagccaattcccaccttccatatgaaaaatacagcccaggcctttcatctctttttgtacaaaaccctgtgcataaatatacacctttctatatacaggaacagggaggtttcctctatttattgtcagtgtttttcacccaaattaaagtcagtcgcctcactctggggtcagccacagtgaggaaccctggtggcatttttctaacaaatgtgatttttctagctgagtcactcctagccagggtttcactttgctgaggatcctttcccctcctcctcccaacctcccaacactatgtatagctcccaattattattgcaagtgcctttactaaaggtagggcttcctgtttggttaccatggacaccaggaaggccaaggcaaggcctgcttgggaagggaaaggaaggatttgtgtgtgtgtggcctgtaaatagtcttaatcattgttttctcttggcaatcccagtaacaatgtaattatcaaccattaagcagggtatataattgtctgaacaacttgccatggctggcacagacctggtgtgtttgagagatttcacccacaaaagcagctacattaaagtccagcatctttccataaggatttttcatgatcatggtgacaacacagtagagagaaagctgtcaatatttagtatccagaattggaaatgacagtgcaacctaaaagatgtgcaatgctgaccttctgattctgtaggcatctggaagaccccaaagcccccaaggctgcttggcataactttgtttcaatctagcctctttctaaagctggactctctctgtagacccttcatcagttatggacaaacaggcaaaagcttctggatatctgcagggacgctgagcttttccccaatggcctcatgagagatgcctctgaactgccaagggaaagtgatgatgaagtaaaaggtagcacaaattgagtcatttcgggaggaggcaaaaagagggctcagcaagacatctgcttaatgtcagttttagaagatgagcttctcccgaaacaccttggtttcaaaccaattgatgttattttagttgttgcatggaatctgttgcagaaacagaatccaactgtaaatcctccaggcttccctcctccatttgtcactttcatttgtgttttattttattttatgcttctttagttaagaacacctcatacttttccccttgggatacttgtttttccagcttctaaggttttccagctggaaaatgtttcttgaaaacaagaggtgggaggactggtgtggaggagtctcggtccagatttgggtccgaatctctagagttaggcgtgttcaccccgtcccagccaccctctctccatgcactcggtgctccctctcgcccacgtgccttgggaagttccagctcatcagaagtggaccccatccactcccctcgccccatggaactggaagttggacagagcacatccagggactccagttgatgtcccctgtggttcaggacttggcatatctgaaagcaaaaggctgagtcatggctcttccccccagtctgaccccagggaagtcatagcagcagctgtttaccctttcccatcctgcttcctccctcctcacacaccccctctacccaccagccatttcaaagattccacagttagccaggccctcggtgatttgtctcttaaaactaacctgcatcactgccatgtgacacagcactgccaggctgccactgtggcctgtcagactattaactcacctaagtgaaagggcccagcatcccaaaggggacccaggggacaggcaatccttataccacttgaagatggacacagcagggtgggatcccttggcacttccttcatgtcctctaaagggccaaaatggaccattgacttctggctcaagccttaggctccttgttcttccttcctctctcaatcccatcagcccatcattttttcttattcttcagcctcctccttctctctttccccccttgacccttgctgtttaggatgcgacgcaacttgttccccatctcattttctgcccagctttacctctccctgcacccaccttctcttctcttctcttctcttttctcctcttctcttctcttttctcctctctcctcccctcccctcctgttctattgtcttctctcccttcttcattttcccgccccgcaccccgcacagtctgcagaggctcagcagtctaggcttcaggattcctccaccactttctgaaggctgctgatgtctggccccatctttattaggttgcctcttaatggaaaagaccaggttaggtgtcattactggtgactgccctaattacatccagtcaatggaaaaatgaagctgagagcatccatttaagttggaattaagggttaagaatgcagcatcctctagaggaatactcacaagggagtcataacatctctatgttgaaagaaactgggaagtgtcatctagtccactgtcctgcctccagagagaaatttatcttcatcatgtgagacaggtggttcattagataaaacactctagcttctcattaaaagccccccctgcaatcagccaactaaaatgtgggccatggcaagcgctgtgaaacaccccatctagaccctggaaatttggaatggtggatgattgattgttgtgattacattcccaaaatagcatggaacagggaagctccctcttcaggcctattggaccccagctttcagggatgatttaagtagagttttgcctgggcctagcgagaggagggagaatggaacctggggagaaccctctccatctgatgttccatttttaacgctatgatatagccctctttttgggctttcagcccaaagtacttttggaactccatataaaggagagggatgatactccgtccggtcgaggggaagggagcacacatcttccctctaggatggcttcttttaagctattttttgcttttggaggcatggctaaattgattacagctacagaccaggctgtgcaactgcccagatcctttgaaaattgggcacagagtctcctgtaagtcacagaagctgaaaaaacacagccgtcctcgaacaaaagaggaaaatgaggtcagaaaaggaaagttcacacagacttggttcttttcactttgtgacaaggccaacaaatgtactgagaaacactagattgttttaatggggacccttgtgggaaacgaggagaaagcattgtgaacttcaaccacattgaaacttcacacaggctagcctttgtcagcctgtgggataaagagagaaatagcttctaaaagagagagtagggaatggatccacccatatgcattccttccaagtcggttatagattatagtacctttgaaaaacattcttttctgcttctcacacattttgtaagacctgatgagccaaaaatgttactgacagattccttccattctgggacctcaactgctagactgggttctgtggcaactagaattactgtttgacatacaggattcggttgttggctttaataagttcatcatctctttccatgagtggtggtcagggcggcgcagggcacagcatgcaggcagagggcgatggtctctgacgggagtccgcttgcagaaggatggagctgactcccgctgcctgccgaagagccaggggagtagtgagtctctgaattccccctatgctcacaagccaaccaagaagcctagcgaagaggattttaaaatgcattgggagaatgttggaatgtgcagggaattccctgcttatttcccagacagtcaagtatgcacccagaggattaggagagagaaagtgagtcccaccattctgggggctcagcagagcctgcttccttgcccaccctcccccgggctcccctggcacggacctaccgagcagactaggatcgctgttccagaaaatcccaagggtctgctgcgggctcacttaaaatcccggttttgatccagcagaagtggtgttgtctttaaaatctctgcatgacggtgaattcatgagcctcctggtgaaggcaggaaggaaccgattccttgtgctgagtcatagcgtaaaccttgaggtgaaaaagcccaagtgtagagcaggcacagtcactgagtgcacgtgttcgtgccaacctgggtgccctctgtgaaacaagccctggggaaaggtattgcctcttcattcgattattttcaggaacactctcagccactggcaggtgttccatctgcaccccagctgatggcctaccttctttcctcccaggcctgctggtctagagctggcagtgggatggagacctgcctgagggagagagggcccgtgtgtgctggcccctctgtcttccgctgcacagcttggcagctgaccaggtgcttatttgttggttaaaccccccaaagcctcggcgccacccagcatccttctccattgaaactggctagctcagcctcccagaggtcagctgcagagcacaacccaagaggcactgcagacccctctgtgggtcaggacatcagagtcctgacagatttcaacagatttttgtggcttggtcgtgaccagccagagagctcaagttcccactccactcccaggaaattacccccgtggccgccaggcgtgttgagtctctcatcttgcctcttaatgatatgttctttcccctctggtcctcttgatgtccccccgcagggtgcaggctgcactgcccttgtggtggccgtggtggcccgaaagctggaactcaccaaagcggagaagcacgttcataacttcatgatggacactcagctcaccaagcgggtaagatgccacacagccatgtcttatgggggacttaaggccacagtggaagccaatcagaaagcaaatggtccaacgggtgcagtggctcacgcctgtaatcccaacactttaggaggctgaggagggtcgatcacaaggtcaggagatcaagaccatcctggctaatacgttgaaaccccatctctactaaaaatacagaaaattagctgggcatggtggcacacacctgtagtcccagctactcaggaggctgaggcaagagaattgcttgaacctgggaggcggaggttgcagtgagccgagatcgcactactgcactccagcctgggtgacagagagagattccatctcaaaaaaaaaaaaaaaagaagaaggaaggaagcaaatggtcatgtcgtatgggtttgcaccaggcttttaaagggtgtgtttgagggaaccccagacacaaaatggaaacagcaccttcatacgccgggttcctgtcttctgttcgatcactgtgcatggttcaggcagccaaataattttcctggtaatttaattaatagcctacaatggtataacctgcccctttgcctgatgataccaaataaatcacggtatgaggcaatgttttttgtttatgctcaaatattttcaggattctcattaggaagggcaaaactatattgaaaatatacctaaaactataaaagtatattgaaaatgtacctaagtctaatcctttaaaaaaaatcatttaaagaatcattctatgctgggagcggcggctcacgcctgtaatcccagcactttgggaggccgaggcgggcggagcatgaggtcaagagatcgagaccatcctggccaacatgtgaaaccccgtctctactaaaaatacaaaaattagctgggtgtggtggcagtcacctgtaatcccagctactcaggaggctgaggcaggagaatcacttgaacccaggaagcggaggttgcagtgaaccgagatcgcgccactgcactccagcctgggcgacagagcaagactccatctcaaaaaaaaaaaaaaagaatcattctagtagagcccacatccctaaataaaattgttcatcaaaacatcatcatccaatttttcccttttgggttttccgggtaatgtttctcacttgaaccattatggaagtggttatggaagatgaaaatctgaaaatatgcaggaatgggtagaccatttagctgctgaaagttggacaccccactgaattgtctgagatgaaaagacccatttagaatagacagatacaagccttccagaataacagcaggccaaatgggcaaggcaggagctgtttattcaaggacagcttttatggaaaattctttagaactacagcctgaaggaaggtcagtaagatgatttcctgcaagactgtcctctttctgagacgagacagaattaaaaccctgtgcccgtgtctcggcctccatagtctttttcatttaggactgaagtaggttaagggacccatgagcaaccaaattttgatttgggtttttgaaagctagagaaaatattcagtgattaatgttgcacagcagcaaaaatgtgttagaaatagagacaacggcaggaaggaagaacaaaaagagagagagagagaatgacagagggagctgcgagcgagctcttggggaaggcagtgggagagtgtgcagcggccaaggcctctccagtttctcagcagaattatttatggtgtttgattgtttggtctttgattacatttattggattctgtaaagagccttaacagacattaaaaggaactggtacgggcaaatattcttatgttgttgacattcaagtgtttgtacttgatacatcatggccctgagctatcagctgcaccaaaaaaagccatgatttgtcacatcacgatggcagtgattgaaggctgttatcacagtaaggcctgccgggaaccctgccacttggccactctctttcagccccctctaataatgggtgcaaaagtcatgctcagtattgaggaaattattcaagttattgaaacacctaaatgcaaatccacttgcatctattttcctgaagcaatttactgaggtttcactggattgaaactacgtgccggagtgagggcagggagatgttttgcctccaaagccttctcataagctgtttaccaagagtagagacattagcagtctctctgtttattctggttttcttttttaagccaagaatattctttgtatttggtgttattcctttgtcctctccatttttcaccaagtagatcagacgctagaggaaaataaagctgaggaaagccagctcctttgtatgccaggaaaataaacaatttttctgcaatataattgtagaagatgagactgtggttgctaattttaatctttcaaaaatgattccctaacatcctcctcaattccacttcttgaaaagtaggactgaaaatcaaatcaacaaatatttattgctcacccatgaatctaaggtagctttttaatcgaataacatctcacttttctgagaacacttaaatctgttgaaatgtctctttaatatctaatatcttttctcaaggaaataaacaacacagaagggatggttcttacagagagaaggttttcaaagctggcaggactagaacttctgaaggttcttttacataaccttaattgaaatgaaactggatgtgtgcatccttggcctgctctggtttgagctgactttgacctgctcacaagagaaccccacctctcttcccctggggatgcctggcctgccttctgtcctcttgaaatggtccattgtatcaagctggagtggctcattggtcaagaagatgctaagcagccgggtgcggtggctcacgcctgtaatcccatcactttgggaggccgaggtgggtggatcatgaggtcaggagttcgagactagcctgaccaacatggtgaaaccctgactctactaaaaatacaaaaattagtggggcgtggtggcacacacctgtaatcccagctactcaggaggctgaggcaggagaatcgcttgaatctgggaggcagagtttacagtgagccgagatcccaccactgcactccagcctgggcaacagagcaagactctgtcaaaaaaaagaaaaaaaaaaaaagaaatactcactctcagacatgatccttagaagctcttggccgggcgcggtggctcatgcctgtaatgccagcactctgggaggccgaggcagatggctcaggaggtcaggagattgagaccttcctggctaacacagtgaaacgctgtctctactaaaaaaaaatccaaaaaaattagccgggcgtagtggcacgtgcctgtagccccaggtactcgggagactgaggcaggagaatcgcttcaacctgggaggcgaaagttgcagtgagccgagatcgtgccactgcactccagcctgggcaactgagcgagactccatctcaaaaaaaaaaaaaaaaaaatgctaagctcagtctattcataacatctcagtgaattctcagagaaagatccaacatgaaggagttgactgtggcataattgcaacctcttcggagtgggcaattagtagatttgacagataaaagcagtctcttaccggtatatgcaaccttgatgcttcaaagacctacgcaaaacgaaaaaaggaattgtagctattaatcatagaaaatactcaaattgttctagtatttattcatcctgtcttgctctaaagactgcagcctagcctttgccatgagagccagcactatttttatttatttgtttgtagggagggaagagggtctgatagcactgggtaagaactcaatttctgcttttcttgagtcccatgcttatcttctttcctcgtatgacttatcaactctggtggcaacgtcatttctgtatttaattcaatcagatcttcccacactgacttcgcagtgtcactgccattgttattctgtaattataacttattgctaatctctgggctactagataatatttaagtacatgattcacagagggactggaagaaagatactagagccccatcttttctgccacttagtgttttcatgtccccatctttctgttttatgtagctaaacagatccatcacagaggccactccctgggtgccacactctgtactctgggggcaccaagatgggtaagaggtggtcctcacctccatccctaacctctggtggctgactgccctcagagagcacttcttcttataagaggtagagtgggccgggtgcggtggctcacgcctgtaatcccagcactttgcgaggccgacgtgggcggatcacttgaggtcaggagttcaagactagcctggcgaacatggtgaaaccccgtctctactaaaaatacaaaaaattagccgggcatggtggtgggtgcctgtaatcccagcttctcgggaggctgaggcaggagaattgcttgaacccaggaggcggaggttacagtgagctgagatcgtgccactgcactccagcctgggtgacagagtgagactccatctcaaaaaaaaaaaaaaaggaaagaaaaagaaaaaaaaggcagagtgggctgctatggacacacttggcttgggaggcaccatggaccggagatattttctttgcggtacctactctccacatcaagccacagtgagcagaaccttcagacagcacagtgtgctaaggatcctatctccttcttgctgcaggggtttcttgccccaagtagctcacccaagtacacttccccatgaattcaatgaataagaccaaaattaaacccacaacttccctaaactatttccttctcctaacttccctggtgtgctcctgacatcgtgttcttccagacgccaggcctaaagacttagccccatttctgactcctctggaccctggaccccacgagggtctgagcactttctgtgtctgatttcaccttgccgtggctgttcacgcatgcccgcctctccagggcctcggccccgccactcttgaagccgccatcttctgtctcgcactatcacagcagcctgctacctgctctcctcacttcggcgtcccttaccccagtcatcctgcactctgcttccccatggatctccttagactctcaggcttagctctgaacatattacttcctgctcaaaaacctttaagtagtttccccacctactatctcctgaatgacactgaagaaaacttttctttaattacaagcatatgccaaagtttgatcataatcttgctagaagaaaattttcttcagcaggctaattcaaagattactcttagtagtggtatttcgtaggaaaaacaatggtagtcattgttatgccagattatagaaggtttagctaaagactgctaatggacagctggttgggctcaacagtggatttccagaacaagtcttcaagtctttacaattgatcagataatcaatagggcagttatcaggaatgctaattctccccagaagaggattataaattacatcacgcacaaggttctgtcccagacagattgggtgcaggttttctttagcaatagtcacagaaacaatgtgcgtttaagctggaaggacccttagggaagagccactccaacccacatgagaagacgaaggcccagaaaggggcgagggtgggcccccggcctatgcaagatccactttgctctcagaccatcaggcaggcagctttagggcggtcagttccttggaactcagcatggggttagggtcccagacctgctgaaaagaaaagccagcttaactccaccctaactgagtatcacataaatagcattatagaattatccaccacccattaccatattgctacagggagaacctcaagctccaactctgaacaacggaaatacacctcctctctctctacccaatttcctgccagccagagaggtggagctcccagttctaagtggtcagtgagggcctctgggtgaggcaggcagagaagcctgtaaagggagtgtggaatagaacagggggaggaaaaagaggaggtgcaagcagggtgatgaaagagagggcagccggggaagccagagcaagtctgcagggtggtgatgaggggagagtgggcttggcaaatgggaaagaggaaccagcccccttctctagtcctgtgtgtaatggacaccttcagtcaagggctggcttgcaggttctccgatagtgatctgatcatcactcagcctaatttcaacctgtgtaactccttgaagttacagtcatgcactgcataacaagtttcagtcaatgatggtgcacatataccaaggtggtctcagaaggctataacagagctgaaaaattcctctcccctagtgatttgtgttacagtggcctacagtacaggaatgtgccatacaggcttgtagcctaggagcgataggctataccatacagcctaggtgtgtagtaggctgtcccatctaggtttgtttaagtacactctgtgatgttcacacactgaagaaattgtccaagatgtgtgtatttaaatcacacccaccggccaggcctccctttccccgtctccaacctccaagtagaatacttccctggcaagggttcctggcagcataatgggcatgctagtgatttcttctctggggggctctgctaatgggacccctggaatttcccagggctcctggggctgctggaggcttagggtgcccaagaaaggtgctcctttcatcccccttgtactcctgccccaagcattcttgccgcaaccgacagcccctctgtaatagcaagtagcaggttacctgggcagagaggtggccagagcaagtcattgacatgggatgctgcggccaagagctcaaggaagaggtgtgtgttctgttgtatgttttcttgctggctggggaagttagagggaaggaagctgacatttattggaaggagagaatattaacaaaggtaccatgtattgaggcatatggccaggatctgtgctaatgttttaagtatattctcatttaatcaacacagtaatcccatttcacagatgcaggtagtacttgcatcactctctagccctggaccctgctttgttgttgtggttttttaagcgcttgttacctgatgctatcatacaaactgcataccgtcttctccgcaggattgtaagttccgtaagcgcagcaatgttattgatttgttcactgtggtaccgtcacttgctacaacaatgtctggcccatcataggtgctcattaattgttcctcaaatgtatgaacaaagagagtctcagagagttcagcagtgggtccaaggtggagctgatgatcacgtctatttatcaagtttttctgagggttaatgaaccagtgcagacatatgtgcttagcacaaagcctggcacgtagtaagcactcagtatatgttagctgtcaccataatttgcaaggtcttcattggaccactttcttgcccaggcccattaatcttagagcctttcctaaagtagatcatagagcccattgtctggccccaatcagagtgaaagcaattttttggtagagagtttttgggcttgcagaaaacaatcagccaatttgtttatgggttttggaggcaggacagctggacttccattcacaaagggtcctctcctaaccatccccaaacccatccgattgtggccaaccttgagccactctttctggcttgctgctttcatcttaagccctgccctctcgcactgctgcaccctgagagcatcttttggccctggtgcctctgcccaccaggagaggtcaggtggtacccaagcctccctcaaggaagggtgcatggagccctttggaggctcggcaaatctgaggaagggcacatgacctcatgtgctcccgaccccaacaatgcttagatcaatcagccaggtgaactggagggagaccctggccacaatagcatttactgtccacctgggaaagcacagtgcagttaaaagcctatttctttttctctcgcagatattgatctacttagctttgtgccaggctgtttgctggtaattaatttcagagtcagtgcaagggctggcagttaacatcactttcccgaatgcacggaggcctccctccaaactcataaagatgatgtgactgcctctctcagctacccgggccgtgctgtgacttcagtatcttacatttgggctgacgttaagtgcaggacctggactccgtgttctgtcacattgctaagtgagggccatgatgatttaaaaaaaaaaaaaatccagtgctctttccagttccttgatcctggaaaacaggaaatgattttgtttgtctttccttcagtccacatgaaaaccttctgctcttcctggacgtggctcttgttttgactttgccattagctagctgtgtgattctggctctcacatcccatctctgaagtggtttcctcgtatgttcaatgaggggtttgagctagataatattaactaatatctgtatggtactttacattttatgtagcattcacacccacactgactcagtttgccattaataattgtctagtcttggtctgtgtcttggtttcttcatctgtaaaatgtggataatgttagcacctccctgatggggttgtggtgaggattaaaggagcttagacatatgaagtactcagacctgtggctgcacctggtagatgttaagtgttgcccccagcaccatcatcactgcctcatagcagccctctttatttttcccatcttacagataatgaagcatttgctcctaaactgcttaataattgacagagcagggattcacctgcagactttccagtttccttgaggctttcctaagaggctaagtgcgtagggaaactgaagaaatgacacatccaattgcctcctctccctgcaagaggagggcagtagtattaaatgtgtgctctgcagagagcaaggcttcccttccgtgccgccttttttgccaggaggctgctgttcactctagttccctgagcagaagcccagagaccacagtgtcctctcctggacatccaccgtttccaactttccaccacaacctgcttcctttcaggcaagaaagtactagaggtgggcagttaagtcatttaaaactattttcacagcagatctttactgaatttttaaaaagcaatatttatgtcccttagacatttctgagaagacttagctgttcttttaaaaacatcacttcagcgccaatgaaaaatataatccagccttagtaataaatttttaaaacatacacacacaaaagttatcagcctgcaaaacaatgtttcctaggcttcccacacatctcagtattttaacaacatcccatctgttgatgtcagtctgaagaagcaggtctatattctctaattttattaaaatcctttctggctagtaacctgatttctattaggctggcctacttatttccaggccccaggcctgtggacacatgccagtctgcatggctgacagaaatggggatggttaatcaaaaatctgcttagcatgtgcttaataaggaatgttttctgttgctcttgttactaattgctgaagatgtctgtgtttggattaaaactttgtcccctgccatctggatgccattgatatgtctcagctcagtcatgagcctggtgatatcagtggtttccatgtcaatggatgacagcgtcatatgttgaaacgtgtgattgcagtgcacagtgaaggagccagccctggggaagaggaagctctggtttcacacctaaatatcttcactgattttcagacattgctctgaaattatttcttttttgtgccaattacatttacatgtacaattgcagtgcaaatgtttttggccatttgggaaaggagacaatgggctcgttggtacctatagttccaatcagtgggaaagacattttctcaaagaagtcttttaaaatctccagctgataggaaatctgtttactctctgaacccaagcaatgtaccgtatacacgaagtggcaatctcaggcaaagctcggaagtctgcatgtaagggcagcaatggtatatcgctagctattttccaaggggaccccgggactcaaggtctcgctcatgcagcctgtctaaatatagcatcagcaacagcagtcaagagatagtattgaaataatcaagaaggaagaaagaaagaaggaaggaaggaaggagaaagaaagagagaaagaaagaaaaagaaagaaagaaaggaagaaagaaagagaaagaaagaaagaaagaccctccaacttcaagctctggtctgcagtgtccaacacaagattaagaacagatgaattttaatcacctttttttttcctttttttttttttttttgagatggagtttcactcttgttgccaaggctggagtatggcgtgatctcagctcacagcaacctctgcctcccaggttcaagcgattctcttgcctcagtctccaaagtagctggtactacaggcatgtgccaccatacctggctaagtttgtattttttgtagagacgggtttcaccatgttgtccaggctggtctcgaactcctgacctcaggtgatccacccgcctcggcctcccaaagttctgagattacaggcgggagccaccgtgcccggccttaatcatcttttctaggagttccgtgattttggttaagaaaatagatcattgcaaaatcgtttccttatgaggtagactacagtagcaaccacaaaaatgaacctaagaaaatgaacctgatagcagcctactttatttattcttccttagatcaagaatgctgcagccaatgtccttcgggaaacatggttaatctataaacacacaaagctgctaaagaagattgaccatgccaaagtgaggaaacaccagaggaagttcctccaagctatccaccagtgagtatgccagagcggttcagccatcagatgaccagactgggagtggcgggactcctacaactctgtcagtagcacagaagaaatccattctgttccactcaacaagtggagtggtgaactgggtctgatcactcactgactgcaccagccacatgccaggaattgggcaggctgctatggaaggtaaaaactagagtaagaacctctaagagctttcacattctacacacacacacacacacacacacacacacacacacacacaccatgcattgcaactcaaatcaaaacaaaccgtggctgatgctttctgtgatggaggagtttttaaaagtatagtggaaaagcaaaggatgaaaacattcattctgatggagaggtttggggaatccctgaaaagttgagaataaggcactcaacatggaaggtgcagcccaggcatagaggcagggaaatgatctgggaatagcaagaaaccagtgactgaaggtgagcatgcgtggagacaagagtttgctttctggggggatgtgacaagcccctggaaagtaaaagcctcagttgttccccaggttcacggtccccatgctgggttccaaaatcagaggcagtggtagggctggaggatctgctggtggggctaaacctttgcatggacttgaagggcttgcctgttaccattcttccccacaggttgaggagcgtcaagatggaacagaggaagctgagtgaccaagccaacactctggtggacctttccaaggtgagtggcagtgtctggagacatcccctagaacacgcagacactgagtcttctcaggctcacctgtgagtcctggctgggttcgcactggacagcgcgggaccaggcaagcaaagaaaaatttctgcttggttcaaaaatacctaggctcaagtttgtttcatttgcaatctaccggtatgtcttgtgggcttttgaaacttggtgtttgtttcttaagtgaaatcgctcaggtgtgtctctgcgtgaaattaatgagctgactaaaccttttccgtgtcattttatgagctgcacattgagggactcctgaggttgggcttgagtttgcacggctgtgaagcatgctagcaaggaccagacggtaacgatggccatggtaactgcccaggtcacaccggtttgctgtaatacttggaagttcatttttgtacatcctccagtccttaaccaactagttttgctggcctcaaattggcggcagtggtgtgtgtgggggggtgcatttctttacttctcaagaggcagatagcctacaaggaacatgaagatacccaaaaagagagccctcttttgagagccctagggtgtaaggctcgccatcactctgccactctgtttctggccctgagctgccataaatactgtaaggaaactcctcttgcaaatcacccaggtgagggagccgaaggccacactgctggcagagctgagagtcggtgccactgaagaaagggcctccccctcctcagccccctctcctcattgcctcttgataggaattgtatattaagtgtacagcccagggccaggctggcagaacattccagcagatgtcaattatcataatggaacacattccctgggtaagcaagagaaactccctcaggcacattaagcaccctttgaaaagagtgcaatcagagaaatcactagttgtcgggccacgtgcaggtgccttgtttaataaagggattgaaccaaagaaagggccttctaaacctgtgaggacttcaatcggggagtaagtggcttggcacatttggggagaagcctccaggcccgcgtgcctttggaggagggcgttcacgtggagtgcagggtggttcctaggagcctggggtgggagtggaacgtgggcatgcaggagagaactccctcaggtttttgggtgtgttggttttaatatcagaaacccgctgggactaggtttaaaaatggagaaatctattctaaggatataagggagtctcattccaggcaaaacctcaaaggagacatgtggccagactgcaggaaggaactgactcgaactagacctgggaagcccccacaaccaggaggtctctcaccatttcttctctgtccttctgtttaagtgactgcttcagttctctctccctctccctgtctctctcttcctctccctttccctgtctctctcttcctctccgtctccctgtctctcttcctctccgtctccctgtctctctcttcctctccctttccctgtctctctcttcctctccctttccctgtctctctcttcctctccctctctcttcctctctttctctccctctctgcctcctgtccccgcgacagactgtaacaggctccaattcagagagtacatataatagttttagccacaggtaaagactaattggccccctactagtcttaattctaaattctcagaatagaagaaatgattggccaatttgggccacgtatccaccctgggaccaatcagcattggccaggaagagggtcatatggagcaaacagggctaggggcccacctgtgagcttcaggaatagcccaacaaaatgccccaggatgtttcttccatgagtagcagtatttcctgtttctcctctcaccttgcaggacatgctgtgactgatgttccctggggacatgaggcaaaccaaactttcttttttttttttttagttttattattattacactttaagttttagggtacatgtgcacaatgtgcaggtttgttacatatgtatacatgtgccatgttggtgtgctgcacccattaactcgtcatttaacattaggtatatctcctaatgctatccctcccccctccccccaccccacaacagtccctggagtgtgatgttccccttcctgtgtccatgtgttctcattgttcaattcccacctatgagtgagaacatgcggtgtttggttttttgtccttgcgatagtttgctgagaatgatggtttccagtttcatccatgtccctacaaaggacatgaactcatcattttttatggctgcatagtattccatggtgtatatgtgccacattttcttaatccagtctatcattgtcagacatttgggttggttccaagtctttgctattgtgaatagtgccacaataaacatacgtgtgcatgtgtctttacagcagcatgatttataatcctctgggtatatacccagtaatgggatggctgggtcaaatggtgtttctagttctagatccctgaggaatctccacactgacttccacaatggttgaactagtttacagtcccaccaacagtgtaaaagtgttcctatttctccacatcctctccagcacctgttgtttcctgactttttaatgattgccattctaactggtatgagatggtatctcattgtggttttgatttgcatttctctgatggccagtgatcatgagcattttttcatgtgttttttggctgcataaatgtcttcttttgagaagtgtctgttcatatccttcgcccacttttgggcaaaccaaactttcaagcctgcatttctgcagtgccacccacggcctcttggagagatggggcccacggagcagaccgggtgaagcgaacccctcagtgaactggaaagacactcctgtgaattgggtgggggaactaagccgtaaataacccaggagcaagttacctggaaagaaagagtgtgcaggaaagggttaagggaaaaatctgcagaacccccgtggggagatctggggaggagatgaactctgacattcgcccagtctttgtcttttcctcccaggagactcacccaaggtcctggcagcagcttagcacacttcacactggtccatattccccctggcatcctgtcaccaagcaacggaacagggggagacaataacgctgtgttctctctcttttctgtctttgtgctgtagcctcccaagtcagcgccttcccactcctgccctttggtcctctctaaattaagaatatggcatgtggcctccacatattacgtctgtattgaattgctgtcctataggctggcagagctgggagggcttggagtctttccccgattgcttcaattacttcaattgaaatataaaaataattcctaccatcggaggctcaggtgatcgaataagatgatatctgtgaaaatgctttgtaaactataaaggttttgcaattggtagttctgattatcaatatagatgaggaaaccaagatccaagggaacaaagtgaccatcccacggtcaggcagttggtgagcaccagcgtgggggccacaacccaggggcctggactctgagtccagagctcatcagggtgcccctgcggtcaaatgaaatgggtgattttgcacattccgggaagaatgtttgcctcgaggaggttctgtcatgttgattaataaagggagtactttcacttctaaagtcaccctgtcctccaagggcatccacgacacggtgtcctgctctggcaacagcagagctcatgggagcggggccatctccatgccaccttgtgacctttccttatgctgccccagtgaatttcctcatggggcctgtagtctgctggggaggcctcactgcattttgtgcccctgctccccttcattcttctctggcttctcacatcttcttttactcttcttttttcctctcaccttacttgctgctgctttggtccctggggcataaatcatgtccatatcttcctagagtaacctgaaatttcacgtgaaataggatcggggtgtcactggcagatcatcagaaacccaaagagccacagtacctcagggatgaccaagcaaccaccggcctggccctctgcattgccgccccaggagcctcactccctgacacgtgggaggctgaagatgcttgtgaatcttgttcccaagtctgatgtacacagccaagatggcatttgctaatttgctgggagaaaaatatctgttgcatagactgggactctgcagaccaacaagggggccacaggatgttggggaaggagcactggtaatcggccggcacccctggaacacggggagtcagtgctgagtgcaggaggggtactggggagctctcaggggagcaccctcaggacccctgccaaggagtgagggaagcaggattggtcagtgggagggtttgaactgtgatacagtcaacaaagacctcagcccttcagagtggcccttcagggatgtcccaccctgaggcattgtggatcaggcaggcgaagggccacacctcagcaaggcagcctcctttggctaagcactgtgcctgagagttaattcactttacatcctgtctgctgggttaaaatagaggttgggagatgtgcaataactcctaactgtgtacagttattattaactccaattttataaggcaaccgagattgagagaggccaggcgcctggcagagggcacactgttagtgagctgcagatgtgtacttgagccctggcctactaattatacacccactgcactgtccattccccaccagcgtcttctctggaatcattagatgccagcagccatgtgagctgagaggttgtggccctgtgagaacatgagacagtttagagactcactttatttaagaaaaaaaaaagggccatttttttccccttggtgcatattttctaataaaatgctgtcattaatactcattacttttgtaataagaaaacaaaaatgtgcacacttcagcatccccatccccaggaaagaagcctgtatccttccttgaccagatcagctggtgtggaagtggctcctgtcatactgtggagggcgtttcatttctcccattgcagattcctctgtgatgacctgtcatctccctgtctctcgcctctctctctccacacagatgcagaatgtcatgtatgacttaatcacagaactcaatgaccggagcgaagacctggagaagcagattggcagcctggagtcgaagctggagcatctcaccgccagcttcaactccctgccgctgctcatcgccgacaccctgcgccagcagcagcagcagctcctgtctgccatcatcgaggcccggggtgtcagcgtggcagtgggcaccacccacaccccaatctccgatagccccattggggtcagctccacctccttcccgaccccgtacacaagttcaagcagttgctaaataaatctccccactccagaagcattacccataggtcttaagatgcaaatcaactctctcctggtcgctttgccatcaagaaacattcagaccagggaacggaaagaagagagaccgagctaattaactaactcatgttcattcagcgtgcttggtccgacatgccttgaaaccagaaatctaatctctgtttaggtgcctctacttgggagcgggaagaggagatgacaggaagcgacgcctctggcagggcccttgctgcagagttggtggagaacagaaatccacgctcaatctcaggtcttcacgcggggggtgggggtcagatgcactgaagtagccaacagcgaagccagtccagaagaggggtccgctgggagggagggttgtgtcaggcttgggggatgggctcttcgccatgggggtctttgaacacacctctctcctttccttttgtctacggaagcctctgggtgacaaaagtaaaagagagctgcccacaacttgccaaaacagatatactcgaatcagactgaaaaaaaaaaaaaaagacacagacaaataaaaagccagattttccactcgatattaatacccacataaacctgtgtgtttgcaaacgtgtacatgtacacacatacacatcccacgttcgcttcaggtcctttcttatttgagcttaatccaaataaaaagggacttgacaccttaccctgcatacaataggcaccccttacatgtgttttgagttggtctgaatctgaacatggggtgctttcagttcaggtagttagctagttctggccacattctgagtttcactgaagatgtggatcccttcagacataatgcacattgctttgtcctggatatgcaccttgcttgatttgaaatggatgccaagccaaaattgttggcattcaggagggataagcaggcttctaaaaataacagcatctgcagagttttcttcttccatccaaacaagttgtgtttcgatggtccacatgaccaggtgtatgtctgtaagtgtggagggagaggacaagaaattgtgcatgtgtgtgcagacatgcacaaacaggagcaatccaataacaccttagtgaatagaaatatggttggggatttgctgagctgtatttatccagcaacaggtttccagccccagatgttagtagtgcaaaagggccaagtgcctcaattgtgagcctctgagctaggaggagaagtgatgaagagtggcctatgtggtcccttctacctgaccttaagtcatctcaaaatgaaatattgtgagaatgaagggaacccttagggaaccttgtgggtaaggtaagtggacatggatttgtcagtagcctgttcctactgtgccatgttaatcttggtgcgaaaaactattccaatacatctcaaactccaagagacttcagaaacatcaagatttagtgtaatgagcggcgcagaaaaatgttttcattgctccataatctgaccacacgtaacatttgtgacgtgaaaaccatgactttctcattctgaggtctttggtttctgcctgtgggaaattgaatggcactgtatggactatttcatctgttgatggtaaaacaaaagggtgatttttttgcttgtggttgtcatcttgggtttacctttgtaagaagacatcatcaccattctgaaggcagtggcttggcatggagatttttattctgtagcactgggcctgttcttctaaggacagcacaaggtagacaattgtagagccaaggccactttttcaggaagatctagtctcttgctaaccctcttctttctctcttgctattgctgctgctcttttgatggtttatagtcttaatggcctgccttgataattcctttgaacactttcattagttgttttgcataccagagatgccgcacctgctgttggcttatttttttacttgttctattaactgttgattatctgaatgtttcccctcctccttgtttcatgtcccaagaatggtgc

SEQ ID NO: 13033 - DNA, 9734 bp, Human
  misc_feature (1)...(9734): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacgtactgtggtggaccccgctggtgctcgcccccaatctggtggttccccagcaccagtgcgttgggggtgggcaacatgacacccccccacctaagccggcctcctgccttctctccctcagtctcaggggccagccaagcccccacccccaaggaagccactgcctgccgacccccagggccggtgcccatcgggtgacctgcccggcccaggggctggaatcccgcccctagtggtaccctccaggtaggaggagccctgggcatgggtgggcggggcgagtgacctgggggaaaggggcctctgactcttttttcttggcttcccgcaatccagaccagcgccaccgcctccgacagtgtcctcgctctacctctgacctctccggaggttccgctgcctccaagccggacttagggcttcaagaggcgggcgtgccctctggagtcccctaccatgactgaaggcgccagagactggcggtgtcttaagactccgggcaccgccacgcgctgtcaagcaacactctgcggacctgccggcgtagttgcagcgggggcttggggaggggctgggggttggacgggattgaggaaggtccgcacagcctgtctctgctcagttgcaataaacgtgacatcttgggagcgttccccagagtttgtctgcttctagaacccgggtcgctcctgctgcggttccaggtttggccgccagaagacgctgccgcctcagacgagggcgggctgtgtggggcgggagtaccagaaagggtcggcgtgtgtccccgggatgctcgcagcttccctctgcccagactggggtggctttcggcgcaatctgtcaagctgttggacctgccgtccccactctgaccattggctgggaaaagtggatctggctgatgctcccagagcccaggagccagggcggagcggggcggcggctgctcccacgatcccaaggccgcgcacctgcctcctccccctccgccgccgccacctgagggatcgggaacaaaggtgctttgtacaggccgcaaccacctcattacttcgtcttagggactggggccgcgtgggcccccagcccggaacgaaggtgtggagcggcaagggacagacgccaatcctaaagtgagcatctagcgcgccacctaaggctctttagggaaggtggtcccagagctgtgttgtcccttccgcttgcactgtccctagatgtgcaaagaaaacggggcagtgcatgaaggtggttggacaggcttcatggatcctcgcccgcgcctcactttcccctatctgggcaaaggttatgtacccttatttaaaatcttccaaacttctaataaggcagtctaccctgcactaaagcagacacgaaagagatgacctccctaaaaatactgctgttggaatacgtccttccttcccgccccctcgcagtgcggtgcagcctcagtggaagctttggcgaacctggcgcgcgctgcggtgcacagagggttaactggagttggcgctgggtggagaggaggagacgcgctcccattggcggaaagttattcaggggcggggtcagtgaatctccgtaccccactcccctttccgcaacttccctcttcactttgtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggtagccgggccgaaccgggcgagcgcacagccaagtctgcgcgctcccgggctttgcgcgcgcccgccacccgctctttgcgcggcgccgcctgagcctggccgcgcgccggggctcctttgtttgagccggcgggggaggggggaggggcgaggggcgaggcgcgccctgggtctccccacagcccgcatgtgttggggggcaggcagaagaccccagccccaagggttgtctagggggtcttggagcatggagctgggggggcctttgcccgcactccgggctccgcccccctcgctgctctcctggcgatccccagcctcccgcaggctggagctgtggctgacgaacttgagagcgagggagggggctttactcttatgaaagagcgtgggttactctcctgcccgctgggtctcacctctggctctcactctgtctcctgatctcatttgctatctctgctttcatctctgtctttattggtccttctgtttctttccagtgtcagccctgcccttctagccgaatcacctctgggcaagtctcgtgaccttcctaacctcatttatctcacctgtataatgggctaataatacctagtaccctgggaagtctggcagggtaagtgaggtcatgtatgtgaaagaggctcaggctgtacagatataaactattatttctttctctctcctgagctgcctgcctttgaaccttagtatattttactgtttccatccccctccccaagtctccctgcctctcctatttcctatctgtttttctttctgattttctacttgagacaatctgtgactattcatttcttcactcactaacatttatttattaaacacatactgtgtgtgcccggccctgtgctaggttgcaggggattaactatatagatgagaagatcaagaccctgccctctgggattccacagactctctggagaacaggcgcaggcaggagagcctgcataaagacaggtcattacaataccaataacaagtgataagagcttttgttgtccttggactctgaattctctatctctgtcacagaccaaagcttctgaatcacttggaggacctgttaaaaattcaggtttctcaccccccaatcttaaggtttctggctcattcattcaatccacaaatatttattgaacactgtcctgtgctgggcacttttccaggcacgggggatgcagtagaacaaaacttaccaaggccctgtccttgctcagcttgcgttctagtaagtctgggctggctgagcccaggaatcttcatttctaatcagaactgatacaggtcgtccttggaccacccactggaggcttttcctaagtcatgcttcgctgtgtttgtggtatggggggtggttcatgcagcattcagtactgtggggagcagccccttccagcccttcccacctgtgctggcttccccaggcagctcccaagaggtggggaagggagtcctgagaagactgaagactgggtagtatgtggactccccccatgcctggcacttgctcctcctggccaaaaaagggaggcacctagcacccactccttcattctttttttttttttttttttaatttttagaatttagagacagggtcttgctctgtcacccaggctgtagtgcggtggcataatagctcactacaggaacttgcggactctaaggatcctcccgcctcagcctcccaagtagctgggactacaggagtgcaccaccactcatggcctttatttatttatttatttatttatttatttattttttgagatggagtctcgctctgtctcccaggctggagtgcagtggcgcaatctcggctcactgcaagctccgcctcccgggttcacgccattctcctgcctcaacctcccaagtagctgggactacaggtgcccgccaccacgcccggctagttttctttttatattcttagtagagacggggtttcaccgtgttagccaggatggtcttgatctcctgacctcatgatccgcccgcctcagcctcccaaagtgctgggattacaagcgtgagccaccgcgcccagcctatttatttatttatggtagagacagtctcaccatgttgcccaggctggtcttgaactcctggcctcaagcgatcctcccacctcggcctcccaaagtgctgggattcagatgtgagccaccacacctggcctccctcattctttttttaccgtgacattcttttcacccttgggttgaagtcagtctaaaggacagtgttcctcactttatatctgtttgaggagacctttcccaacccctgtctccacctctgtgtctgcagctgcactgtgtgcaactgtacctcctgcctctctgcccagcttcttcacagcatccatccacctgacattgatcaagcctggtgctataccacattgagtgttgggcactggagctagagaggtgtgtggcagctccagcctgtaggacagggtgtggtgaccctccttctcacatctaagctgtgtggttatgggcactgcaggtcttagcctctcggaacctgtgaatcgatcatctcatccatttcttgcactctctttgtctctcaagagttgtcagtctgggaacctcgggccttcctgagctgctccatcgcacatgggtggaggagaggctggcaggggcctctgagaaggggtgtctctggcatccatggccatggcgtggtgccctccactcctcagcccacccctgcgttatgcctgcaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctgtgagtggccaagggcacactggacacctcttgtgtaccagaagggtagggagggggaaggagaggcctggaaggaggagggggctgggtctctaatgtacatcgggttgaggtatgggctgaactcaggactgaggagggaaatgtctagaaaggagaaagtaggaggagctaggaaagggggccagggagatgagaggactggatggggcctgatacatgggtgtggccccaaagtaaggaaacgctttccagggacctggagagaagaaaacctgggagggtctgaaacagtctgaggcatacaaaggggtgactccctgtgctaactttttcccactttcccactacccagcggtgcccactccagagagttctggccagtgcttgaggctccaggtgtctgtctgctgcaaggagaggagtaagtgggttgggagcatggaccctactggctaatgtggggccttgggaaggagggaaggagtgagaagaatctaggaggatcagactccaggggtcctggtgaagcttcaagctgtggtctcttctccccatttagccttgagggagcttctactgcaccatcctctccccacttctgttttgttttgttttggttttagacggagtctcgctctgttgcccaggctggagtgcagtggctcgatctcagctcactgcaagctccgcctctctggttcacgccattctcctgcctcagcctccggagtagctgggactacaggcacccgccaccacacccggctaattttttgtatttttagtagagatggggtttcaccgtgttagccaggatggtctcgatctcctgaccttgtgatctgcccacctcagcctcccaaagtgctgagattacaggcatgagccaccacccccagctcccccacttcttttttaagagacagggtcttgctgtgttgcccaggctggaatgcagtggcacgatcatacctctctgcagcctcaaactcctgggttcaagcgattctcctgccttagcttcccgagtagctgggattacaggcatgtgccaccacaactcacaactggctaaattactttttattttttgtagagatgggatctcaggctggccttgaactcctggcctgtgttgcccaggctggtcttgaactcctgacctcaagagatcctcctgcctcccaaagcactggaattacaggcgtgagccaccatgtcttgtgtggcctcactgcacactttttttttttttttgagacagagtctcgctctcgctctgtcgcccagggctggagtacagtggtgcgatctcagcttacttcaacctcaccctcctgggtgcaagcaattctcctgcctcagtattccgagtagctaggactacaggtgtgtgccacccagctgattttttttttttttttttttttttttttttttttttttagtagagacagggtttcaccgtgttggccaggctggtctcaaactcctggcctcaagtgatccactcgcctcagccttacaaagtgctaggattacaggcgtgagccatcacacccgacatactgtacactttttaaagctgggccaagagaacagggtgtccaggggcaaggcccttcaaggtcttagctgagttggttgtctctattggcaattttggggaggcttggaagttggggcttagaaaggatgaggtcatagatcatgggaagggagtggctggtttgggagaccctggaggatgggaaaggagggaactgctaatgggaaggggaggaaggaggatggtaaagtgggaggactgatcagtgctaccccctccccctcacagagtctgagtcagcccatcctgttgggagccctggagagagtggcacatcagggtggcgagggggggacactcccagccccctctgtctcttgctattactgctgcttctgattcttcgtcttctgcgaattctgtgagccaagcagaccttccctctcatcccaaggagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttttgttgccctccccaatctactgccctcaggccacttccctgatagcaggactccctgtggcctgggctctcagcttagcttggcctgacctccatgccagctgtgctcaggccatccatgccaggcctcagtgggcacccctctgggcaatgtggggtgggtgccagcagcagctgtggagcttggcaccctctctcacctccccagccggcttcctgtgctgaggaggggcagatgctcctgacagcccatccgcttggggccctgcccaagtcctggtagcaccaaccagggcgcccagcaaaagcaaagggtagtattaatagcatctgggtttcagaatgcctgggtccctgagagctggtcatccctccccctccccaagggcactctgggcggtgcctggcctagaactgggaaggtggggtcagatcaaagcctccgtccccagcggcctctttgttcttagcttttataaggaggaggaggaggtggggctgaggagggagggctccctctgctctcagcccacactgtctcttccacctctggtaggcgaggctatgatccccacaaggccaagtggggccctctttctgaatggtatcctaggtggtgcctgggtaaggggcgccccttcccctgcagctgtactttacccgccctggtgccccgcagcctccactggcacggtgccggcccgcctggcaccgagccagccatcgataggtggatgttgtgctgattagctcggcccggctgcggcagcgagaggcagcgtgtgaacatggttacggggtgtgggggagacggcggggtggggggagggcgctagaggtccagagaccgacacagaggtgctagggttttctaacccctcccccacccctttgcacacctaggtcagatcccggtctctctcggagggggcgggggccctatcccccaccacccatgcaccccatttcgggctgccatcgttccatgttaattcgattgctctagctgaggccttgggtggagggcagcaccgcgggcagagcggactccagtctgtcccttcccccaattcgaggccacctttcagaaaatgcctcttgtaggtaggtgcgtgtatcagggccttcaccccaaaccttgatctttagcgggggcgagggtctgggacgcgaaggggagggtgtagtcggctgaaggagaagctatgggctaggtcttcaggtcctgggttcaagtgttcaagttccatctttaccgtcatccaggagggtgtctacacgttgccatggaaactggctttactgctacctccgcccctcccaagtgaagccataggcggagtagactgggagcgactagttagcagccctttccctggattgagaactgtgggggtctcacccggctcccagcggccccaggccagcctccttttcgcagaaccaggcgggcgcgctcgctcccgcggctggggctggcgcgcggacgcgccgctgataacgcatgtgcgaaagagacgcggggcccagtcagctttctccgcactcagacgcacgccctaactgtcgggcgctcccacttgacacggacacacgcccctgccggccgcccagccccttgcaggtgcaagggcggatgcctcagcgaccacgggagccgggctggggaggttggtggggggcggggggagtcttaaacttaggcccgcccagccacaggcgctcaggcccagccggccttccctatacaactttcctcatagcatgcgcgggcggctgattcagtcccggggcgcgtccccatggaaagccagggctgagtccactcatggggccgagacgggctgcaggcgctgggaggtcttccaggcaccgggccttacccacgagaagtcgaggcgtgttccagggcgcagttccaggaggctgggcaggcctgcaagttttggggcgtcaccgatctcccctaaactcagtagcgctaggcggcttagggtgggg

SEQ ID NO: 13034 - DNA, 90900 bp, Human
  misc_feature (1)...(90900): n = A,T,C or G
cttttacagttcttgccaagtgtggagatcactgtggaatggtgtggctagaaagtcatcctggaagcagagtcttacttgcagagaagcagaaggcttagacaagtggaaagagggcaggaggggctgctggccaggggcaaagcttgacaggggcagaaagcgatataggtggtcagagaggcccgtttggaaagtccctataggtcaggcagaagaacttaaccttgggagtccattaagagtgataagagaaggaagcctggtattagcaaggaaataagagagaactgagaaaccagatgccaggagaccacccttgttgcaataatccggatgtaaaatgatgagggtttggatttagaatgttccagggggaacagaaaggaaacaaagaattcatgagacatttcaaaggaggaaataccaggtcttgatgacaggctggagatgataatgggagaagtcacacatgattccagtttttctaccttgggaagccagcaaagtgacttctttttagatctcttttctttgctcacacacaaattgaccccctcatagagttcagttgaaatatcaattacaaacagaattgatctattttttttcccttagaaacacaggtaatcttatttgcctttagctaaacgacccaagatgcaccttgctgggctttgctcttggatagcactcatacctctatgacaatgctccccactttggccttgtactgcgtgtgtggtgtgcaggtgcgtttatcacccactaaaccaaaagtccgtgttgtgcagggaccacgtctcatgcagagttaagtattcaaaagtttttgttaattgtttaagaaaatgagatttacatgaaacaatactttaaaaagctttccagaaacaacagcattaaaacaaaatcactgaaattaaaatttacataaattaaaaggttctgtgttccacatgccaagaaaagatcttacactattgtaatagtggtagggtcacacagttttattcctcagcttaagtgctgcaatacagtaataatgcagtacaagaatactgtataataaaccttaaacgaaacacttcatatatactttacacaagttattggatattgcttagtatttatttcccccacccctgctgtgcaaagatattaatatccctcttttataggagaggaaacaggtaaagagaagttaagaaacttgcacaaggtcatccagctagtaaatgttggagctgggatttgacaactttgtcaagtctccatccttaacagttctgctctatattgcataagcagacagctcccttttggggactgacaggttatttgaggcatatgaaccatttttggtgggggggctttcccacccagtactggaagtgtctagttatatggggcataaccttaggagcaagcaggaaaagaagaaatgtattccaatagtgttcagaaatataccagagtaaacgaataaccatcaataacagcattttacagcctacctaataacacaggaataaaaccctttatctggaacctaaataataccccctccactcattttattaaaagccttgctttatttggaaactcttaaaataagtggtcatacgattaaaaaaagcagcggcgcgccccctccccggcggccgggcgcagctgtccgcgcctcccccgcgcggctgcccgcattccaactctctgaggtcacgggccgccgccgcctccccggatccgcccgcccggctcagggggagggacgcctgggcccggccgccccgctgctccggccgcgcgtcccgcgtcggtccgacggtctgtccgtcctcctgccaccccccgcccccacggggcttctttgtgcggcgctcctcgccggccggtcccacctccaggcctcgcccctcgccgtcgccaccgccggactctgcccaggggaatggtctgcgagccgggtttttggagacaggaagtgaggcgtgcgagccccatgagcgcgccgcggcccgggctggcgtgcgggtgcggctgcggcggccgcgcggcggggccccgggaggcgggtcgctgagcggggcgcgcggccccgaggatgcgggagcgggagcgggagcaggtgagggcgcggtccccggccggcgggaggggcgggcggctggcccgagcggtggggtgtgtccactcgcccggaccccggagcgcgcccgcggccccggaatcccggagaatggggcgcggcggccagacccgtagcgggagcgtaacaaagagaaaagtcttgtttttcaggttcgctctcatatacttgagtaatttctaaaaggagtcttgaacttctattccgaacgccctggccgattgttgcgggttaattctggatcagggttttaaatgtgttaggcatatttgtgcctctcagaatatataaacgtgaaattcgccagataactttggcgagaaggggcgcagggaaggactgtttggtaacgcctgggtttgtttttggagtagagtatttactctggaaacaagaattcttggatctgcaaattccgacttgtgatttctgcaaatcctgattagattggccgctcttggcatgctcgtcctattttcttttttgctgagaaagccttatactaatagcgtatgctcacaaacacattcagaacattcgtgtgctccaagtgacaactgctgtatgcctaatagttgctgacagtttatttatttttttaagtttgggacacgacagtaattttactctgaatatagtccgtttcgtttctagggcattttattctggagcatctacgcacagatgttttctccgtgagaaacatgggtttaatgctatagctatagatattactctaaaaatgtcacatactctctccttttagtgcttattttattttaaagcaactttggcaaaattacatgtggtaaggaccttaataggaaaggggaaacgctgtaagattgagaggtaaagtgtatttgaggaacttttggaaagggttgtagagagggaaaattaaaatgaattcacaaatagttcagactgccttttgtaaacttgtactgaagcagaatctagtatgtatctgtttacttaccacaaaacggaaagattttgtagagaaaaaattatatcctagttttcctttaatagctatttataaattatgtttactttagtaaattataattccagacccaatcactttcatattattgcatattattttatacctgaaacagacctccccaaagaactcttaaatttctactcatcttggttttattatcttcagacattcataattgtattacaccatttggcaacaaatactgcatattactgaaaattaagatgtataaatcattgataaatttgtaaattattaaacaaaatcattgttttaacatagtgggttttatataaataagcaaaaagcaagccattcttatggatagatcttggggggatgcaccatgtacacacacactgcaactttttcaatttcatctaccaaaataagagataattttgacttttcctttatccctgatgcagtaatacatttcaagtctgagggacaattgaaagttttactgagtttgcttaatcagagcttaagttaataattaagttatacagtgtagtatctattgctttcaaggcatagttctatgtagtgaaaagactaccatatttgaatggcacctaatacaaatatttatctttcctctacacatatgcaatatcttgtctgttcatctacactacttaatccgcccggtttccagttaccataatttttatgtaaaattgaaacccaccatctgatctcatgaaagggtgtttagtatgcatatttataatccttaaatatttactcttggtttatcaattttctagttaaaagcttattatttaaagttgtcatttgctaatttttttccatcttgctttacttatttagtttatacccctgaaacagcaaagagcattgaaaactactggaagtggaaaccatatcttttaatacttattttctgtttccctccatagtatggtgcttttacctacagaaggcactcagcaaatgcggttaattaacacagtgctttaggtagttgcagcgttgtttttttcttctggccttcccctatcccttgtttttaatattttgattttcctggctatgggaaataaccagagctcaaaacaaacaaaaaaactagccagataaaaccgtggttgggtccttattagagatacagctctgtatgtaattatagcatggttgtaatctctttaaagacagcgacggtttagggattcgtcttagatttctcacgatgctcattacgctgtcttgttcccagagacgcagtacacatttgtggaatggaatttcaaaatgttaagtttggcaaagccgagggtagtagcggaacccttttctccaggtctgccattccctaaccctaagtgccccatcacctctgggcctgagacgcagtcaggagagcaggacccaggagaggactgggactgtggaatttgggatcgattcccagctcagcccgtcctagcgtgaaactgcgaaagccgcttctcttcctgaagcctgggttctgtctgccagatgagagggtcgggaatagatcttgcctctccgcgcggtcccgggccggaactcagcgtagccagctatggctgggtctcgctaagcgattcatccccaacaggcaatctctgcgcagaaggaaggtagggaaccgtctcaggaccctggaaatgtccgggattttgtagactcgtttagggggaaaaaactaatccagctgatataaaaatccccagctagtgctcgccccagaaaccatcaacaggtctggttaaaaactgttagagcccggcttggtggcgcgcacctgtggtcccagctactcgggaggttgaggcgggaggatcgcttgagcccaggtgttcgaggctgcggtgagctacgatggcgccactgcactccagcctgggtggcatagcgagacttcgctctataaaacacgttgtaaggagcgtattttgaggtcctgtggctccaaagcgggcatcctatggggcccgcccagcctctccaccgccagtagggcacgcgctggtccctttaaatgttcccttcgggagccgagggaccggtccttttagagcgcgtccgtccagaaacgcggctgcagaaagagggttccggggcctccgagtctactggttggcctggcaacgccgcgtgctcttcccaaggggaggacgcgggagaagccggggcctgagtgctccaaggccccgtgggcttcttgggtttgttgcctccggccgctcattaactcaggatggcgtggaagacctcgcccgcctccccttctgggccgcggctccgcttaggtgaaggcctgtttgggcgtccccaccctggagaggggccggggtctggattttcagaactgccactcttctagtggtaaatggataacgagcatttgtagggtcttttatgatgtttatcagtaaatcaatttgatgacgtaaatacttccacaagcgcttgttaggcacctcaccgggtttgaatcacacacctgcctttcttagtggggattattcctcccatttgccttcagggttaattttctaaagggattgggactgaaacctagctcttttggggccatttggcacttttctcacttaaggactaaagaactctgacatttggagtattacaacctgaaagagttacctatgaaaaaacaacaccttatccaaaataggaagaggatcacaattactaactacaaaatttgggattatagtagtgctggctattatctcatttaatcctgaggatggcccagtttgctatccctatttgtaggatacagtgaagggtggagtctgaccctgagcctagcacaactctgagataaaattccaccctgccttccgggtcctgttagtgccttttttccagtggagagggacggcttgttctttggccacagcttgactggcttttctttatataagcaaagcccagcgttacgtttgcttaactaacggcgttcctctttccccagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtaagccacctaaagacactgcaggccaggcgcgggtggctcaagcctgtaatcccagcactttgagaggccgaggctggtggatcacctgaggtcaggagttcgagcctagcctggccaacatggtgaaaccctgtctctactaaaaatacaaggccgggcgcagtggctcacacctgtaatcccagcactttgggaggccgaggcgggcgaatcacaaggtcaggagttcgagaccagcctggccaatatggtgaaaccccatgtctactaaaaatacaaaaattagccggacgtggtggtgggcgcctgtagggtgtggtggcgggcacctgtcatcctacctactcgggaggctgagacaggagaatcgcttgaatgtgggaggcagaggctgcagtgagccgagatcgctccactgcactccagcctgggctacagagcgagacacctgctcaaaaaaaaaaaaaaattggctgggcgtggtggtgggtgcctgtaatcgcagctactggggaggctgaggcaggagaatcacttgtacccaggaggtggaggttgcagtgagctgagatcacagcactgcactccagcctgggcaacaaactctgtctcaaaaaaaattaaaaataaataaaaaaaacacgacaggcttctctggcccgcatgctggctgtgtgttctagcccacgggccactcactgtgtgtccctggctgggatgtctgagttgagcctgtagtcccctcctcatgaagcaggaatagattagattaagaagtctccccttggggtgccctataagaactaatggttcttattttgaatatgtttatattccccctctaaggtaatccagaatcaaatgtgaatacactttgggttgttcaaatttccattttctaatatacccccaaaggtcatcctgatctctagtacagtttactgacttcattctttcttttttgttcattttaatttttttagagtcaaggtaggtctagctatgttgcccaggttggtctcaaattcctaggctcaagcgatcctcccgcgataggcatgtgccaccatgtccggctcttgacttcgttctttcaacattcattgagtaaaattcattgactatattcttacaggccagatcgaggttctagaaacatactgcctgaactcagtttgagttctagtttcctcaccatctgcttctgttaccttgggcaagttatgtgatatctctgagccccagttctccatctgaaccatggggatgactgtgacacctaattctcagagtagcataaggttgtaagctctgctaactagtctattagagtaccgattgggaggtttgcccaggaaacccctaatctagttggtaggaagttatggagtactcatgtatccatataatgtcttaaatttaaaatgttatgcaaggcctgtgaagaaaggtctctaattaaacctaggaccctccctacctttggctacctggttcttgggtaagggaaagttagagaaactggttattccacctaaaaagtcaggaatagatgaactttgctcctggtgaccatccaatcacttatatgatcactcagtactgaagatgcgtaagtgccaagcacatacatacttggaagctcaccctagtgttgttgccagtaagaaaacaggcatgatgcatgctgtgataagggaagtagagggtgtgctataggccagagggaggtgcagcaaagggaaggctgctcagggaatttgattctgagctgtgacctgaggatggggcaagggagtcctatcaagggctggaggagttccaacaaagagaactgcacaggaccaaagacgcagaggaagctggtctgcctgaagcctgaagtgcgtggaggaaaggccgactgtaagggccacacaatgaggattttttgttaaaggatttagatttatcctgagggtagtggggaagttaatgaagggtgtaaacaggtgtggtacgattgtttctgtgaagagtgagccctttggagaatgatttgaggggagtggttcaggtacagatggtagccacctggagttggatagggttggagagaggtggttggaatctggatcaggacctaccgagtaatagagaagggatagcatgggtcctggttgatattcaggttttcagtagatggtggggctataacagagaggaaatgtgaaaggaagtgcagatctattaggggcaaggaggagcgtgtggtgagttcagttttagaaatactgagtttgaggtgccagttggaggttttgaatagacagatggatctgctgatctggagttcaggcatgagatccaggttagagggaagatattgggaagtatcagcctaagtgagttcattaaagccagaagatggtatgaggctctccaggggagaaaaagaggacatcgcagacccctcatggtagattagaggaggggaaagtgttggaaggaaactgagatgaaactgccgaagaagaagaaagaaaaccagaacagcaggcctcagtaaccagtccctgcttacttgcatttattcttttttagggatgaggtctcactccatcacccaggctggagtacagtggcaccgtcatagctcaatgcatcctcaaacacctaggctcaagtgatccttttgccttagcctgccaagagctgggactacaggtacactccaccacacccagctaattttttttttaacttgtgtttttgagatggagtcttgctatgtcgcccaggctggtctgggagttgtttcctctagttatcttcctgcctcaactttgtgagtaggtgggattacaggcgtgtgccaccttgcctggcttagtggcttatattctatttatttatttatttatttactttggttgcttcgactttttttttttttttcctattatggtttcttcttcctgtaattttcttcctcgtgcaccaggtctgtctataacgcctagagagtcagcttcttgaggaactgtggtttatttatttttataccaggtgtggaatgtgttcagtaaatacagggagaactgaacccacaggcattgccttccttctgttaataagtccagagaaattgccatcccttgttagaagttatcagtctcagggaacaagtaactttatatagctgtgggtatattttgagcctgatttttaacagaagaggaaacaggcatggtccctagaaaatgttttgcctgtggagagtctgtcccacaatttccaacataaatgtaacagtcatgggtagaaagtttgtatagcaaactttttctttgaaagccccagaagctctgctctgtagcatataaacagatggctcaggcatcaggcctaatcttaacaaatgactgttcagaaataatctgagtggggtcacacctgtttctagtttgtacatatagtctctgtgtgattcataccaagaaatatcagtatgttggtttcttgcactgttctcccaccaagcaaatctggaattatcgcatatagatttgggtggaaaactttgctactgtccaaatataaatggagggaaaagtccctcttgcttaattgaataccatttcacttctataatgacaatttttttttttttttttttgagatggagtttcactcttttgcccaggctggagtacaatggcgcgatctcggttcactgcaacctctgcctcccgggtccaagcgattctcctgccttagcctccccagtagctgggattacaggtgcctaccaccatgcccggctaatttttgtatttttgtatttttttttttttttaagtagagatggggttttatcatgttggccaggctggtcttgaactcctgacctcaggtgatctgtccaccttggcctcccaaagtgctgggattacaggagtgagccaacgtgcccgggcctataatgacagttacaagggccgcacaatagtataacactatacccaggggtttcagctatatcagtagtgtttcttacactgggtatatgggtattttttttgtttgtatttttagctgtcatatttttacaagtgtctaagatattttgtattaaattaaaagcaacgtggttaatatacatgtatccaatgtagttaacttaggttgctaactttcttttaaattcaccatatttgaactacagaaagtaacttctttttttttttttttttttttatttgagacagagtctcgctctatcgcccaggctggagtgcagtggcgcgatctcggctcactgcaacctccgtctcccaggttcatgccattctcctgtctcagtctcccaggttcatgccattcttctgtctcagcctcccaagtaactgggactataggcgcatgccaccacgcccggctaattttgtatttttagtagagatggggtttcaccgtgttagccaggatggtctcgatctcctgacctcatgatccgtctgcctcggtctcccaaagtgctgggattacaggcgtgagccaaagtaacttttaaaaatgggaaaatgaattattcccttaggaaaatattgctgttcgttatagcagtagtttctcaaagctgttgaaattccctgcctatcattcttctgagtttcaaaacattttttcaagagaggctgtgagtccttgtggaatttaaggggagctagaaaattttctccaattttaaaagcatatgctgtagaggcttgaaggaggtggtgacacaagtggccacctgggcatgggcactgcctggggcatcaccttgacggaatcagcacaatccagagtgcaagagtcaggctcaaaaatctcatgtcatgggaagacctgatttaatctagctcgctaaaaatgatgtgtaaaaccaggacccaagtttagtaatttataagcagtaaggaactgccaagggtcccaggtatgtgtgccctctgcctaggccaagattttcctatagttagggcacatgggaaccagaacaaaccagaagtttcttggtgaacatggaatcagaagaatgttaccttgaaaaagtagatattttcataagtcggccaggcgcagtggctcacgcgtgtaatcccagcactttgggaggccgaggtgggcagatcacctgaggtcaggagttcaagaccagcctggcctggccaacatggtgaaaccccatctctactaaaaatacaaaaaaattacccatgcgtgatggtgtatgcctgtagtcccaactacttgggaggctgagacaggagaatcacttgaatccgagagacagaggttgcaatgagccgagactgcgccactgtactccagcctgggcgacagagtgagactctgtctcaaaaaaaaagaaaagaaaagaaaaagtacatatttttataagcagagaattgctgcctccaggaccagacaaattcctttgagtcagggcaccttttcctctgcgcggtgcttcagtggtgcttcagtgcctgtctgcctcttgagatggctgcttagtaaagtggttaagacagtctgcagtattcagaaacacctaggttgcatccaagtgctgtcatttaagtaattattaaatcacttaatttcccaagttcattgatttttcatttgtaagttggggataataatagtacctacttgatagtggttatgaggattcggtgttaaatgtaaaacatttagcaaaggacctggtatttgggaaactctcaataagtgttcttctttattaccatttttgttgatgttatgttattgttattagtgactcctatcccctgttgtagtaactgaccaaattctcttcataggaattcttttcttttctttttttttggtgagatggagtcttgctctgttgcccaggctggagtgcaaatggcgcgatctcggctcacagcaacttccgcctcccgggttcaagcgattctctcacctcagcctcccaagtagctgggattacaggcacctgccaccactcctggctaatttttgtatttttagtagagactgggtttcactatgttggccaagctggtcttgaactcctgacctcaggtgatccacccaccttggcctcccaaagtgctgggattgcaggcaggagccaccgcacctggcctaaaaagttttttaatcctcaggatatggggaagttgtgaaaccatggaagtctcttcaaggttatttttttcatgtttttgctgtggtatattgtgttagttttataacttagaggacagttttctttcagctgtttctgaggggggtgtgtgcatgctggggcgtctttattgttgttcccatatatggccttcatacataactattgttttgaagttgagttaaatactgagccactgctaaaaattacctccagggtattttgttgaagatgaaagtctagcaaaatatatatagtggcctctcatttcttaattataggctttggtttatcatagatctttacgaaatgttttttaaattgtgtgtttagtgcgttacacacaatgtcaagtttttgttccatagactgtaagctccatcaaagtaggactcttgttgactggagcattgccagggtctgggatggcaccttgcacctatgttgttgctgaataaatgtttacttagtttaaaaattaagagtttagttttgaatttagattgataaacatggacagcagtacaattaagtcagcctttgtttgctctgattttatttcctggagagaggtaaacatttccaaagttttgtatacagatagaaaagcaccattttctttagactcttctttttcactttggggcttcttctgaaacacttagaaagtgatctagttgtagtggctccctgatgtaagattgctgtgtcaagggagtgtcagcttcctcactggactttgaacagatacttctcatagcaccttatggcagatggggatattttttcgctaggggatttgttagaatagagaggaatcaagcatataacgcaaaccataaccctcaagcacaactttagaaagtgttcttggccatcaaagtgttttattttaaattagtgtcttaggtattccaaatatccactgaccttatcttgactgttatctgagtagacatcaagaatttcatgcttatttccttgtgtactagctgttttcatttggactctaaaaatagctgatatatatgtaaagtaaaagtctagtacccagaaacttttttaccttttgggccaagtagttattcatttaggtatgtacgttataaaacaagtaagaccgaggtagagacaagaatctgtgaatattttcagttagagctattggaccgtctgaagcaaatataatgttaggttggttggcctctcacctagatagagaaagctttcccaagtctaacaccaattataaatgatcagggatttttcttgatgtttaggttttgttacttttcttctttggtctaggtaattaagaattagccatataaataagtatggaaattacacatacaaacatggaggatatgcattttaaagtctattctacaatcacaagttattgcagaatttggaaacctgtttatttgaagaatagagtattattcaacctagacttagtgcctaataaacttaaaggctaataacctaagatgttttcctttcagtattggatttttcccttgagataccagatgtccttattttcttaccatcagtctgtcacagtagtgtagtctcaggaccatgtggaattaagcatgaatttactcattcgagatttgtaaggtgaattacaaaatggtggacatgagggaactgatggtgttttgggggctctaagtgctgtcactgtctttggtgtatagaatcagattccattccttctaatatctctagaagctttgactttctgctgtctccatttgggtaaatgagcgttattgtgctggaagctttatttacctcatttaatcttcacaatgagttaggcgttgtattatcttttccattttcaaattaggaaactaaacttaagaaaagtttgagtgattacgtagctaataagcaaaagacccaggatttgagattttatatcagacttctgctcgaactttgacctttaaatttgtggcggtcatggacccctttgagatctgatgcaaacacagaattttgtatacaatttcaggtggttcatagccactctctcccccaagtccatccatgggcctaggctgtgggcctggaggcttcctggttaaggcagtctttccctttttctccccttgtcacagagcaggatctttcttccctggtcttctacttcccagagtgaaagatgctggaaggatggaatatttgtgaacaattcaagaccttcataattaaaaaataataatttgcctctgaatatagagcctcccctcgctgacccttctactacagatgccctttttttctttggccttcatctttaggtctcaggaagggccattcattgctcagtgggacaacttactattaaggaaaaagcccctctcaggggggacagaggggaggtcatgagtgggaattcccccactgtcctgctgatggtagatccatgtctgtcttccctgctaggcagcaggtatgtgatgcatcttcaggaattgaatggatgattcattcttcctttatacattaatcaagttcccaggccaattgttgagccctctgtatcattcttcttgtcagatacacactttatgtgaatatggcattttcttttctattaacaaggattcatcattcttttaacagtatgccaatttagcgaatattttcctattcagttctctgagcaatttgttcataaacaaatgtcacttagatttcctttatcttttaatgaattgacagaacatacagaggcaatttaagtttttgcctaagatgctaacattactagaagaaactgtgtatgtcacaaatccttcatgaggattggtagcatgtagtagaaataacttcctatcaagggtttgtaccactttctatagtagattacccaaatatgatcattaaaaggtgtatagtgttgagatttatatatggggcagagtagttttgttattttaaataagttttgacttattttgcctactcaggctaagaaaatatacgggtaatctcatgctgagtggcaagctcatgtgaatctaaaaacaacttattggccgggcaaggtggctcatgcctgtaatcatagcactttgacaggccgaggcagtaagatttcttcagtccaggagttcaccaccagcctggggaacatagtgagaccctatctatacaaaaaattaaaaaattagctgggcatggtgtcatatacctgtagttccagctactctagaggctgaggtgggaggatcacttgaacccaggaaggcaaggctgcagtgagccatgatcatgccactgcactctaacctgggtggcagagcaagacactgtctccagaaaaaataaaaataaaaacaacttgttatgttacagttacttagatggctcagacttcgttgacttgtcaaatgaacctcaatgtcaagtgaattttcagcacattgaactttataccatttgattcaactacatttggcaaagtggggttttggaagaaaagaggtaaagttttggtgctcaatggacttgggttcaaatccctgcagactacctgtgtgaactgaggaaaccaacttccctgggatttgtttcttttgtatgtgatatggctgcatgtaatagtaagaatgatagctctgcattgggtactgaccatattccatgccctgtgctagttgctttacatatgtgtaaccctgtgtataatcaactttgtttcctcccaccatctcgttgatggagtggaccaaagaccaatagcatccataggacactcattaactggcagctcttttttagtattctttagccgtttccactttctgtttcatcatgtaaatttgttagttggaataatacactgagggataataatggattggagaaaaatcactggagaggtattattgttaagtcaggcaactgagttcagagctgcactgctgagaattaagatattcaccataacatcctttctcttcctgcaagtttggtatgaaatatctagaaaataaccttctcagtcccttgtattttgcacttagaaataatatgtagacacttgcatacttgattcgcctgtgtttttatgattgacacctattttgaagtcaaatttatgcttagtgacttaaggaaataacacttaaaccatacagtatgataacagaaaaatgaagcatgtttaatagtgaatatgtctaaaattgtattattattatttgtataatgtatgctacccttcaatagaatgcagatttctctgtatgatgctatacaactaatgcctggctagggcagctagttggtgacagccccctgctagaattcaggtcttccagctcttgttttagcacttttctctcaatatactgcttttccatggagccattgccattttcctaaaagaaaagcaatccaagtgttgatattgtctatttactttaaaaggaaataaagggaaagaaggccaggcgtggtggctcatgtctgtaatcccggcagttcgggaggccaaggtgggcggatcacctgaggtcgggaattggagaccagcctgaccaacatggagaaaccccatctctactaaaaatacaatattgctggccatggtggtgcatgcctgtaatcccagctagtcaggaggctgaggcaggagaatcgcttgaacctgagaggtggaggttacattgagtcaagatcatgccattgcactccagcctgggcaacaagagcaaaactatgtctcaaaaaaaaaaaaaaaattaaccgggcgtggtggcagtcgcctgtaatctcagctactcgggaagctgaggcaggagaattgcttgaacccaggaggtggaggttgcagtgagctgagattgtgccattgcactccagcctgggcaacagagtgagactccatctcaaaaaaaaaaaaggaaagaaaaggaaaagttcccaaagatagaatcctattagtgaaggaagtatttaagtgtaggatctcctctactaaataaatgtaatacgaaattttatactgtttaaagggactagaaaaccatgataagaagatctcgtattacttgagcacttgtttgcatgagacacttttgtaagtgctttaaatgtttttgcttattttgatcttcacaaaaatcctgtatatgaggcactgttatgctcatctccattttactgatgggaaaactgagacacaaaggtattaagtgacttgctcatggttacatggcggaaaccacagctagagtagttctgactccttgaacagcatctttcttcctggtttataacctttgacaaatgacaggtggcctgctctggagctcatgcccttgatgacagcctggctcagagtggcctcctaaatgtgacagtagtttttgtaagtactctggagatatttgttatcatttaatttttgtatttttacaattatcttgcttaagataggtttttgcactcacgtcaggcaaagaaaggtaagcatgagaaggaacatgagtgtcattaggcccgcaagacactgttggggaatccccagggtgtttagggcagagctgtttgatgagaagcctttggtgagcttgttccctggcagagttggaagtatcagactgatgaaatacatcccaggagtgttctctgctgagatattttccaaagcaatatctgcttgcactactgttagatgaatttggtgggcttctagattcagattcttcatccaagcaaggagaaaggtagaggcagtgagtccgttgaagtgctggctgcctttcgtgatgagcccaggctgtgactgaagaataagaagttctagtttatctttggttatgtgggtcgtaaactaaacaacctttatatggtagcacatagagcatattagcttttgactgtattgaaactttgtgcagtaacatctcaattatccctgtcattcttgttggttatatatatacagtcatgtgctgcatatcacatttttggtcaatgacagactgcttataagatggtggtcccataaaattataatactgtatttttactgtacctttcctatgtttacataagtgtagatacacaaataccattgtgtttcagttgcctacaatattcactacagtaatgtgctgtacaggtttgtagcctagcagcagtaggctatatcacatgccctaaatgtgtaggaggctataccatttaggtttgtgtaagtacactccatactgttcacacaatgaaatagcctaatgatgcattcccacatcgttaagggacacgtgactactaaaatttcccctttaatcctagtttactctttaaaaacatgttgatattgtcttaatcttataattcaagatctttctccatagcacttatcagtatctggcataatatatattttgcttgtctatttttccctattggaattaagttacgtgagggcaggaattttgttctcatgttcaatgctgtattcctagttcccagaacagtgattgacatgtagtaggtattcaatcaatattcattgaatgaatagatgaatctttctaaacattagtccagttaaaaatagagtatatttatttgtgtttcagaggcatcatattcatagcatctcattgtccaggatagtaaatagaaaagagataagcagttcatccatgtggacagtaatctcagtttgtgcctcctactgtctttcagtccctgaaattgtcttatcatttgactcttccttaaagataaatgctacagcaacaacaaaaatctagccacacgagaagttcagttacttggacttcagtataatttcagaataatttagaaggtcaagatgtactcttgattattttcttgagtcttcatttagttgtaatagagtataatgatattgcatattaccactttggctgtaaaatatatattatttgatcaagtatagaagaaaactgattaaaattaaacagaaaaggaaaaaatgctgcctgctttgaggcaatgtgaccgccactatctgtcacaaggaagaagtacgatacttcattatttatggcagactctgtaaaggtaagctccaggcttgaattaggttaatacttgttaactacccttgttagatgatctcttcccgggatagactttatctagtgctatcttctgtcatctctttcctgatgaaaagtcttctgacttctgcctagtctaagaaaggcatcaggatgaaattatatttgcaattttagatgggattaacttttatcaacccaatgcatcagtggctttaaaaacccttcagctaatttctgtgtccctctgctctactttaaaaatagtacaaccaaaaagactcttaaaataattagacgagaaatgacttagggattaggaaagggtttacattctgacaggatttggacctgcttttaatagctgacgtctccttaggggactatgatttgggtgctgcacattttttccccatctcaaatttgtaaactctcttttgctttgaacaaaaaacttggttatcaaatcactttgttctcagtcaacatcagttcatgtaaagtaagtcaaccatattgtgctgaaaagaagccaagtttgttttaacttttatttttactgtagtttacaaagcaggcacagttatctgtacaattttagaagagtagctatgaaaaaattttaaacaactatgaagaaatcattgaataactttttgaaaactatcctgatatgtttgttcataacaaaataggaaaggaagggagaatgtaaacacacctgacaatgaaagtttcacaaaattctctacagtgactattgagaattgatctaggggatgctagaagattcagtgatttaacaacttctgctggaatgagtttcccacaggtcaagtcaatttgctttgatcaccagtgagagtggatgcagctgtggagaaagagaagccacgtggaggtaaagtttcttatcaggaaaagcactggaaagttatataacaaagtgtggcaggagacatgaactgaacgccaataactaaaggctgtctgctggaaaacttctgttacaattaaacgaactccattaacaggacgtgcatagtccagaagatttggactcaaggaagagaggatgtgtgcttctgggaagatatcctagaccaaggcagtagttaaaatttcaggcacatgggcctgtctgtagcaaagtttttgcctttcttttagtaaaagtcctggtatgttcagactttaaaggaagaaattagtttgactgttatttgaatagtgatattttcaaggaagaagcatgcttgattcaagttttattctattttctgtcatacctgaagagatcctatctgctaaatataggtaccatgacaaaggtaagagtgcttttcagtattatcagtacgattagaacttacaaagttcttcaccacaattttgaggaaggaagagtacatgttaaattccctattaagaaacagactcagtgaggaagtgagacattccagagctggcaagtggtaaagtcaggactcaaaggccgagccttttgcctgcaaatctagtgctctttgtaccacaccatgctagtggcagctattggaatctcaggcattgtcacccgggggaaatacagccatgtgtcacttaaggacagggaaatgttctaagaaattcgttaggcaatttcattgttgtgtgaacatcacagggagtacttaaacctacgtggtatagcctactgcacacctgctatgtgctgtggcctagtcctggtaggctataataaacctgtccaacatgttactatactgaatactgtaggtaattatatatatataacaatggtgagtatttgtgtacttaaacatatctaagcatagaaaaggtgcagtaaaaatgtgaggtaaaagattaaaaaggtacacctgtatagggtacttaccgtgaatggcgcttgcagaactaaaagttgctgtgggtgagtcagtgaatacgaaggcctaggaagttgcactatagtagtaggacactattgtagcctctagaaacactgtacagctaggctacattaaatatatcacaattttttaattttttaagacagagtctcactctgttgcccaggttggagtgcagtgacgcaatcatggctcactgcagcctcgacttccaggctcaagcattctcccaagtagcctcagcctcccaagtagctggaattataggcgtgcaccaccacacctggctaatttttgtagttttagtagaaatggggtttcaacatgttggccaggcttgtcttgaactcctgacctcaggtgatcctcccacctcggcctcctaaagtgctgggattacaggcatgagccaccacacctggccttcgataataaattaacctcagcttactataatgtttttgctttacaaacttttaaatttttaaaacttttgactcttgtaataacataggttaaaacacagacacattgtacagctatacaaaaatatctatatccttaccctataagcttttttctattttaaagtatttttttgttttttactttttaaacttttttttttttcttttgagacagtcttactttgttgcccaggctggggtacagttgcgtgatcttggcttactgcaacctctgcgtcctgggttcaagccatttttgtgcttcagcctcccaagtagctgggattacaggtgtgcaccaccaagcgccccccgcccccccttttttttaatttttagcagaggtgggtttttgccgcgttggccaggctgatcttgaactctcctcgccacaagtgatccactcaccttggcctcccaaaatgctgagattacacgtgtgagccaccgtgcccggccactttttaaacttctgtgttgaaaactaagacacacatattagcctagccttaaacagggtcaggatcatcaataacactttctttcacctccacatcttgtcctcctggacagttttcaggggcggtaacatgcatggctctgtcatcccctatgataacaatgccttcttctggaaacctcctgaggctgatttccagttcactgttttttttatttgaaagagggtctcattctgtcacccaggctgtagtgcagtggctcaatcacagctcactgcagcctcgaacttctgggctcaagcaatcctcctgcctcagcctcctagttgggtctacaccaccacacctggctgatttttgtattttttgttgtgatggggtctcactatgttgcccaggctgttcttgaactccttggctcaagtgatcctctggcctcagtctcccaaagcactgggattacagatgggagctactgcacctggcctacagttaacttttttataaataggagtacactctaaataaaaagtataataaatgcataaatcagtaacatagtcatttattatcgtccagtgttatgtactgtacatagttgtatgtgctgtgcttttgtgcaattggtagcacgataggtttgtttataccagcatcactacagacatgtgagtaatgcattgcactgcaacttagcaactacaacatcactatgtgataggaatttttcagctgttacagtcttaggggaccaccatcgcatttgtggtctgtcgttgactaaaacattgttatgcggcacgtgactgtaattagcttctatgctactagttaaacctttcaaaaaacaaataacagcaggtaccaaaacagaaatggaaacagctttcatgtttggctttggaaaatatgcttgtacttgtaagtgaagtaatgaaaccccaattaaattggctagagtactgtaaagctttatataaaataagttatttttggaaaataagttatttcttggaaataagttatttctttgggaaatgaagcgcttcataactaactttgcctgataaacaaggttgactcctttgtccaaactatttggagtgctaagttttggaaacaatttataaatttctatctgtcgtaaataaaggatactacctctgcttttaggaacagtgattgttgttgaatacatgactaattaatgtttggagttatttgtttctttagtaagtaactccagactcccatatatttgtaattctttgtaaattctatttaaggggtttttgtttgttatgtacgtgttctcctttgctaaaaagaatattgcccatcacttccctctactgccaacttgctattattaaataagcccttttcctttaatttgtcatcttttaatctgctttggattggattaccaaatcgctaaactcattaaaagtatgtataaaataagaaaaaaaatccataaaagagataggagaaatttcttctttgtcaagggcatatactttataacattgactttaatatgtatttttgattgctcaaacacatttttccctattctctgttcttcaattatgttcacgtgaggttgccagttaactgtcaaacggcacaaaatcttgacgtaagtatagatattagaaaatagaaattgtaatgaactcataggctcgtctatttctggctcattttttttcttagacttaatgaactgaatttgttgtatttaaacattttaaaatagagctgaaaatatctgtacttgttatgtcctttcctggttttggtattagggtaatgctggcttcatagaatgatttagggaggattccctctttctctatcttttggaatagtttcagtaggattggtaccaattcttctttgaatgtgtgatagaattcagctgtgaatccatctggtcctggacttgttttttgttggcagtttttttttttttaattaccgtttcagcctcaatacttgttattggtctgtccagagtttctgtttcttcctggtttaatctaggagagttgtctatttccaggattttatccatctcccttaggttttctagtttatgcacgcaaaggcgttcatagtagacttgaatgatcttttgtatttctgtggtattggttgtaatatctcccagttcatttctaattgagcttatttagatattctcttttcttggttaatctcgctaatggtcaatcaattttgtttaccttttcaaagaaccagctttttgtttttgttttgttttgtttcaatttcatttggttctgctctgatctttgttatttctttttttctgctgggtttgggtttggttggttcttgtttctctagttccttgagttgtgagcatagattgtctgtgtgctctttcagactttttgatataggcatttaatgctatgagttaatatatatttaatgtatatttaatgctcttagagctgcttttgctgtatcacagaggttttttgtttgtttgtttttttgagatggagtctcactctgttgtccaggctggagtgcagtggcgcaatctcggcttaccacaacccctgcctccctggttcaagcaattctcctgcctcaacctcccgagtagctgggactacaggcatgcaccaccatgcctggctaatttttgtaattttagtagagatggggtttcactatgttggccaggctggtcttgaactcctgatctcgtgatctgccagcctcagcctcccaaaatgttgggattacaggcgtgagccactgtgcccagccatatcccagaggttttataggttgtgtcactattatcattcagttcaaagaatttttaaatttgtctttattttgttgttgattcaaaattattcaggagcatattatttaatttccatttatttatatagttttgagggttacttttggagttaatttccagttttattccattgtggtctgagagagtacttgatgtaattttgatttttttaaaatttgttgagccttgttttgtggcctatcatatggtctatcttggagaatgttccatgttttgatgaaaataatgtatattctgcagttgttgggtagaatgttctgtaaatatctgttaaatccatttgttctagggtatagtttaagtccattgtttctttgttgactttctgtcttgatgacctgtctagtgctgtcagtggagtattgaagtcccccactattactgtgttgccatctatctcatttttttggtctagtagtaattgttttgtaaatttgggaactccagtgttaggtgcatatatatctaggatggtaatattttcctgttggactagaccatttattattccataatgtccctctttgtcttttttaagtgtcgttgctttaaagcctgattcgcccaatataagaataactactcctgcttgcttttggtttccatttacatggaatatctttttccactcctttaccttaagtttatgtgagttcttatgtgttagatgaacctcttgaacacagcagatacttggttggtggatttttatccattctgccattctgtatcttttaagggaagcatttaggaccatttacattcaaggttagtactgaaatgtgaggtactgctctattcatcgtgctagttgttgcctgaataatttgggtttttttcccccattgtgttactgttttataggccctgtgagatttatgctttaaggagtttctattttggtatattttgaggttttgtttcaagattaagagctcctttcagcattttttgtagtgctggcttggtagtggcaaattgtttcagcatttgtttgtctgaaaaagactttatctctccttcatttatgaagcttggttttgctggatacagaattcttggctgataattgttttgtttaaggaggctaatataggaccccaatgccttctggcttgtagagtttctgctgagaaatctgctgttaatctgataggttttcctttataggttaccttgtgcttttgcctcacagctcctaagattcttctttttctttttttttttttcttgagatggtgtctgactctgtcgcccagactgaagtgcatggtgtgattttggctcactgctacctccacctcctgggttcaagcaattctctggcctcagccttccaagtagctgggattacaggttcctgccaccatgcccggctgatttttatatttttggtagagatggggcttcaccatgttggccagactggtctcaaactccttgcctcaagtggtctgcccaccttggcctcctaaagtgctgggattacaggagtgagccactgcacctgacctttaagattctttcctctgtcttgactttagataatctgatgactgtgtgcctaggtgatgatctttttgtgatgtatctcctgggtgttctttgagcttcttgtgtttggatgtctaaatctctagcaagaccagggaagtttttcttgattattccctcaaataagtttccccaagttttagatttctcttcttcctcaggaataccaattattcttatgtttggtcatttaacataatctaaaatttcttggaggctttgttccaaaaaaggctacagaccagtatccctgatgaacatagatgcaaaaattctcaacaaaatactagctatttgaatctaacaccatatcaaaaagataatacaccatgatcaagtaggtttcataccagggatgtagggttggtttaatatcaagtcaataaatgtgatagaccacaaaaacagcattaaaaacaatatgatcatctcaatagatgcagaaaaggcatttaacaaaatccagcattcctttatgattaaaaccctcagtaaaattggcacagaagggacataccttaaggtaataaaagccatctatgacaaacccagagctaacattatactgaatggggaagagttgaaagcattccccctgaaaactggaacaagacaaggatgttaactttcaccacttctcttcaacgtagtactgcaagtcctatccagagcaatcagacaagagaaagaaagggcatccaaatcggtaaagaggaagtcaaaccgtctctattcactgatgatatgaacgtatacctagaaaacccctaagactcatccaaaaagctcctagatcgataaatgaattcagtaaatgttttagtctgttttcatgctgctgatagtcatagctgagactgggcaacttacaaaaggaagatttaatggacttacagttccacatggttgggaaggcctcacaatcatggtggaggatgaaaggcacgtctcacatggtggcagacaagagaagagagtttgtgtagggaaactcccatttttaaaaccatcagatctcatgagacttattcactatcaccagaaagagctgcccccatgattcagttacctcccaccaggtccctcccacaacgtgggaattcaagatgagatttgggtgaggacacagccaaaccatatcagtaaagttttaggatacaaaattcaggtacacaaatcagtagcactgctatacacaaacagtgatgaagttgagaatgaaatcaagaactcaacttcttttataacagctggaaaaagaattaaaatacttaggaatatacccagccaaggaggtgaaagaactctgcaaggaaaactacaaaacactgctgaaagaaatcatagataacagaaacaaatagaaacacatcccatgctcagggatgggtagaatcagtattgtgaaaatgaccatattgccaaaagcaatatataaattcaatgcaattcccatcaaaataccatcatctttcttcacagaactagaaaaaacaatcctaaaacttacatggaaccaaaaaagagcccccatagccaaagcaagactaagtagaaagaacaaatctggaggcatcacattacccgacttccaactggactacaagcctatagttaccaaaacagcatggtactggtataaaaacataggtcaatggaacagaatagagaacccagaaataaagccaaatacccacagccaactgatctttagcaaaggaaacaaaaacataaagtggggaaaggacaccgtattcagcaaatggtgctgggataattgacaagccacatgtataataatgaaactggatcctcatctctcaccttatacaaaaatcaactcaagtgggatcaaagacttatacctaagacctgaaactattaaaattctaaatgataacatcagaaaaatccttctagacattggcctaggcaaagagtctgtgaccaaaaacccaaaaacaaatgcagcaaaaacaaaaatagatgagatttaattaaactaaaaggcttctgcacagcaaaagaagtaatcagtagagtaaacagacaacccacagagtgggagaaaatacttgcaaactgtgcatctgacaaaggactaatatccagaatccacaaggaactcagacaaagcagtgagaaaagaacaaataatcacatcaaaacatgggctaaagacatgagttagacaattctcaaaagaagatatacaaatggcccagaaacgtatggaaaactgttcaacatcactaattatgaggaaaatgcaaatcaaaccacaatgctataccaccttactcctgcaataatggccataataaaaaaatcaaagaataatagatgttggtgtaaatgtggtgagaagggaacacttttacactgctagtgggaatgtaaactagtacaaccactatggaaaacaatgtggagcttccttaaagaactaaaagtagaactaccatttgatccagcaatcccactactgggtatctactaggaggaaaagaagccactgtatgaaaaagacatttgcacacacatgtttatagtagcacaattcacaattgcaaaaatatggaaccagcttaaatgtccatcaaccaactagtggataagggaaaatgtgacacacacaaacacgcacacaccatggaatactactcaggaatgaaataatggcatttgcagcaacctagatggagttggagaccattattctaagtgaataactcaggaatggaaaatcaaacatcgttatgttctcatttgtaagtgggagctaagctatggggatgcaaaggcatgagaatgatgtaatggactttggggtttccaggggaaggatgggaatggggtgaatgataaaagactacagattgggtacagtgtacactactcacatgataggtgcaccaaaatcttagaaatcaccactaaagaatgtattcatgtaaccaaacaccacctgttccccaaaaattattgtaataaaaataaaattatttactttattatgaatatttctgatctttaaaaacatttttttactgagatgaaattcacataatgtacaactaaccttttttttttttttttttttttttttttgagatcatctcgctctattgcccaggctgaagggcagtggtgtgatcctggctcactgcaacctctgcctcccaggttcaagcgattctcctgcctcagcctccggagtagctgagattacaggtgcacaccaccatgcctagctaagttttttgtatttttagtagaaatggggtttcaccatgttggtcaggctggtcttgaactcctgacctcatgatctgcctgcctcagcctcccaaagtgctgggattatagatgtgagccaccgtgcctggccacaactaaccactttaaagtaaacaactcattggcatttagtacgattacaatactgtctatttctaaaacattttcatcacccccaaaggaaattctgtatcccataggcagtcattctctattcttccctgcccctagcaaccaccaatttactgtctgtctctgtggatttatatattctagtcttgaactcctggcctcaagcaattctcccaccttggccttccagtgccttgggattacaggtatgagccaccacaccttgggatttattcagatgtttcatataaacagaattatacaatatttgaccttttgtcttctggctgcttttgcttagcataatatttttgaatgtcatccacattgtggcatgaaccagtacatcattgtgttttatggctgaatgttcattgtatgtatacaccacaaacttgtttatccattcatctattgatggacatttggcttgtttccaccttttggttattgcagatagtcctgctgtgcatatgcatatacatgtgtttcttgagcacctgtttttcagttcttttgggtatgtacctagaagtggaattgctggatcatatggtgattctatatttagtgttttgaggatccaccaaacttttccacagcagctgaaccattttctgcttctactagcaatgtataagggttccagtttctcctcaccaatgtttacttcctattttttaaattatagccatcctagttggtgtgaagtggtatctcattatggttctgagttgcatttccctaatgactaacaatgttaagcatcttttcatgtgcttgttagccattcatatcttttttcaaaaagtgtgtaagtcctttgcccattttaatattgggttgtttctttctgtatgtaagagtcattttatacgtttcaagtagtagacctttatcagatatataatttgcaaatattttctccttttcttctgttctgtaggttttttttttactttcttcatttattattattattttttgagacagggtcttgctctgttgcccaggttgaagtgcagtggcacaatcatggctcactgcagccttgatctgttggggttaaagtgatccttccacctcagccacttgaatagctgggactacaggtgtgtgccactgtactcagctaattttattttttgtagaggcaaagtttcactatgttgtccacgattgtctcaaacttctgagctcaagcagtcctcctgcctcagcctcccaaaatgttaggtttacagctataagtgaccatgcctagcctgatatggttttttttgcatgtaagttctaaattttgtgcgtgtgtatgtgtgtttttaagagggtcttgctctgtcgcccaggctggaatgcagtggtacaattatagcttactgaagccttggtctcctgggcccaagtgagcctcccactttagcctcttgagtagctgggactacaggtgtgtgccaccacacccagctaactttaaaattttttgtaaagacagggtcttgctttgttgcccaggctggtcttgaactcttggcctcaagtttctcccactttggcctcctaaagtgctaggattacaggcatcagccactgtgcctggcaagttttgtaattttgaaataagtttatctatttttttctttgttgctcatgtttttggtgttatactcaagcatttattcccaaattcaagatcacagagatttaccctaatgttttcttctaaactattttacgggtcgcttcttatatttacttaatttttatatatggtatggagtagggatccaacttcattctttcgtatgtggatcttcagttgccccagcaccatttgctgaagagagtattcttttccccactaactggtcttggcacccttatttaaaatcagttgactgtagatgcataggttcatttctagactctctattctatttgtctatatgtctctccttatgccagtaccacacagtttggattactatactcttgtaataagttttgaaacaaggaagtgtgagtcctccaattttgttattctttttcagtattgttttggctatttggagccccttgcaggcccatgtgaatttgaggattggctttttatctctatgaaaaagcatattgggattgtgataggtattgcatttgaatttgaagattactttgggtagtactgcaccttaacaatattaagtatttcagtctatgaacatgggatatctttctatttatttagattttccttaatttcttttagcactgtttagttgtgttcagtatatgccttttcaccttcttggtcaaatttattcctacatattttgttcttttggatattactgtaaatggaattgttttctttttttgacatgtacattgctggtatatagcagctgatttttgcatgttgatcttgtaccctgcaaacttcactgaatgtattacctcgagtagggcaggggtgtgtgtgtgtgtgtgtgtgtgtgtgtgtgtgtgtgtgtcacggttggggggtggatttggaggattttctttgtctaggattatgtcatctgtacatagatagttttactacttctttccactttaaatgtcttttatttttcttgcctaattgctctggttagaaccttcagtacaatgtcaaatggcagtggtgaacatgggcatccttgtcttgttactgatcttagggggaaagctttcagtctttctccatggagtatgatattagctgtgggtttttcctaaatgctcattgtcatgttaagaagctcttctctattcttctattcctagttttctaggtgttttttatcattaaggatgttggattttgtcaaatgcttttcctgcatcaattgagatgatcatgtgtgttttttttcttttgtcttagtaatatggtataatgattttggggggtatgttttaccacccttgcagtcctgggatgaatcctacttagtcatggtgtataatccttttagtgtgctgttagactcagttttttaatatttgcttaggatttttgcatctatatttacaagggatgtcggtctatagttttcttgtggttatcttttgtctggctttggtattggggtaatgctggcctatagattgagttagaaagtattctctccttttccttgattttcgtgctcactccccaccttgtttgttttttgaatggattttaaattattttggaaagttaattattcagattcttaaggttattattcaagacgagccaaaaaaaaaaaatggtcttacccaggaaaaatctttgcctgatgagaatttaatcacaatactttgttgctcaagctccacctacctattttagaaacagatgatattgtagtcataaaatctcatggaatcagatgttgtgacttgattatgtatgtgtagaaattctaagagagcattcaatccaggattataatgttacaataatttagttacccatatgtatataaacatttctagcagcaattttagaaatataatacctccttggaggtatttaacaagatataaatttgatttttggctagctttcactacttcttaagatagaacttgaacattggggcaggtcccaaagcaaatactttaactacaatagttacgcacgagaaagtcatgtaaacaatctatccttgacaagctacaaagtcaatattcagatgtcccaaatcttagactcctttatttaaaagagctaaccaacaaagaatttactaagcccacctttcttttttttttttttttttttttttgagacagtcttgctctgtcgcccaggctggagtgcagtggtacagtggcatgctctcagctcacttccacctcctgggttcaagcaattctcttgtctcagcctcctgagtagctgggattacaggcacccaccatcatacccggctaattttttgtatttttagtagagatggagtttcaccatgttggccaggccagtctcgaactcctgacctcaagtgatccactggcctcagcctcccaaagtgctgggattacaggcacaatccaccacgcccggcctaagcccaccattcttttcagctgtttgtacctttagataaagttctcgctactctcttctatggtctataatttgtgaaaaactaattatgatgcaatttcaacaaatgtatttgttcagttctatttgattttctaattcatgttgcatgagtaatagatgcactgataaagttagcatattttaacagttttcctttcagaatgtgctttttaacagaatgctagcagattgttcagctgttatttttttaaattatattacagtccattcacaaaaggtacaaccacaaattatacaataaaccagaaattttataattctgtttttgtatttggaacagtctacagtccaactgtatttaaaggggaagttaatgtattcaaagggtatttttaagaccttttcattttggttaaaaatgatgacatacagccaggcgtggtggctcacgcctgtaatctcagcactttgggaggccgaggagggcagatcatgaagtcaggagttcaagaccagcctggccaacatggtgaaaccccgtttctactaaaaaatgcaaaaaaaaaaaaaaaaaagttgggcgtggtggcgggtgcctgtaatcctagctacttgggaggctgaggcaggagaagcgcttgaaactggaaggcagaggttgcagtgagctgagatcacaccattgcactctagcctgggcaacaagagtgaaactccgtctcaaaaaaaaaaatgacctgctgttaacttaccaaaacagttttagatcctaaaggattcctaatctggcattatagaccgaatgtggtacattcagtccaaaacttgtgttctaagatggaacagaaaacaaacatagtaacagaaatgtattttgttgtaatcaaatacatgtaggtaattttaaaagtcttttgaggggaggagtcagtaattgattttgttggtggagagaatgggtgaaactaaatgatatttttaaaaatatagtggttttcaggctggcacagtggcacactcctgtaatcccagcactttgggaagctgagacgggaagatcacttgaagccagtttaagatcagcctgggcaacatagtgagaccctctcttgaccaaaaaaaaaatatatatatagcctggtgtggtggcatgcacctgttgtctagctacttaggaggttggggcagaaggatcacttgagcctgggagtttgaagttgcagtgagccgtgatcatgtcagtacactcccgcctgagtgatagagtgcaactctctctcaaaaaataaaatataatggttttctaataggaaaatgtacttaggtagttttcccgtatccaatcctcatgacaggattgtgagggagatattactttattttacacttgagaaaaccaaattagattgattgactttaccatttcactcctagtaaataactgttggaaatcaaactcagaactttggacttaagcatcaagctctttctattaaaccagatttttgttttctataagttgcagtttaaaaaaagaaaagaacagtacttgttttctataaatgtatgatacatattctatgcttacagataataagcaattcattttaaaatgtcataacctcagaatataattaacaatgggacttggcctttcagatatattacaatgtgcttggattttcaaaaattttatttgcatgcagcttgtcaaggattttttttttttttaaggcagagtctcactttgttacccaggctggagtgcagtggtgcagtcttagctgactgcagcctctgtctacctcctgggttcaagtgatcagcctgccaagtagatgagactacaggcacacgctaccacatctggctaattttttgtattttttacacagacagtgtttcgccatgttgcccagattggtctcaaactcctgggctcaagaaatcttcccacttcagcttcctaaaatgctggcattccaggtgtgtgccaccacacccagccaaagataaggttttatataactttctcttgcataactttggaggagcagtgtagtgtagtgcaaagttatcaaactttaaaggacccaagaaatacctaggagattaatagctttttagggcccaagaaaccctctaggtacttctggtagaggtagtccagggacaatacctgggggaaacactggctttgaggttttacacagataaaaatacctacttcataaattagtgatggtgatttaatctatggtatctctacagttcttggaatacaacctggcacataggaaatgttcaaaatattccattcttgtgtgatgacttgggtggcaactaagaagcaagagaatattccttctttacattcaacaaaatttattgaattccagcagtattctagggatttgtggatataggggaaaatgggcacattcttcactcttgttgaatttatttgatgaactcattttaaaggtatagttcttaccttgttaaaaaataataaaatgactattgagcacatgtttgcataatcttttcccttgcaaattaaagttttattttttacttgaatgaggattgcaggtcaaagaaatgttctattatttctcagttttcttgttgctttaaatctatactatccaatacagtagccactagatacttgcagctatttaagtcaattaaaattgtataatattaaaaatacagctccttggtggcactaccacatttcaagtactcagtagccacatgtggctagtggctgctttattggacagtgcagatgtagataatttccatcatcacactaagttctgttgggacagtgttattctggagtgtgcaactacaaagcagtgattttccaattgtcttaatctgtagattgattttgaggcaagtattagcagtggcttgaggctgtcatttcagctcataagtgcattaatatcctttcaggttgaccaggcccagggctagtattgatttatcttaacagtttcatttcacagcaagtgagatctaaatgctaagacatctgggcattttctttaaacttctgagtaatacactaacgttattttactgcattagtcatagcttttctcatgcactctgtgtgtgtgtgtgtgtgtatgtgtgtgtgtgtagggagagagagaattcaccttcacagcattataattgttttaaatgtgcatgtaatgaaattttggggacaaaggaataaagaagagttggaattgcatctgaatactagaaatggtacttacatgaaataatttcttttatagaaaccaaaactaagagtagtgaaaagttggtttaacactgcttactcagcattctactgggtagaaccccagttatgattatttaaaaatattaattatgaggctgggtgcggtggctcatgcctataatcctagcactttgggaggccgaggtgggcggatcaactgaggtcaggagttcgagaccagcctgaccaacatggtaaaaccctgtccctactaaaaatacaaaaaattagctgggtgtggtggtgcatgctataatcttggctactctggaggctgaggcaggagaatgacttgaacctgggaagcggaggttgcagtgagctgagattgcgccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatacatatatatgataaatttagtgttttagtaattgaaaaaccaaggataaattcttctgtatttttgttgttgttaaaatctgcatataaaattgagtagccgccactacattccagtgtctaggtcgtgaatgtatttttttggttcagagttcagtaaatgatatgcaagagcaattgagtttttgcctctgtttcctgaatatgagtagctagttacagataggtcttacctcctttttttccttcagtttttgctgttgttcttctctgagaagaaaggcaataagagactgctgtcatttggtcacaggtcagggattattgcgactgaagtcattgaaatccttttgtatgttattgcctccttcaatgaccttctgtctttccaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtgagaaattacatgccgtttgtttttaggaaatagtctagtgagatgtaaaaagtgaaactaaggttgaagtcagaagataagtttgaaactttgccctctcgccccacatttttagccacggtgttacaaagagattctcatatgtggcatgtcagagtgttttactgcatgttgggtaacttatgggttcactaggcacaaaggaataattaaagggaaaaatgatggatttaccctctctgtgaactcttcttgtagtgatgttacctttaatgtttttgttgttttgtttctgatcttttgtaacaaggaaaggagagaagagattttagaaaattagttacaaaatctgtcttcattcctcaaggaaatgtgctgaaaggctcctagaattctctgcctctagctatattctgtagaccggttggggagggagtacagaggagagggagggaagtgtttaagatcaggaaattttggccaataagtgcacttaatagggacaaaagcagaaagggaagatgatattaaggagcagaatagaggaactaagtgttcttattctttttccccctgaagacaatgaaaaaaggaataaaatttgagttcttgagcctgcctttcaaagttctgtgaatcccatcactacctgacctttttaaccctatttaatgttacttttgaacgttaaatatgttcaaaaatgaagtagctgtgctacttcaagggcccgaaacatgctgcacgccctttcatctttgtgtcctagatctttctctcacatgtatttactggaatcctgtttgcctcctgagttgtggttcagaaggtacctcctccatgaagcatctatgaccccaggatagaatgagttttggcttaccacctagaatttgattctacttgtgttaagatggtaattgtcataccctgttattaggattgtccgtgtatctttttcctaggttttagcccatgttttctttagctttacttaatgatatcttacacagtgccttgcagatagtaagaacctggtactgtcccatgtttgtggagtgctgtttgagtctgccagttaatgattaggagagaatggaaagtcaaagcagtaggatccagtggtaggataaacacaaactgactgtaaaagtctgagatagaaatattgaagagaaaagtggaagccagaaggaaaaagcctgaactgatcactttaactcatttaaacatttactgaagatatgctctaagaattgtgttgaatagagtgggaggtgaatatgctttaatcccaccctggaggagctgctcacagtctggtggaattggcagttcatataaatagttacagtatcctatgataataaatgctttaattaaagctgtggattcctaggggtggggcaaggggaacttgaacaggaaaggtagagagactgacttttaaattgactttagaaatgttctagagggaatagtttttgcaaagcagggggaataatcaaaatgattacatgtcttcaggaagtttcaggtattacctaaggaggttttaaaaatagacattagcaataaagtcatggtacaatgaggaagagattttcaaatttaatggaatcattaaatttacatttcacaaagatcacccatcatagaaggtagatcagagatggcaagactataggcaggacaccagtttaggaatacctgtgccataatctaggcataggtttacaatatagaactgaacagaaaggcattagctggattgagagagaatgggcctattagagtcaatcaataggattgctcatcgattaggtataggagcacctgatagagaagttgtatcggtaaggattaagtatagctatatataacaaaaaccctaaatatcattgacttctgtgagagttcagaagtcagccttgcagagcttgtctgacagctccacagagtcttcaaggatgctcgcactttctcttagtgctccagcatcctcagcgcatccttcccatgcactaggttacctcttggtccaagatatccagagttctgtctattacatccatagtcagaaagcagatgagtggtttcctaggaatggggtaggaattggagagaaagattatgaggggtgcaaggaaacttttgcagttggtcagtatgttcctcattttatagtgatggtttcatggatatatatatgtgtctaaattgtacacttgaaatttgaacagcttattcgtatgccaattatacctcaaaaattgtgttctaaaaaaacccactcaaagatattggaagaaaacaaagggggagggccaggcgtggtggctcacacctgtaatcccagcactttgggaggctgagggggccagatcacctaaggtcgggagttcgagatcagcctgatcaacatggagaaacgccgtctctactaaaaatacaaaatatgtcaggtgtggtggcacatgcctgtaatcccaactactcgggaggctgaggcaggacaattgcttgaactcgggaggcggaggttgcagcgagccgagatggcaccgctgcactccagcctgggcaacaagagtgaaactctgtctcaaaaaaaaaaaagaaaaaagaaaacaaagggggagaacaacaatctgaataatacatcttcagaaagtgcagacttaacagaaaaatatgaccataaagcagcagaaaactgccacctgatactacaaaatgaacttaaaaaattaagaaaataacatgatatgaaagaaccatttaaatctgaattagaaaagcttgggaataattcgtctgtgtaacaggtgaatatgaaaatagctgcaaaaacaattagaaattttgaaatgatagaaactataaaagtatagaagacaagataaaaaatagatgtaataggattccctaaaggaaaaagccaaaacattcttctaacagtatgatctaaggcaaaacattggcaaagaacaaattccaaaaactatataacaaattgtatattctagctataacacattctgaaaacttccttgaaaggaaaatgacttgaagctctctattgaaaaggcatactgtgtacctggtatggtcagtccagagcaatcagcgccaacacattctgcaaagtcaccagaaattgggcatccagactaaaactgttataaaattaagaaaataagattggtatcagacttctggaaaaacacttcatgccaacagacaaaaaagtaacatttaacatcctcaaggaaaggaaatatgaggcaatgattatatatctagcaaaaacgacctgcaaatatatcttagcatgggctgccgtaacaaaatattatagactgggtagctgatgtattttctcagtttggagatctgagcatggttgaggtctcatgagggttcccttcctggcttgcagaacttctggctgggtcctcacatggcagagcgagcaaacactttggtgcctggagtttttacttgcaaaagaggacattttgtttcaattgtcgataatcatgcctcagataaacctcactggctatgatactaccactgcacaaagcttggaaattttgaccatcataaagaatacaactgggctgggcacagtggctcacgcctataatcccagcactttgggaggccaaggtgggtggatcacttgaggtcaggagtttgaaaccagcctagccaacatggtgaaaccccgtctctactaaaaatacaaaaatgagccgagtgtggtggcgcacgcctgtaatcccagctgctcaggagactgaggcaggagaatcccttgaacctgggaggcggaggttgcagtgagctgaggtcacgctactgcactccagcctgggcgacggtgagagcccatctcaaacaaaacaaaacaaaaaaaagaatacaactgcatggattaaaacataccaaatatatcttaaaattcatgaattcataatactttaaaaaaaacctcattgctcacctttgaaacttactagagtacaattcattactctgaatggcagtaagtttatcctatcttttctttatagactatataaagaggtaacaatcatcagtattggctaaaacctttgggtaaagggaacaggctggcatcatctgaactcagtgggcaatgtcagcgtcactgtaagtgggacaaccaaataccatttcttctgatgtgatgcatcaggaagtaccaggcaccactgatgaaaatgactaaaatgaacttgtatcaaagcaagcttccagtctgcactgttcagtaaggtagttgttagctacatgtggctaaagttaattaaaattaatacaattaaaaattttcttgcactagctacagttcaggtactgaatagccacatgtggctaatggctactatattgggcagtgcagatatagataatttctatcactgcggaatgttctgttagacagtgctgctctaaatctaatgattagttttcaggaaagatgtgagaacatgtaaacttgccaaatgaccccatgagactacaatcagaaaagtccagaaggcaggaaattctacatgacaaatggctccatttctgttaataacatgaaaataaaaggtaataaaaactttcttttttatagcaagagatatttagaaacatccattaaatgtaatctgtagaccttgtttggattctaatttaagaaaattgtaaaaatgcatttttgaggcaatcatgaaaattgcatatgaatcaggtattgggtattatgaagatgttcattttgttgggtgtgataaaaatgtagttacatttttaaaaaataaagcttaccttttagggatatgtactgaagtacttacaggtggcacgatgtctgggatttgctgtaaaacactggcggtggagggggcaaaggacaggatggatgcagaaaacgtggtaggcataaggttgatgggtgaggcaccatgataaggagatggggtgactatacttaatgtctctacatatgtttcagaatttccaaaataaaacttaaaaaataaaaatgccgatgcctacacattgccttctattactagtctaagaaaaacagatgaagaaaaaaggctgcctcttcatacattatttggaatttctgttgtgcaaaatggggtcacctaatttattatataattattgtcatatattgtatgaaatattttatattggaaagttgatcagtaacttcataaagatttagataaaatatttaatcagcatattttgactttcgggcaagtttatggaatacttgcttttgaatcaaaacgtgcaatttcttttattccttggctgacagttttgaattcaggtctgcatgttacattttattactgctttgtttttttcctgttatttcattcttcttgttgcttggttgccaggctggagtgcagtggcgctatcttggctcactgcaacatccgactcctgggttcaagcaattctgcctcagcctccaaagtagctgggattacaggtgcccacgaccatgcccggctaatttttgtattttttagtggagatggggtttccccatgttggctaggatggtctcgaccttctgacctcgtgatccacctgcctcagcctcccaaagtgctgggattacaggcatgagccaccgcagcaggcctgcaaaaatattgaaataacatatttataagccatcttcagccccaccaatatatagaaattttagcaaaaaggtttttttaatcactttagtagaaagtgataatgtcattgaagtgtaatttcttggccatctgctcctacagtaaatacttctttaagaaaaacgtatttatggctgggtgtggtagctcatgcttgtaatcccagcactttggatggccgaagtgggaggatcgcttgagctcaggagtttgagaccagcccaggcaacatagagagaccctgtttctacaaaaaattaaaaaaaatttagccagctgtggtggtgtacacctgtggtcccaactactcaggaggctgaggctcaaggatcacttgagtccaggaggttgaggctgtagtgagccctgattacgccattgcactccagcctgggctatagagcaagaccctgtctcaaaaaaaaaaaaaaatctatctgtctgtgtatccatccatccatccattcatccatccttagttgcttccattaaagtatttgagggataatacaataacatataataacaaccacttatgttttttactgtatgttagacactgtcccaagtactttattaatttaattctcataacaaatcctgtgatgtaggtgctattatctctattttgtagatgaggaaaccaagacacagaagggttgaacaccttgcccaaggtcacactgctagtatatactggaactgggactcaagcaggctggctcctgggtccttgctctcgaccattgtgttttgtggactgtcatgtaacatactaaatgaataaaaatactagaaatatctataactgtagatttgtcgtggttaagaacaagacctttgggtcattgagacctggggattcaaactccagctcagtctggctctgtgcatttgagcatgttgcttaatctctgagctccagctcttcatcacttaaaggtaactattattaaatagtggagaaagcaattaagagggatagtaatgagtgcgattatgcctggattttagctgtgagcttaatggcagccaaagcaaaagaagaaatacgagttccatcattcattatgtaacacaaagaagcatacctgtttgcaagcatgatacattttcctggtatagcatttaaacagaaactttgaggtgtgattttttatataagacattgaaccagaaatgaataagttagagcaaatatggaagagtcaattctcataacagtataatgtaaggcaaaaatatttttgtggaaggctacattaattgggtccaagtatgttgctttttcatgttttttgttttttgttttgagacagactctctctgtgatgcccaggctggagtgcaatggcaccatcttagctcactgcaacctctgcttcctgggttcaagcgattctcctgcctcagcctcccaagtagctgggactacaggcatgtgccaccacgcctggctaatttttgtatttttagtagagatggggtttcaccatgttggccagtccggtctccaactcctgacctcaagtgatccgcccgccttggcttcccaaaatgctgggattacaggcatgagccgctgcacccagccctttctagtgtttttgatttaaggaaaagtcctagaatatttagaatggaatatgtgaatagcatgttcaatagacagacttccctaaacacgctctccctcagataagcttctgaaaggagctgccatatagaaaatctcaagtttttctctttggtggatcccagaactgccagcatcccattagctatagagggaaatccatgggtttggctgttagcaggtggaaggagaaaagctggatccaaattcttcttacttgaatggatggtgttttggtcaggttctttggtaataaagaacagaggtttacatgtctgtggctgaaataagatgataaagactcatatgaaatgattaaaggggtgggctgtcagaggaattcaaacatgaactgtaactgggttgcacttcacaggcaccagatacggaggacagtttggattccagatggctccatagactgcactggcagagtgtctgtgatttccatttagtacggtatccccagcatctagaataatgcttaacatataatagaccccagtaattacctgttgagaaaataaataaaaggaagtagtaaatcttcactctagagctttatcaaaatggagaagtgagtggcttcaagtacgtgattgataagagctgctgttagccggctatgctcttggtccttcacatatattattatttgagtatgttcagtcctgtgaaggggtgatggtaccctcattttactggtgatagaatttaaattcaccagattatgacttgcccaagttcgtgcagaatactaatttggagagttcaggtctacttgactctaaaccttgttctggtaactgatgccctatatattgaaagtacaaacagggtggtaaacagaagtaaacccacattaccagatattaagaaagcatcttaacagctgttttgagggatttcatcagaaacattttaatatcagcctggtctgaaatatcagaaaccatttttctctggctttactttccagtgctagggaacttctaccaaacaaggtaagcaaactcttatattactaagttactagtcagagtttttaaagtaaagattagccactggctttccatttctccaactaaaaagaaattgtggggactgttttacagggcatgaagcagatgactaattgtcttataggatcgttttaattttgaaataactataatctgggataagtaattcatcacatatactttaatatgtgtaagtgtcatgtggttgaggactttctcatccttgtttgaaactgtctaggggctctgtgtggtggttcatgtccgtagtcccaacattttgaatccaagcactaggattgcctgagcccaggagttagagaacagcctgggcaacatggtgaaactcccatctctgtaaaaaatagaaaaatttgtcaggcatagtggtatgcacctgtagtcccagctactcaggaggctgaggtgggaggatcacctaagcttaggaaggttgacgctacagtgagcagtaatcatgccactgcactcgagcctgggcaacaaagggagaccctatctaaaaaaaaaaaaaaaaacacacacaaccatgtgggattaaggttttatttcactggtttatgcttctctaccaaattatggttaaatgcattgtatctcaatgagataatattgacattgaccttatacaactgacattttttataggtatcagtattatctgcaactgaagaaagatatcttggaaggaagtattccttgtaccttagaacaagcaattcagctagcaggcttagctgttcaaggtaaataagatcaattcataatgaaatggttctatcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacagtacaataaatagaagtatgtatatatgtgtgtatacacacacatatgtacaatcatatgccgaatgacattttgttcaacaaaagacctcatataggacagtggtcccataaaattataacactatttttagcgtaccttttctgtgtttagatacacaaataccattgtgttacagttgcctacagtattcagtacagtaacatgctgtataggcttctatgagcaataggttatacaatatagcctaggtgtgtagtaggctatacaatatagcctaggtgtggagtaggctgcaccacctaggtttgtgtaagtatactctgatgtttgcacagtgacaaaatctgatgatgcctttctcaacacattcccatccttgacacatgactatatacatatacatttattaatactatgctatgtattcatctagttcaaagactttgtctgctaataggtcatattttaagaagaaagatatgccagtcagtgagtttgatgaggttatattcgcttacagtttaagtacacttcatatgtttggtttctttttatttatttcaataggtttttggggaacaggtggtgtttgcttacatgaataagttcttcttatttatttagttacttttttttttgagatggagtctcgctctatggaccaggctggagtgcagtggcacgatctcggctcactgcaacctcctccgcctcctgggttcaagcgattctcctgcctcagcctcccgagtacctgggattacagatacctgccaccacacagacccaactaatttttgtatttttagtaaagatggggtttcaccatgttggccaggctggtctcaaactcctgacctcaggtgatccacctgcctcagccttccaaagtgccgggattatagatgtgagccaccgtggctggctatggttacatgaataagttctttagtggtgatttctgagatttggctgtacccatcacctgagcagtgtaccctgtaccccatgtatagacttttatccctcaccccactcccacttgtttggtttcttaaatggttgtcctgaattatgcagtaataacatcaatcataatagataaagatggctgggtgcggtgtctcacgcctctaatcccagcactttgggaggccaatgtgggaggattgcttgagtccaggagttcgagaccagcctgggcaacatagcaagacctcatctttaaaatgtacatatataaataaagattctgcatttcaccagcatttttgaattgtttatttttttcatttttacatgtctgatatacatgtatttacatgtatgtgtgtattttcctttttttggagacagtcttactctgttgcccaggcttgagtgcagtgatgtgatcgtggcgcactgcagccacaacctactgtgctcaagtgatcctcccacctgagcctcccaagtagctgtgactacaggtgtgcgctaccatgcctggctgatttttaaaattttttatagagatagggtcttgctatgttgctaggctggtctcagactctttggctcaagctatcctcccctccttggcttactgaagtgctgggattataggtgtgagccactgtgcctggctgggaagatttctgatggggcattatttcaaacaataactggcatttagccttgggagtgaaatttaatcagaataattattaataaaactccttcagccataagaaggcatggagacatgtatcatttttaaacaaatgcctgatgcacatggagccacattccttttcaaggtactttagattttcttaagtatcacttttggctttaagaattactttttcataagcattttgctgaattgtcaattttttaaaaaatattaaaaatttcaacacaaatatatcttgctgtaatatattcaagtggtctaagtctattccccagaggtcatcagtactgttgacaatttggtttctccttgacattttcctgtacataagcaagcatatatgattacagggtaggttttgtttgcattttaactgtaaaatgagatcatattacatagagcttgcaacttgtttttttatttaattcataggcatttttccaagccaagactcatatctgcctaattaacacttttaaaaagatactttaaaaatatactttatatagctataacaaatttgacttctgaaatattagcataccatctagatatactgcgtattgaattttgttgtgcatattttgcaatgaaatttaaatataattaacgtgaatgtttgtcattctatatagcggattttggtgactttgatcagtatgaatcccaggactttcttcagaaatttgccttgtttcctgtggtaagacttcttttgacactgggccttttaaaagaaacagtttattcctatacccttaataatccctgaaatgaaatccgtatgatagacttactgtcaggaataggattataaaaaaaaattccctcttataaacatctcaagtgtgactgctttccctgttgtagtcatcttggtccttgtgaacccacagaaactgaagggtctgtagtcactgcactgtgcctggagacatttgttttctatttgtgagtttaaaaagaaggattcattttcagcttctcaggaagcatgcacaggttttgcttttaactgaaggtttgaaaccttacaaaattatattgaggaatgtcgcttctcatcagcaatttaaaaagtagatgacaaagacactgccttctacttttataaagtcattactgatggaagggacatggaaactgcattgcaacaactaaggaaggtgtggtatgctgttctgagtgtctacacagtgccagagaacgcacaagatgtttttatcttgctgggctcaggactggctaactactgtcaccaacttgacataactcagctgaaactttccctggaattgagaaggtggggcaagttttttttttttggctcttgtgagaagccagttaattccttagaaagatgattacctatgtaaacaaagctcccatatagtaacaatagtcataattttgcctgatagtgacgagagtcattaacagtcaatggccatgattccttctaagaaattggggtgaattgtcacatacttaccactgtgtgttttcttcagggatggttacaagatgaaaaagtattggaagaagcaacccaaaaagtggccttactacatcagaaatacaggtaactctaagaaataagacatggaaatagcatagaaccaatgtctgcttgaatttgaaatattcaattaaatatttaatttacatgattaatatttatttgcccaactaaatttggaacattactgccactactattacaagtagccaacatttatatagcactcactgtgtgtcatgtgctgttctaagtaagcacttacccatattacttatttattgtccatgttttaccagtgaggacactgaggaagttgaaagcagccagtcattgaagggtgcccattttttactgcatgtagtaaaggtttgtttgataacctcaaacaaacctgtataggttaacgtaaaattaggatgatttgttttcttttatgatacagcttagcaagtacagggttacttccctctctatacctatggaagctgtgtctgtcacctggggagctatgctaagagctatggtgcttattactctgaactatgcttctgcatacctttgtatacttgtacatattgacgttctttcatgatgaatctctgtgttgcctgtaagaaaaaatactcttctggataatgctaagtcttattctaaaccaactaccacacagttccacatatagatgctccttgacttgtgatggggttaagtcctgataaacccatagtaagttgaaaatactctttaagtcgagatgtatttaatacaccagtcctgctgaacatcatagcttaccctaacctaccctacgtgttctcagaacacttatgttagcatacggttgggcaaaatcatctaacacaaagcctgtaatatattttataatgttgaatatctcatataatttgttgaatactgtactgaaagtgaaaaacagaatagttgcgtgggtcctcgaagtacagttcctactgaatttgtatcacctttgtaccactgtaaagttgaaagtcattcagttgaaccatcatcgtaagttgaggactgtctgtactctatcattaaattcttataactactcattaagataaacattattatctccatcttaccagatggggaaaccaagctcaaaaagattttgttatctctggctgggagcagtggctcacacctgtaatcccagcacttgggaggctgaggtgggcagatcacgaggtcaggagatcgagaccatcctggcaaacatgttgaaaccctgtctccactaaaatacaaaaaattagccaggtgtggtggcatgcaccggtagtctcagctactcagaaggctgaggcaggggattcgcttgaacctgggaggtggaggttgcagtgagctgagatcgtgccactgcactccagcctggtgacagagcaaaaaaaaaaaaaagaaaaagatttagttacctctacgtgtggtagaggtggaaattgaaagcagatcagtttcattagaacctattgcttatccccttccaaataaaataaacttttgcctctagtctctctccactcaaatccacacagtgactcacaaaagattaatctccctagaatatcagtttcctcttacctctctccttctccttccacgtgctcatgggtattttcatgctttctactagcccaagttcattaccctgggattaaaggcctcctacaagttggttaaatcctgccttcccagctttaccttctgctggacagcagaaccacatgaaccatttcttttctagcttaattggtccctcaggcacacattgtcctgccttttgtcacttccatttattcatttgtgcatttccttaaaagatagcttagtgttcttattctgcattaagcagaggaagagtgctggatgctatgacacaaagataaatagaataatttcttgtcttctaagagtgcattcccagccctgcaatatgagggctggcaggacaacccactatagtaattataatacatataagaagataatgagtgcagttagaggggtatgggcggaatgtgttgggactgcatggagctgcggcattggagaatcccagaaggtgatccagaggaaatgatgcatagacagagtcttgaaggatattagggattggccaggtccacaggtgagtcacaggcacaccaagaagagggattctcatgtgcaaaagcccagaggggctagggaacatattctatctgaagagatgcagagtttgggatggctgcagtgtgggtgccttgaggacagcggggagcatcggaagatgaggctggagatgcaagtctgcatgcacttgggcactcctcctttacccacactgccttcctacccatcctagtagtgttgcactcacctgagcaaaaaggggttttcatgtagcctcctcgtacccttattccctgcgttcgacatttagcacataattctcagtaatgcctcatattttgttgtttttatttttgtttttttttgtttttttgttgcccagactggcatgcagtggagcgatcatagctcactgcatccttgaactcctgggctcaagcagtcttcccacctcagccttccaagctgctgggactatagatgtgcaccaccatgcctggctaatttaaaacatttttttttttgtagtgacagggtctcactatgttgcccaggctggtctcaaactgctggcctcaggtggtcctttgtccttggcttcccaaggtgctgcggttacaggcatgagtcaccatgcccagccctgatatttgggataataagcaattacttggtggtttaagaaaagttcaagatttcaccctaagattttttagggagttgttttatcccccaccttcccactcatctgccttaagtatggagagcaggatctcatgtgataccctcagcattcagcacatactggttttcagtaaatagcaagattgatatagccaattatagatgcttagaaacgtgaaatgtttataatgtcttatgctaaattgacatataggttttaagaaaagctttattttaaaccattttaagcttgctttgtgaacaatcttgcttcttttgggttgcagagggctcacagctcctgatgctgaaatgctgtacatgcaggaggtagagagaatggatggctatggagaagagagctaccctgctaaggtaagtgtggcttggcggctggggctctttaaagttaggcttacaaatttgagaaaatcatggggaaatccaaggatgtccttatgtgcaaaggctgaggacgtgcaaaactctggaaacttaaaagctgaggtcctggtgaccaaagttttgtggtaaaacacattcccattttgtggttcatactttgaaatggtcttgaaatagagttcctaaggagggccaaactttttcaatttttatacttacctataagatcatagatctcattcagacttttgtcttccttaatagttactctgtaggtcttcggaactttctacatctgggaaaccagtccagggaactctagcagcagttcctctgcatctgcttcctgggtgtttcttcttctgctttctccttgtaggatagccaaggaagtgacatatccattggagcgtgtcttgaaggtatctttgtgaaacacaagaatggaaggcatcctgtggtatttaggtatttttcttacctctttttgtatgttttctatggctcctgttggtgatacattttttagtacttacagcagttaaattgttcacaagtctataccaaggtctcattaaaaaatggaaataattcccttcctaggaaaaaaataccatctgaatgcaacagtccttttcaataagccgctttcttcaaaactctatgtccagagtataatgcctataatgacggcctattataaaatgcttaaaaatgtgtgaccctttttgtgccatatggaggccattctttgctttgatatgaatgtttaatttgagctctggtttccaaggctatttattggttaatttatttattgtgaggcaaggtctcactctgttgcccaggctagagtgcagtggtacagtcaccactcactgcagccttgacctcccaggctgaagtgatcctcccatcccagcttcctgagtggctaggactacaggctaatgccaccatgcctggctaatttttgtattttttgtggagacagtttcaccatgttgcccaggctagtctcaaactcttgggctcaagctatctgcctgcctcccacagtgctgggattccaggtgtgagcccactgtgcccagcctgaagggctctttcctatgaaaaatatagagctttgttttgactctagttttgtaccaaaattcctaaaataccagtatctaagcaaatttcaattattttttataatgttggttttttttgctgatataaaaaaagatactattcatttgtggaaatcttggaatgtgaagcaagttggaaagaatatatagcgatgtgctaatagtaactgactctgaacaatgaaagtacaggtgattttaatttcctttatagtattctgtgttctaatttgtatcttaaagatagtaagttggaccatattgtacaatcccctacctttaattccttaaaatctgttatctggaaaacccaaagttcatgtccaaccaaaagcttatattgtttttataaggcaggaaaacatattctatcacttttgttttttggttcctttgtgtctaccatttgttgagtgcttatcatgagtcagataaactatgctgagcattttttgtgaattttttttagtgtaatcttcataacactgtcagcagtaggtattaccaccactttgcacgtgtgataattgaggcttagaaaagttgtgatttgtccatggtgacccagttattaactggcataactaggactagaacttggatcctccactttatgcgtgggctcttaatcgctgtattaaacagcttttattctctccaccgcctactcactgcccgccccacaacacacacactactcaagctttctaaaccactcctaccatttcttcttgagaactagtttggcctttgaagagctttttctctaaactgacatctcctccctcacttcctttgctttactgcctcttgagccatgaattctccatggtgattatgacctcagagagtacgcatcacttggggagcagaaccccattcctagaatgcactgccctgggctgggtggctcccctttggcagttgctctctcgtccccaagccacttatattaacccttcccaacatgctgagttgggggtcagggagaggagaggaaaatggatccgtggcttcacctgaagagcagggctctgatggtgcccaaagtgtcacatggaaacttgaggcatctacctggcttcctttatcactggataggaattttcacagttgccttaatgtgatgctaataatctttagatttaacaaacaacggaatccgtactaagttgattttattttaatacatttaaaataaatctaatggagaaggataaaattttttcttccataattttttctttttataaaattctgtgattaataaaatcaaatattaacatataaaagctaatacgataaaattagaaagtataagattttgaatcctagtgatcacttccagaatagttcactctttgagttcctggcatttcaaatttatcttcaccctgaagcttttcagagcacacctcccccacttttgtgccttattttaatacctgcagcacttaaaagttcttgtttgcttctgtgttctttctcccacctttcccctccaactgtgcgaatttgagggaagcactgtaactcactaatcttagtgtccctaggacctactgcaatttctggcattgttataataggtgtcttttattttgttgaatgaataaatggggcattggcaatcagctaagagagggatcttccatcaagcaaatctgacacatgagaatgatacattttacatcttttaaattctcttttccctcatttattatacatgagtttactttttgaactagctgctgttacttcaattagaacattcatgctagctgattaaaaccactgtttttttttttcttttttctgttttggttttttttgagacagagtctcgttctgttgcccagactggcatgcagtggcacaatcttggttcactgcaacttctgcctcccaggttcagacaattcttctgcctcagcctcccaagtagctgggattacaggtgcctgccacctcgcctggcctagtttttgtaattttttttttttttttagacagagtttcatttttgttgcccacgctggagtgcaatggtgctgtctcagctcactgcaacctccgcctcctgggttcaagcgattctcctgcctcagcctcccaagtagctgggattgcaggtgcccaccaccatgcccagctaattttttttgtattcttagtagagacagggtttcaccatgttggccaggagtctgaaactcgtgacctcaggtgatccacctgcctcggcctcccaaagtgctcggattgcaggcgtgagccaccatgcctgacctagtttttgttttttatttgtttctttgtttgtttgtttgaggcagtgtctcactctgtcgcccaggttggagtgcagtggtgcgatctcggctcactgcaagctctgcctcccgggttcacaccattctcccgcctcagcctcccgagtagctgggcctacaggtacctgctaccacgcctggcgagttttttctttttttttgtatttttagtagagacggggtttcaccatgttagccaggatggtctccatctcctgacctcgtgatccacccaccttggcctcccaaagtgctgagattacaggcgtgagccactgcgcctgggctagtttttgtatttttaatagagacagggtttcaccatgttggccaggctggtctcgtgttttttgttttttgtttttctcaaaaatgttaccaaatgctaacttacacgtcaggcttagggaaaacttgtgtattctatctccttgtttcccccatgggcactcacattgccagttctctatttgctgttctttaggtggcatgacattgccaacatgtcccacaacaagtccttttttgcattagagctggcaaataaagaggagaccattcaatttcaaactgtgagtaaacattaggggtctgcatggaatgtttttcctaaaagttaacaagttctacttctgcgtgcctgtatgtgtttggaggcagggcagcattaaaatgataatattttgtaattgtataaaacatgcagttttatcatatagcattttgcaaaatggcagttagcaaaaaatggctgctcagtaaatgctgagtgaatgagtctttggataactactgtctgatcatgataacctttaaattaaacttcagggattatgtgggggagaaagtaagcactgatatcttaaatttcattgataaatgaatagctctgaagaaatgttatttaacagttacttgcttttgctctcttgacaaaggcaatattgagttactgagtcatatttttgtttaaaaatgtctttgagtatatttggcaagaataaaagttggtatttttatagtttttagattcccaagtcattttgaaactgtttaatatgagaatcacactgttagaacagattgttttgtcttcataaattaaatcctacttgtggtattcataccatgggcacagtgttggaaaatgaaaggcttatagtgttctgaaagtgactttgtcatatgatgtcacccattatgtctttagacaaactctgcattaaacgtatcaagttgtatgtgtgctttcatattgctttatgcctattttgtttgctaggaagacatggaaacagcaaaatacatttggagactctgtgttgcgcgacacaagttttacagactaaaccagtgtaacctgtaagtatgtcctgctcatggaaattatcaaaaataatgaatttagaaattgtaatcttgagtatactgtatcatcaagaaagacattttatcagttgacatcttttcttgatcctatagctgttttcctattttagctttggaccaacttgtaataactacattgtatacctctaagatttatttcaactagttacaagaaccattgtaattcttgaaaggtaaaaagggaataatatcctttatttgtttaaatcaatcctctggtaagcattttgagtcattaaagattattcagcttttccagctatctgaagaatttttgcccctccttcctggtgtgcatttttcttagcccacatgggtttcttactgtttgccagatcaataaagcacacggtgatattgcacatataaaatattgtccttcatctatactcccctccagcctctgcaccatatctctgctttcctgaatagcaggtttcctcaagagagttgtgtatgcttgtatgtttccttccttccatcccattttccctaagcctccacgttactgatgctgcttgttgtggtcaggtgactttcgtccagtgatcatttcatgagttctctcacttgaccgctccgcagtactgatcctccgacagctccttccatccttctggaatcctgctcttcttcggctgccaggacaccaccccctgctcggcttcctctttctaggctgtttcttctcagtcacctttgctggtttggtcctgaggccttttctccaaatcctttcgtctagggggcttctcctgacctgtcctccccctgagcccccggttcaagtgattctcctgcctcagcctcccgagtagctgggattacaggcatgcgccaccacaccccactaattttgtatttttagtagagacagggtttctccatgttgttcaggctggtcttgaacttccaacctcaggtgatctgcctgccttggcctcccaaagtgctgggattacaggcgtgagccaccgtgcccggccctccttgagctcttgactcctgcatcctaccgcaagcatttagtgtgcttagtcctcaataccactctgaaagttgtggtgaatatatactactgcctgtatattctgaaggtagagctggcagaacttgctgatgaattggatgtggtatgaaacctgaccatttttaccactcgtgttaacagcttagtgctggctgccactacttctcatcagaatactgaggtagccttctgactttcctgtttctgtgcctttgctgcctgtagcttattttccatatgtcagccagaatgatcttagtttaacctgaatcagatcctgacactgacactcttcttttttttttttttttttttttttttggagacagagtctcgctctgtcacccaggctggagtgcagtggcacgatcttggctcactgcaacctccgcctcccgggttcaagtgattctcctgcctcagcctcttgagtagctgggactacaggcacatgccaccacgcccagctaattttttgtatttttagtagagatggggtttcaccatgttggccaggatggtcttgatctcctgacctcgtgatccacctgcctcagcctcccaaagtgctgggattacaggtgtgagccaccgcaccctgcccagatcctttcactcttcttaaccctcctttggcattccacttctttttttaagtaatttttttagtttgtttttgagacagctctgtcacccaggctgagtacagtggcatgatcatggctcacagcagcctctcaacctccctgggctcaggtgatcctcccacctcagcctcctgagtagctggtaccacaggtgtgtacctggttaattttttggtgttttttatagaggcaggatctccttatgttacccacaccggtctcaaacttctggactttaggaatcctcctgccccggcctctcaaagggctggacaggtgtgagccaccaggcctggccccattttacttctaataaaagtacgaggccatacacagtgtggtccttgcctggtttcaaccttatgtcttttatcctcctccctgcttgctctgttccagccacagtggtatcctggctaggctgcagatgtgcctcaccctaggggatgctgtccttgctcttttcccaggtctccacctgccttgctccctcattgcagcctgctgtctggtcagatatgaccctcttcagaggctgtccctgattgtcctatggtaccccccttccactatgatctgtctctttaccctctaactttgttttgttctttatagcacttagcaccatgtgaatttctatatttgtttgtttgtttgtttgcctgtatcccctgccagcaggttagctctagagcagtgcttgaggacagacactcttccctgccttcagtgctatattccccatgccaagcaagggcctggctcactgtcggccttaatgaatttgttcagctaatctatagatacaggtgttaagagctctgattcaagatgtcttggtgctgtaagatcccttaggaaaatggtacgtcacccagaactgccaagataggaaaggctacccagccaagtgacatctaagctgagacccgaaatgttgcactcaattcccacaacctttctttaagctgtcctcttgtccctggtccatgtctggaggcacctcctggagctccctcccacttggccccccacgccctatctcatctgtatgcagtcagtcttctggatagataagcaaaatatgtagcactgctcttgaagttacatgtcaggaacaaatctgagcatgtgcctctcacccgccccgtcctgggtacaggattaagggcagactcctgaggtccttctctggacttagctgccccagcccagttggccttggagtctgactccaggaaggcatctttccttatcatgtgaatgcccccagcccaggcctttgctaaaatgcccttccttcccttctctgacagactcttagtcattcttcaagattgagtttaaaatacagcccccatagacaccaccaaacattcagtttgcttagtccttgacaccactctgaaagttgttttttctacctcttttataacaatgacctgaataattcataacaataatttagtaaatgcttgctctgtgtcaagcattatactgagagcttttattttctttaatccttacagtaaccctgttgggcacaattattactatcccattattgatgaaggtatggagacttacagaagtgaaatgtcttgccctgccacacaactagtaagtggagcagcaagactcgagcctgtgctcttagccgctgtgctagcctgttagagtagttcctgcctgcttttttcatattgacagatatcaactgacagatcattttcatttgatctgtctctcttgtttgatgaagctccatgagggcagggtctcctcttcctcatcttcgtgtcccctgtctggcaaggtgcccggtgcataagggcttagtgaacaatgggagccggagtgtggcagtgatgggagtcacaggggagaagagcacttttgctcctttgtctcttccttttattacagattgtaaatgaggcatggggtggaggcaaagtctaacaagggcattttgtcccttagcaccaggaaggaaggagaaaggctgtggaagtgccttctgtcttgcagggtgtgagagaaactctgggcaggagcagcagtgtaaagataacatgcggggatgcccacccggacggggagctggccagtggtttgcatgtatggcccagtccctgtctcttctctgccttcccctgcaccatgtttgcatccgagtccccatcgctggtctggtgatgggattttcgtaagcactgacagggaggaggaacctgctttctttgtaaatatgggaagcggtttctgctaggggcctgggtgtatttgcatatgaaagtgttccccctggtggtgatattcagtagtgctacttgcctttggggttccctggggctggcctggttatccagccatatgtggcatgatttctatgcagaagtaagttctaagattcaagcagtagataatgcagtctgttggaccacagcattttcattttaaagactttaataagttaagagtgttcataatattgagccattattacctcagtttgtttcttctctggaaaatagtggagagtctacattttgaataaaccataaaacataatccctttccatgaggcatccatattggttggtggttagtgcctgttttttgtttgtttgtttgttttgttttgtgtttttttttttgcaaattaacaacttgtaataagtaaaagagggaagagggaaaagcaacaaatgattgattatggtgaatgagtcttagaaattcagctctagtttttggaatattgctatttattggcaagtgtgaacaaaactacattaatgtcatcagttgcatatgctatacctaaataaggaacacctgaatctttttaaaatggaatagttatgtttaaagggctgttttccaaagtttgctttcaatctctatatatccaatagattgtggcagtcgatttccatgagctattcctatgtaattacttatgattcattctgtagggaactaatatatttcattgtgagcgtttgtttcccacataaagtaaatgaagcttttaatattagcttttaaaattttgcttgataataaaatgaaaagaactttaattgttatggccatgttttaaaggctctcaatatagactgtttagtcatgttccaatattatgattctgaagtattggtagacttgttgtcatgggccagatgggtaaactaaagcgtgataggcatttaacaaaactgcccctggcctggaactggacggtggcttctggacatctgctttgggctggggtgactggtggcccaggagatagactcgacttgcacagaaaggggaactgtaatcccagggtgtcccctttacccccagtcctgatctattgtagtttattgctgcttgggatggccttatgtgactcatctaatcttgacccagataactatattttagtatttatacaatggcataatccaacagccttctccctccaccccctaacaaagtgcattagataacagaatgatcgttatccaaaccttaaaaatgttagatggataacaatctgtcttttaaaattataaagtgaggatattgagacttttatacttaatattcctttatggttgaattgggaattaaatgacataataatgtcaacctgttagatcagaaatctgcttcaaacccactgtctctcactctaagccccagaactggtcatgctgtaagcaccctccctgatttatataaggaaaatgccgggagagttggggagtcatgagaggccccttggtgtaggtggctcccctgctcttttctgtgaggaaaagggaggatggtatccttcaacctgcaaagccaagtgatagagggttcaagagactttctccagaagggaaacttgtatttcagactgcagcaggccactcgctgagcgcagtgagatggctggtgagtgctccctgcagctcaggggtgttggtgaacatagcagccggtgtccaccttggttccggagacttttgtaatcaggagactgactagagtaggccctgcctggaaagggaaagagtttacccatcttcttggcctactgcagggcttgaagagactataggaagtctggaagaagatggagcagcccctatcccattccagtcccctgagccccagaagtgtagagaggacccagtagttcccatggatccatgtgaaggagcagggcaggaagaggtgggaggggagaggaggagcagccacaaggccaaacagtgggacctctgggtatggggacatggacccctggtggagccgaggagaggcagcggctttttctgagtaggttcttatatggataaaggtcagtgtcaccctggaaaaccacacatgtcggccggtcacggtggctcatgcctgtaatcccagcactttgagaggctgaagcaggtggattatctgaggccaggagttcaagactagcctggccaacaaggtgaaaccccgtctctactaaaaatgcaaaacttagcctggcgtggtggcgggcgcctataatcccagctgctcggaaggctgaggcaggagaatcccttgagcctgggaggtggaggttgcagtgagccaggatcgcaccactgcatttcagcctgggcgacagagcaagactccatctccaaaaaaaaaaaaagaaaaccacacatttcatggggctggagtgacactagggcctctccctccatcagtattccttcccagttacctgagatggtctctgctggctttgttcctctcccatcccacaatgccaggaagctacacctaaggcggggtttggtaggggggtgaacagtggaagcaggcatcccagagccaagtcagtgacctgtaagcagcttggatgcagccctggtctacccaagtgtaggctgggaggagagcatttattcttccttacccttactatagtgagctcaaaaggtgtaagtcattgagacaaacatttgctaggtatttccaccatctaacacttttatttatttatttttttaaagagacggggtcttgctctgtcttccaggctggagtgtggtggtgtgatcatagctcactgtaacctcagactcccgggcttaagggatccactggcctcagccctcagcttctgaagtagccaggattataagcgtgtgccaccatgcctggctaatttttttttttagttttttagagatggggtcttgctgtgttgcccaggctggtcttaaacccctggcctcaagtgatcctcacatctcagcctcctaagtacctgggattacaggaaggaatctattccttgaactatctattagtgcatgagctttcaatggcatctttttgtttatcaaaatcttaactcccttacatcgtataagaaaggaaacttacaaagcaaaattcagacgaggcttagaaatacaagctcagctgtaaatgcttagtaataagcatcactttagtcctcacttgttagtcactcatttgctcagcaaaggcaccagggataccacatcttgcctccacggagcttacagattagttggggttggggagcaggttggacacatgattgttagacacatacactcaggaatctgacagacctgctggttcaaatgccggttctactacttgtttgccatgtgaccaggagcaacttactgaacttacgtatcactttccttatctgtaaaatcaggataataactggacctcccttatgggtttggtgttcacattccacgagataatcatgtacagtccttagcacagtttcaataaataatattgattttacttgggctggtagacttttttcttttttttaaagacaccaggtcctagtatcccagtttcccaggtagaatatggtgggaattcgcagatgggatcgtagtgcactacagccatgaactcctggattcaagggatcctcctgcctcagccttccaagtcgctggcactacacgggcatgtgccaccacgcctggctcagcctttttaatttttattttgtcttctttggcacacagattctagtgatttcttctcagttatttagcagcacccatcaacatagtaactgcccaaaaagtttggaaaccacagccaacagttacatggttttctcttgtatgccaagctgaggatagctggtctcagagtaaactgcatttataagaacaatgccaagaagaaagagaaggttagactattagaactgatggcgtggctgcctgggtcaagcactttggcaggtacacgcttttgtagtttgttttcttagtagagccggctactacagtgggcagtgttcgcctccacactgggtgctgcggcaagagcgccaagataagctctcagtgtgggagggccgcccatgtgctgaagctctgcatccttgggttttgtgttttatttttgccccaggctgggcaactgtagacatgttgttggagtttgttgacagagaattctgttggcaatccttgtgaatttgtagtactttaaaagtttcttaagttcagtccatctagacagtgagtctctgctagactgaacacagggttcagaggacccagtttgcctaaacctagtcctgacaatgaagaataaccagagacaaagtaaatttcaaggctgcaaaaatgcagcgtcttcaaattctgggcactattttttttttttttttttttgagatggagtctcactctgtcgcccaggctggagtgcagtggcgtgatctcggctcactgcaacctccgcccccttggctcaagcgattctcctgcctcagcgtcctgagtagctgggattacaggcgcctgccaccgcgcctggctaatttgtgggcactaattttaaggaatatattaatgtgcagttaaggagtattttttattttttattttttattttttaaaacccagacacgccatgcagacttgtgtcaccaaaataaatactggaagaatggaatatcttttggaaaagagacatttatttttcattaacagcctgaatactttccagtaacaaagaaatgaaattatttataaaagctagtaaaagcagttgtaatcacctgatgttaaaactagtatgtactagttttctttttatctcaagagtcttataaaaataagctaatattcagggtttttgaatataagatactagttttcagagtgctaagagtaatattaatttatgagacatgaggcttgatattatggtaaatttgcttaaatggattgaatattcactttgtcatgatggattttctagtaattagtccttagaacactgtaaccaaaggtcacaaaatatttttgtaatcagtgattatgtgttacataagtacatgaaccaggaataggtggtaaaaggtataagaaaaagtgctttgacaaaactacatgtcatcaacaaagccaagaatccagtgtgtttaggttcctagatcttgcagtaaaactgaccacacagaagaaaaaaaaatcttgcctttatttgaaaacaatagttacaaatgggcttttctgtgtctgtttcctttttttaccttattgtttttttaaagatagaacttgctgtgtgaatagttgaaaatctcacattatcacattagtgtttgtcagcactccctaatacgtttaggtacttttttttttttttttttttgaggctagaatctcgctcttgttgcccaggctggagtgcaatggcgcaatctcggctcactgcaacctctgcctcctgggttcaagtgactcccctgcctcagactcccgagtagctgggattataggcacccaccaccatgcccagctagtttttgtattttcagtagagatgaggtttcaccatgttggccaggtggtctcgaactcctgacttcaggtgatccacccgccttggcctctgaaagtttgggattacaggtgtgagccactgcgcctggccttaggtgtttttttaaaaagtatattcaaaacaaatcagaaatttcttgcaaagaaaggtaaatgggtttaccatcggctcactgaaccaagtcttgtgctttgctttcccttggttccttagaggaaatgtagatttaaaaaatacgtaggtttgaaatttttttatatttgagttttttaaaagatggggtctcactatgttgtctaggctggtcttgaactcctgggcccaagatgctcccaagaggcgggtctacaggagcatgcttactgcacttggaaatgtagattcttgtcactaaaatcataaattcatttcttcattatgtttgtagtctgtggttaacagacttttaattaaaggcagttcttactgcttgaggcttctgggttgacagtggatggtcccccgggaggaaggttagtggagggacccagggctcccccagcgcataggagaaacacatttgcatttgcactgaatccagcttctcctgcgacaagtgtgtgggtgatgtagccttgtctctttccccactgcttatggctaatccagaggtttattggatgggcctgggaagtatgctctgatccctttgtgggtccaggcgatgatgctgtgtggggagcctgaaaccacagggcaggttgacgggttggggcagcaggaaagggctgaggccccacgggccgacagagaacctcccttcttttctttgacttcatgacttagatagcttgtctttttttttgcctgagaagatttattattttacattcctatatcttgttttggtagaatttaagagagagtgtgtatgtgctcttctcagagtcatcctattttataggcaaactcagactgtcacagtgaacccaatcaggaggaggtcttcttcaaggatgtctctggtaagaaacaaggaaaatatgattgcttttttattttagtgatgtttttcctgaataaaatatgctttcaatgctgttaattttgagtttgaaccataaaagtgtattgatatttcatcatttttaaccaaagaaatggtaattttttcccataggtccaacctaatatttatattattatattatacatatttgaatattaggtctgaccttaatattaagaacttagactattggccaagagtaatcctaagttggtatatatttaaaatactagatgcctttaataagattgactataatacctataagcttcttatgttgaaatgtttctacaaggaaatgtgtatctattgcttcttgctcttagctttttagatgcagattttctggtggagcctaatgtccttggtatcagtcatagggcttgacattgccatttggggaaacagaaatgctagatatgttaagaactactgtgtcttcatgtttattttccatatataatatatttaattcctttagaagtttttttaacagaaagaatccagtggataataactttacctgtattacataagcaatgtgtttcaaccctgtgtcaaactctccatttcttagcctaaaccccagccctacgtgatgcctcccccaccgcagttgcactataatggacattatacagaaccatatgcttcttcccaaggtaaagtacactgtttctgccatgccttacatagttatgactatggataaatctgtgaatgcttggagatcatgaagcctggacagtttttggctgaagttgcaccccaaattgcatcatgataatagctatcctggattcataaaagaagccaatatattgttttttgtttgtttgtttgtttttttggagacagagtctcaatgtgtcacccaggctagagtgcagtggcgtgtctcagctcactgcaacatccacctcctagattcaagcaattcttgtgcctcagcttcccaagtagctgggactacaggcacgccaccacgcctggctaatttttgtattttttagtagacatggggtttcaccatgttggccagactggtctcaaactcctgacctcagatgatccaggtatatttgggttcttgaatgtatgtaaaaacatgcagtatcaaattttgatgctccactggtctcaaatttggccaatgggaaactatcaagctggttcctgtgtccttttaccaccaccctattagcctttaagtgcttctttgctatctgacaaagaattcccagggttacttttctttccctgccagaggctttcctattgtaaaagttaaacacatgactactgcagttttcacatgagaagtataaggaattgtatttataacaaacccccaagctgaagtttaagcagtcaattaacatttactctatactctctctgtgtggggctataccaaatgctaaggaggtttatgcagatgagtatttccacatcttaagaagtttatcttcagcctggaccacagggccagaccctgtctctaccaaaaaaaaaaaaaaaaaatagctgggcgtagtggtatgcacctccagtcccagctactcaggaggctgaggtaggaggattgcttaagcccaaggtgggggtggaggttgcagtgagccaagattttgtgctactgcactccagcctggatgacagagggagactatctcaaaaaaaaaaaaaacaccttagaatctaatagtttaagataagacaagtgcacaaataactttgtctttctcccctgaacccctttttcgtggagaatggggtcttgctatattgctcagggtggtctcaatctcctgggcccaagctatcctcctgcctctgcctttctaagtgctgggattataggcctgagccaccactcctggcacaaataacttgaatatgatagtttttctgagacagcatgtgcaattaccatgctcctcagtggaagagagactcatcacattggggagattgagaagaactttctgtatctgaaaagatgggtggatttcagcaggtagaaaggcaggaacttgactggggttgctgttcctagttttggggatagtgaacgccaggcacagaatgaagcagggtgtgtttggagagtagagtggtccaggtttcctctcgggtaaggaactggtagggagtgatgcatgaagggaccagaaggtgggatgtgactgtattgtttgtgtcggccctggtgtaaaagatgagggttttcatgcagtgaggtgggtagtagagagcagggctttgggtgtagagcctgagagcatccccctcaccatgttcttgtatttcctccctcttgcaccctgcccttgtctggtatttgcaatcccggcccctcccacttccaggacctggctgtcctctgcattgttagtctcactttgccactcattctcttccctctgtctataaacatcttaatattgttcattctcctccctttaagtaatggtttgagtgatctgctttcttttctcactgacttttttttttttttttttggagacggagtctcactctgttgcccaggctggagtgaagtggcgcgatctcggctcactgcaagccctgcctcctgggttcacgccattctcctgcctcagcctcctgagtagctgggactacaggcacccgccaccacgcccggctaattttttgtatttttagtagagacggggtttcaccgtgttagccaggatggtcttgatctcctgacctcgtaatccgcctgccttggccttccaaagtggggattacaggtgtgagccactgtgcccagccctttctcactgacttataagagtactctctgtgtgctgcttctgcttgctggttacccgcccactcctctgtctttgccactctgttaaagcggccctctgggagcctcccagcacccccacatcccctcaccatcacattcaagcctttgtaccttctggaaactctcctggcatgctaggtttttccctcctccttcccatcagtattgtttggtgagctctgcaggtctgtcctgtggctttttccctccctctgtgagcttcccagggatctcatctacatttaacatttcttttcttttcttttcttttcttttgagatggagtttcgcttttgttgtccaggctagagtgcaatggcatgattttagctcactgccacctctgcctcctgggttcaagcctcagcctcccaagtagctgggattacaggcatgcgccaccacgcccagctaattttgtatttttagtagagatggggtctctccgtgttggtcaggctggtctcaaactcccgaccttgggtgatctgcccaccttggcctcccaaagtgctagtgttacaggtgtgagccactgcacacggctgtgtgcaggatcattcttttgcctggtgttcgagactccacacaatattccctgagcctgcccttccaaccttacttcccaagttattttactcctctgtagctatctgacactctagccaccccagcttgcccaggggtgcaccctggctttgccagtgccgctctgcaccctcaggtgcccttaccccatgcacccttccgttcacatgctgccatgcagaccggataggcagggctatgctgtgctgacaaaatactccattccaaactctcagggaagtaataataaaggtcacctgtccgttgcacactgtactagcaggagggctctgccctgtctgagtctgccgtaggggcttgagctggagaggctcttctctctggaatgttgttggtcagtgttgcagttggaagagagcctggaagctggcttttaaccctctgtgcactttcccttgaccattactagtcgcattgttgtgcctgatatcaaggggtgaggaggggtaaccctgcgtgctctgagaggtggagagacctcacttctgatggaagctggacacgcccaccccacccacttacccctcaagtccccttaactgccatatcttgtgaggtggttcttggttctctcttccttgtccccatcaacccaactcaggctggaaatgagcatttcttcctctggactcctgtaacccttcatctcttctcccttccttgaattatggtgatttcatgcatacctttccccttttcttgcctgtattccaaccatcttttcctccttctattcttagtattgccttttccacataacagtctcataaatggctagatggtttgtggggtgcagaagcagggagactaggtgtatatagagctagttcagacaagctggggtaggggcccgagctgtggcagcagtgaggaaagggggattgcagagatggagccatgaccaagctttgcataaatgaggaaagcacagtgacatggaagtgctgtgtgtcagcagaagaataccatggagatttgagtgctatttcctcacagctgcatgtgccaccagaataaagtgtacccactggattgtggtgtattacttaagtatcaccatgatcacataaatcaccatggagctttcgaagcacaaaaagaatgcctttcagaggaaattgttatttgaaggagttggctgctgagtgttagaaatcatctagggttagaaatcatcctcagtaacagagggcaggtgagctacaaattgactagaagaaacatggcccctgtcatccctgggcagggacacatgcatagctattttaagattaggttaaactgattctgttagctgcaggtctggatcttcctgaaacatgggggccagggcagggggcagctgcagctgtttaatgtggctcctcttggcttctggacactttatgggctgtgtggctgctggtgacactgttggaccagagaagttcagatcctgctataccattacccttttacagtcgaagctctcatattcatttgggaagaacaataaaaatttccagttaaggaaatgcttacagacagttggtgcttgaactagctcagcagcagcaaggccacatccctacccagggaagaaaggcagagtccccagcccagtgccttgaatggtatctctgcctcaacttccccagagttccaaaaagtctgctagtctgctgtgggtgtggttcgtttaagacagggtctcactttgtcacccaatgaatgccaccccttaagtaggcagagccatgcccatcctatagatgaggaagccgaagctcccagggtcactcagatagtgtggctaaagctaggtcattctagcggggatttttacaagctgtgttaaaaatgtcatcagaggtaagggccgatctcagtatttggttggagtaattagtccatttaaaaaaatctcattttgaactcattttttctagataacctctttgtgcccaaccagaacggatactactgtcactctcagacaagcttggatagagcccagattgacctcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctaggggtaagccacgcggcgagcagtgccgggccaggggaccgcgcgttcgccctggcgcttctttcactcatcacgtcccgtgtttttcagctcctcttgttcttttaacgttcttcattcccccacgtcactctctttttgtctaattctgaacacatttaaatttatggaaatcatggggatccacttgaattttagtggttttactggagataattattatagatgaagtgaaaaggtaaattcacagggttttgtcgaaatggaaaagatgaatgaaatgttttagtaatgcactgttaagggaaagacagttaagatttcattactttagccacgattgctttagccacccattaaaaatactgtgggtgatgtggcaccccaggggtgcatttgtttagtttgctcaagagatatctgaaaaaagcatccaggaaagtgtacccaatcctaatataattctccaggttggagtgtgtgtggatacagcttacatatcttggccgtgattctccagagtgattctggagttgggaaggtggcactttgttaaggcaaatcctgagacgtccaggtttcttaaatttaaaagaaagatgaattcagctgagaatctaaggaaagtccccggtagaagatgcagttctttaatattcagcctaataaataaatatgaattaagcactttttacctactttgaagcaaaatataaaaaagcatagtagcatcatctctagctaccatccttggagcatttgccatgggccaagcatttcctctacttttgtggcctatttacagtaagcctattgttatgcctgttttacagatgaagaaacagacttagatattaactaacttttccaaggtcacatgactagtgagtgactgaactggaattttaaacccatacttagaagcccattctgttatcatctacactgtagatgtatgttctgcattgaagtatactgtatatgttctattaagtcataattgcttgttgaagccttgctagtctttcactgaaacttttaaactcagtccttaacctgggactaagcatctgcggccttgtcatgaagtgtgtccaccgaagtgattttgttgcagtgctcaggcttccagctcttcctggcccacatctccactcctcatgccctgcacttgagccaggctaacttgattagggcctccatcctatctcctgttggcttccagtgtcctggcaactagggttctcctccccccatcgctgctaaactgcaaactccgacaggacggctcatctcaagtgtggttctggcctagtgtatgacatcctttaagatgctgcaaacatcttgctaaacaggaaaaaacgcacactattatagtacttatgaaagagattaatgtacatagacaaaaactacttaacaaaaaaagtaccacagatttaaatttgctttttttttttttttttttttttttagaacagtcttgccctgttgcccaggctggagtgcagtggtgtgatctcagttcactgcaacctctgcctcctgggttcaagcgattcccctgccttgtgatctggctgcctcagcctcccaaagtgctgggattacaggtgtgagccaccacacctggcctaaatttgctttcttttaataagttttgggtttgaattttaagttgatttttaaatttttcacaagtatgcaacataactcacatccctgaacagtaaaggccaatgccttcagtggacacagatttaagagtgtagggagcagtgattcaggataaggtgtgggtagattttccaaagtaactctacctgaatccctgagccagctggacagggtccttttatagttaacacccttcccattgcattaagaacggtctgtttttatgtgtgactcacgtactttccccaaatgctatctgagtacagctcagtactcaggcctattttatccctgtatgttttgaatggggtctggtaggttcagttaaatctgaggactttgatcaatttggttctcttaaaagaacttttctctcccattgacttttaagaccacaatactagtaaaattatgtgattggattatgtttttggtcctttttgcttaaaggattctacttaaggaatgggtatggcagctgtggtcacgaggaaagagcaaaggtcctacaagttaagaacgttggggctgagtctagagcctgccatttgttagttctctgtgaccacggtcaggacccttcatgcgtcagaacctcagcttccacatcagataacctcagatcatgaggacggtcatcccttcgctgcctgcttcgtggcattatgtcccacatgcagttaggcatgaaaaaatgcctcctgaattacatgattcagtgtaactgattttaaccaaagatttgcttttatttgttttgacactgattaccttgtaaaagaggcagccatgtgacctcagacaagctatttaatctgtgactcagtttttacatttgtaaatgagaggaccccagagagttgttggggggataaaaatgaggttctggcacattgaaagagattagtcaatattaacattactgtgaggtggcatcatatatttaacttaatggctttcaagagtggaagaggccaattccctattgtaccctctgacctttcatagtaacatggggttgccattatcttaatcgttacaacaaatttcctaatgtgaattaaggttatggaggtttagtattaaaaacagtgaaataaactgtagacaagtaggaatgattttagaattctccacccatctccacctccagcaacctgattgttatcttaaaggcagactggtttgggtgctcatatatctacataaagattttctttttgttgtaccctttagtgcagtggttctcacataagaaatcactgtgcagggtatgcattaaaatcctgtgcttatattctaagggctaattaaggcatattcaaggctagttttgactacatacaacattcttccaatactggcttttgaactgacctcacagccaatcagctttatccagcgtgtcccagtgtgggatattttgagtcattttcaggcagagaagtgccagagctagttcatattgactagcaagagccgacttaaatgttcaggaaccttgtgagccaattgatgtgacattaacagtttgaaattggctgtgatgggagtatttacaccatggatatgggcaaacaccgatcaaaacttccttccaagagcctgttgttaaatattaccagcacatcactgttttctgcacgttagaatcattaaatttcagcctaagcaggaagtgtttagtctgtatgcctgtgtctggatatatctgtctctttctgtctaggtgaggcttacagaggaaaggtgacttgcctgaaagaagttggtcagttagaggccagatgtgaacccaggcctctgctgtttatagtctagactgcattatgtggggagctcatgatcaaatattaattataaaattaaaaattaatccacttagcttattgagttaggtaccaatcacagtctccaattacagcagcaatcttttaggatttttttcctctctcaccaagttgccttttccctctgttcttgcaccattatcatggggcttcatggcctgttacaggctgagagagctggaataacacggattttgtttacagggcagaaccattattttccagttggggctactcattatattgatatcatccaaggaagtgtagtatatccaacgaaacttagtgttctttttttttttggagacggagtctcactctgcctccaggctggagtgcagtggcacgatctcagctcactgtaatctccacctcccaggttcaagcctttctcctgcctcagcctcccgagtagctgggattacaggcatgtgccaccacgcccagctaatttttgtatttttagtagagacggggtttcaccatattggccaggatggtctcaatctcctgacctcggcctcccaaagtgctaggattacaggcgtgatcccccgcacctggtcaacttagtgttcttatgcttactattctcagagaggaaaatcatgctctaataataattttaggaaacacttgatttcaggagacaagattttgttgatgctttctcttctgtcctatcctcctggtgtcatgatggagattttagccctgttttattttccttgtttaaaaacgtagccgttctgagaggtagcgtgatctaacccgggtcatctaagtctgcactagaatgcagagtagcatatgaggagggggcttaacacacaaagggggctgctgcagaaaccatttaatttttcagaatgacttaaagaatttatatattttaaaaattataaaaagctgtccgggcatggtggcacacgcctgtaatctcaagcactttgggaggccaacactgcttaagttcagttgtttgagaccagcctgggcaacatagtgagaccccatctctacaaaacacacaaagattagttgggcatggtggcatgtgctggtagtcccaggtactcgggaggttcaggtgggattgcttgagactggaggttgaggctgcagtgagctatgatggtgcccctgcattccatccagcctgggtgacagagtgagaccctcaaaaaaaaaatttataaaagcttactatagtcaattgattgcatttaaagcttttgttttttttttttttttttttttttggacttcagctgatttgttacgtctgtcttgttttaaaaggaatgcagtctgcctggagcctcacctttcattacaacagaactttgtaaccaatagtgtttcaaaaccttctatctggaagactttatcagggctttggccttgaaaggaatgtcttcctactaatgtttgttaaacaagtggtgtgtgaaggagtgtaatctttctgggtttattggcaaaggagaacactccctctgtgtgttcctggtcttcagtgcattgaaacttcttttcacaggggttgtatttgtgtatatttcatatatacatataaatccttttacagggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaagggtatgtatgggacacacagggctttgtgccttctctggaacaaccggtaaatactacgcaaatgccttcatgagattttggtgaattttctaacacaatttaataataaatgagtgttaaggaattttgtaatatgggcctcaaaattggggcaaatgtatagctaatgtcttaatagataatttcaggttcgaatgctgattttttgtttgtttgtttctcagtgttcttttttaccttctcctggccttttggagcagtcttgattttgatggccttaaagtgagaagaaatctacaaaaatacaggagcatacaggggaaaagcagcagacattgacttttattatactgaaagtttatctcgagagtagtttctcaatttttcaaaacttcctttgtgcctgaggtgtattttctatgaggttttattacatcaaaatcagataggcatacatttgctttacaacgggatcctggaggtagtttcgaatatttcctactgctttagtcttttatatatcgtatgacataaaatggaaacatttgttcatagctgttggaactcattatccgtcccctagatttacttactgttccccaggagaattccatctattaggggtcacaaaattgaccacagatctagagaaaatgaattcaacaaatttctttaggccaattttcaactttaaacaaaagtttgcattatatttctcaccaaaatgattgtcttttgttcttttaactcttgttgttgtggctttttaaaattttaacttcattttcacctagaattttgtttctgttttggttttggtttggtttttttgagataggttctcatggttcactgcagcctcaacctcctgggctcaagcaatcctcctgcctcatcctcccaagtagatgggaccacaggcatgcactaccacacctggctcgttttttaattttttgcagagacggggtctcactgtgtttctcaggctggtcctgaactcctaggctcaagtgatcctccctccttggcctcccaaagtgcagggattacaggcatgagacaccgtgcccaacctagaattttcaatattatacagtgctagatttgaagcagaaaacaagatttcaaatatacagtcaaaaggtagccacgacgtgtggctgtattcatgttattacacatattctgttttatagtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgtgagagtggagttggtcccaactaaagaaaacaacactggttacatcaacgcatcacatattaaggtgagaggaacgcctcaagtaatcaacagcacatgcagtttcagttaagttacaagaatggtaagaattgtattcatgtctgtttagaattcagatattttaaaatttatttttattgtattgttttagataaacaccctagttttaaacatttgtgacaaactgtactgcaagctgggaaatccacataccagtgctagataaaaagcgtctatcagacagagccaaagtcatgtctactctccatgtgcgaaaccactctgcccccaacactgttaccaggactcagggcgcacttatttgcccggcttttttttttttcttttgccttttttgagatagagtcttgctctgtcgcccagacaggtggagtgcagtggtatgatcatggctccctacagccttgaccttgtgttgcctggctttagaactttgtccttctaaatctgaagacctctttttagctcataaattctgggagccactgaattgctagtttttcctcatcacatactgacatgcatttttatgtaacaaaagtgtctgggctttttgatggtgttcacaaaagctttcaacttaccaaggtgccatctgttctctttacatactctttataataatttttaagtatcatttttttctttgaagaagtgcttttttcctggaaccagtataatgccattaaactggggtaatgtttatggtgagagatagggggtccagttttacttttctgcttatggatatccagtcttcccagtcccatgtatttaagaggctgtccttccctagtgtatgttcttggcaccttatctggggtaatatcactcctatgaaaatggacaaaatgatgattcacaacacatgatggaataaagccagatgttccctcttcctcattgtaccctttgttcatgctggccacattcaattctttattttgggaaggagaaatctcatggtgagtgaatgagtaactgtggacaggtggtggtttttttctttagtttgcaagtattatttgagaagggaacaagctgacaccaaggctttctggagactggcagtctgcctgtgaatgccagtaccccttgatggcttttgggaatctatgcacatactattttgtttttaaatataatatcagcataatttacttaaaaaccgagcatttccttgaaataactcatccagtctctcatgactagatggataagaatgaatgatactgtagttctgtagtgatatttcaaaatcttcagcagccacttgcagaatagaggaaagaatttgatagacctgggtctgacgcctagatctaaaatgaggtgggacctcactttataagctgtgttgtgggacctcatctcacttacatggaaataaataaatgatgacacctaccctgccagcttctcactagtcccctcctcctccctagtgtttattcactgttataacctggtactcatccacagtggcagccactgggtgctcagtgagacgatgtggagcggtgactagggggctggcagccctgagtgagagtgcgtgtggcacaaggcttggcactgggttttacgtttagtgagtgtttggagacagttattgtcgtcactcaatattggtgaagccaagatttaacccaggtctcttaaccacaaatctagtaattactgttgtattagactgctctcaaggaagttaaatctgaagtggaaacttaatattattgtggagagtgaccttgactcagaagttcagaggtgagactatcttaagtaggaaggttttttttaaagaagaggcaccatgtctgcaataacagctacttattgagttatgtgccaggtaccatagatactgactcagtcctcacaatgaccctatgacggtaggcagtatctttattgtataaatgagaactgacattcagcaaggttaaacaggttgcatagatattatgtatattcacagtacctaagtttataaaaatgtcagtaatgcaaattgtattcacaagggaaaagatgaaaagtctttccttattctgctgaataatccagtttactacttttttactttttacttttttaaaaaaacttttttagtactaccatgaatgcatgcatacatacctatgtatattatacccacacatcaatttttttaaccttttctaatcccaggtctctgtcagtggaatcgaatgggattatattgccacacagggaccattacagaatacctgtcaagatttttggcagatggtatgggaacagggaattgcaattatagcaatggtgacagcagaagaggtaggtacttatttctcttaagtgattttctcagcctctgaagaacagttaatgttaatcatctggaatcctgacctgtggagaaaaaggcagggtagggttgtggttctgtttcagatgtgccgtctatgtgagaaaggcatccattgccggatctcgagtcatttaaccatgctcatctttaacaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatgtgagtgactttaactttgttccgaggacagctgcctctggaggtgttaaacagagaggaacatttatgtttccgaaatatttcctttatgttatctcatataagcttcggacttgttttaacataaagaatacaagtgttttggggagggttaacgaggtttataaattatgatttggtagtgagtagaatgccacagctgactcagtatctccgtcatttcattttgtagatcagaaagtggacagaggtagtgacttgctcagggtcacactgtccctttgtggttgggtttggttcactggcacccagtgctctttatctgcagtcctcttaatcagtggagagaatatgaagattgagtcaacaatgtgatacgccttgatccttgagtacttttctatttcattgattttccacagcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgatggcgcttatgatcacctggcctttttgggtggaaatgaggctggggaagagagggacatagtgacttaatagctctttttgcgcacatttccttggactgtggtggcctcaagatgttactaatgttccctgcaaaaggctgtgtcttcttggagagtctcagtaccaattagcatattaaagactaagaagtcatacgataaataaagctgtttaattttgttttacttgcccagggtttttcaaatttgagctcagaattctttttctgtttacatttcaaggatgattcatgctgcccagagcccttgagggaaatagctagatactgatagcacttagcacactatgtttttgtataattttggtatttagtgagacatggtaattatgtccaaccatacaaagtcagtgagctacacctggggaatgttgaagaaatagtctgcatggacattctatttatagctaaaactaatcagaaaatcagaagtaggcaatcatggcttatttctagaagacgctaaggtggaaaagagactgtccatctcccaaccaggtttctgccaggacactcgtgtcctcccatcctttctgtctccctaggggaacacattatcttcattaccgtttctctcaacctaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatcttaaactaatttttgataatggagtttttattttatgacaaatatttagggatttttctagtgagaaacaactttgtgtaaggatgatccacagatatgagttgctcctatataactttgtatttaaaaatcatgttattatcttttgttattttttaaaaaccttgggtacttaataatggtttagttgccaaactgaaaactatactgagaatctgtgttattttgaaacatcaaaaggatttttctatccagaacattttttatcctaaaaattctatatagttgtaccttctgtttttcaaatgagagctcaattcatttagatactgaaatgagtcagttaatgtaaagttgaggatgaaggcacattatttaaaatgtaagagaataagcattattttttcagtattattcatagatctaaatgaatttgattttattggttgaaaatgaagtgaaaaacaattgcctagggtggttttaagcacttttttgttaaaaacaaatctgagttttaatatatgtgttgctttgtagatgacacaataacaatgggcgctgagaagcgttttgggagagattaaggactaagagtatgtaagatgactaggacaagagtaggtggagtgtgatggtaaatgcaggatgccttcgtctttacaaaaatgcagtattatctatactcagactgaggtgctgggatggcgagcaggggaccccacagcactgtccccagggaattcaagtcctgtgaccgccagtgacttactccgtttccttggggcttttcccacctcaacctgtattgtttctttttcataaataaattcagcattatagtatcattaaaagaagccttaaagaggcgtatttttccttttggttgaaggaagggaatagttaataatagttttcacctcttctcccaaaaagtacagtccaaatttgtgcacagagattgctgtggtattcaagaggtacttgcattttagctccttaattccctggccagtgttagctgtttagtgccccctcacccatcccatttaggcacatcccaatagacagagccaggctgagttacagggggagagtgtcatctctggccccgattaagatggccttgtcacagtgaccgctgagtaggcatggatgagtgggatatttagctgaggaaccctttcccttttccttctttttggggtctcttcttacagtgaacttccaaaatgtcaaatctagggctgtttcccaaattacactattctaggcatcattttgattcccatgtcactccttaactcacttccttgagcactacatgtatgttgtcagccacgagacaggacttcctaaatagtgtgtgcaccagcctaactctgccttacccagaaaccaaccacctaagaggaaaactcagaagatattaatgaaaactaattgaaagtacgcacacttctcatgtaggaacaaaattaaaattttacatttttattttacaaaattaaaaaattacattttgtaggaacaaaatgtaaattttgtaaatacaaaattctttttaaagtcctgtttaaagaacagtagaactaagtgaaaatattcagaacgagctccttagaagaaaggaataagaactttttactggaactattttccatctctagaaaaagtgcttcttcccctccccctccctctccatggtacgtttttgtgaaaatgcttttctgtcaggtttaaacaaacagtttgacatagctcgttgacaagaacatattgtaaaacaaatctaattaaagagtaatatgtggtctatttgtgttcctgttgtaataatttgataagtaaacttctgaggg

SEQ ID NO: 13035 - DNA, 144596 bp, Human; identical to SEQ ID NO: 11749
  misc_feature (1)...(144596): n = A,T,C or G

SEQ ID NO: 13036 - DNA, 27223 bp, Human
aaagtcagttgaatgagaaattgaaagtacctctgattggtcccttcctgcaaccaatcaggctggtggcaggccaagttttcatttgtataggagtgtaactttgtaacttcacttcagcctctgattggtcactttctgcaaccaatcagactgaccatggaccactacttcatttgcatggggtatacaccaagtggctaatgggaaacctctaccgggtatttagaccccagaaaattctgtaaccaagctcttgagctgcttgctcaggcctgctctcaccttgtggagtatacttttgaaaccgcctttgcaaaaatcataactgaggaaattatgacagtgaaagagatcagacctaacctaccctatcttccttctaacttctaaaatgtctttgttcattcctgggtataggccaaactagccttgggaaagaatttatagtgtaaactctgagacaaaattgataacagccctttccccttcttgctgggaccagtctgcctttctttgtaggtgtaacaaattagctacaagattataaattacagtttaggggccatgcagcctctggctgcaagaatctgaacctccccaaattgcttctgggaataacatcaccattgcaaatcctaagatcagtgcttgagatattttgcagaccctgcattctcatgcagcagaggacaccacccagactgataatctggctcaactagctccacgatcccacccaggaagaactcgcaagaactcacttcgaccccgtgatttaatcttcatcccgaccaactagcactccccactttccgaacccatacctgccaaattatccttaaaaactctgattccagaatgctcagggagactgatttgagtgataatgaaactctggtctcccgcacagcgctcagcgtgaattattctttcgccattgcaattcccgtcttcataaatcagctctgtctaggcagcggacaaggtgaacccattgggcggttacactttcgttttcaatacatctctgcttttattgcttcattctttctttgctttgtgcatttcgtccagttcttagttcaagacgctaagaacttggacaccctccacgggtaacaggactacaggtgcccgccaccacgtctagctaattttttgtatttttagtagagatggggttttgctatgttgctcaggctggtctcgaaccactgggctcaagcaatctgccggccttggcctcccaaagtgccgggattaaaggcgtgagccaccgcgcctggcccactaaacttctctgtgcatcagttatttcatttgcctaatgaggataacagtagtcactactgcgttttgtgagcgttggttaatatatgaaaaatgccacgtgtttgccattagcatcaatcatgccataaccagaaaaattacattgcattttttattttaaaaaaggtgggggccagagtggacctgggcctcttccaacttctgagaggtctctattactaagtaagccttaagaagcagaattccatgaagggagctaggaaaccaggattttccaaaaggaggtggcatttgcattgatcctggtagggcagcctcgaattccacggggttggggttgcgccttttccaaggcagccctgggtttgcgcagggacgcggctgctctgggcgtggttccgggaaacgcagcggcgccgaccctgggtctcgcacattcttcacgtccgttcgcagcgtcacccggatcttcgccgctacccttgtgggccccccggcgacgcttcctgctccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgaggtaattctgcacgtttgcccgcgtgctctctgtgctctgtcgcaaacctctttggccggagccgacttgttctctcgtctgctctaagttcttttagcttttggctgggccccaggggtcctaggcttggagggcgaggctgctcacgggtttggtggtttctagccgcattttccccagcccagaaagcacccgaagtcacccttcggggatggatcccactgaggaagggctgagattgccgctgggacccattttgtcctttttcctattggtgaaatgcagttccgttgcctccagctcccagtcggcgagatgggacttaatgcttatcctgcaaatctctaggcttcaaggaagggaccttgaaaggtcattttactttcccttcccccacgctcctagaccgtcgcagccaaatgagaaacggcccacatctcacaggttcctgcacaaaaggatatttttccaagaggatgttgatttaacttcaggagtagacccccccgccccccgccactaaagaattggggtgggagggtagggcggggcgaactggaggaggccctgcagagcttacgtaacaggcgtctgctgccctgcagcgcggtatcgttggactcttgggcacaggatttgcatcaggattgtgacatactaggtaatggtagagcagggtgtggctgctcatacttgctggcctccaatctcatccccacgtgtggctagaaaagtagaattttaaaattgggggaagtttcctcgtgcactttgggtctcttactctgcgcatgtggatctctagtcacttgccaacacggtttctctcttatctgccagaattgttggtagagtgggcagcttttacatttatcctttttgtcacgtgtgatatatttgtgcataccaggagcaaggtgcaggaggatgagtcggtatgtaactgatggacttgactgttcatataccttaacaggatccaagagtggtgtttttgaggggtcataaaggtttctgttgatagcattttgcaaccttgacctttttgggaagtggttgattgatgggtaggtatttatttggctggtgtaatctagccccttttccaatttgggctggttcaaatgagggcttgtgttggatattaacagacacgtaagtcagtaggagatctccctttactctaactttaaacatatgaggacacgtttgagttagggaactgtatgggtaccctaaaaggacatgtagctctcctcttctctctaatttcactttggtcaatatttttgcaggtaaccgctgccctgctgtggagatagaagaacccaataatttatgtccatgaaaaatacctggtttccacatttccccaaatgacataggcctttgtaatctggacaaagtaggagtcacagccatgttagtactagaggagtgccctttctggccctcatacaatcctaaaaaaaggggatagaccctgtaaaaaacaggacaggtggacattggcatgcaactagcttttaggttttaattagttccttgcatctcccctgtgttcgacgctgattcttccagatgcatggaccaactaacagacaaggagtgggacattatgctgataaccttcctgtaattgcagtcttgggctttatttcctctctctctagggaaactggcttgaggaagctagctgggggcgggattggaggagctgcttaacttttctccctctggacctaataaagtttcatttagcacacgctaacccaaagccttgaaatgattggctagtcctgttttgctgatggaaaatgacctgttcagggttactgaactaccaagttggtggcagagctaggagtagaatttaggtctccttggctatcaactagatcctctgaatattcgagacaatgaccaaggatacgttgaaatagaactttctcccgtaacctggataccttctacttatttaggctgaggacaggaagttacatggttccctgattattaatgtatttcttttgaacagagagtcacattgtaggcctacttttttggaggtgcttaggcagccatgtggtgtcagctcaattcctttttgtttcaacgtggtggttgctggcggtgtttccggaatggggcttcctgagtagtggctgcctcatttgtcgtctttgtcctgcagaagtgaactatggtatttgctgactcttctggtccactggtttggattgccaagggaaattgatttgttgaggtaacatgggatagccagaaacctctgacttgttaattaccaggttccatcttagttttttaggactccgcagttgactttacagcctctttgaatacacttctgcttatttttgtggtaatttcctttctttctctcataggttgccagtcatcctttgcctgcttgtaaagcacttcctttttgcttgctcctgcctttttttttaaaccttactggttttctccaacttgtaacttgtaaagaaactgctttgatgtagtgggaagagaaacaggaaaaaattgagagcagagaaaaagtcactaagacacccacaatatcccagttttccatctggggcagtgaagcattgatggacatggttcctttgagagtttttaatggaactggacctgggacctgagatttcaggtgatagagacttgatattcttattccagctaaatcagtatattttttaatgttttattttgaaataaagattcatgggaggttacaaagttagagaggtcttgtgttcaacccattttcccccaatggatgcatcttacctaattatagaacaatatcaaaagtaggaaattgacattggtataaagtgtgtatggttctatgccattttattacgtgcgtagatttgtgtaaccgccaccacaatcaagatacagaactattagatcaccaccaagatctccttcatgctacctctttataataataaccaccccccttcctgactcctggtaactactgatctgtccactgtttctaaaattttgtcacttcaaaaatactatacagattgaatcacatggtatataaccttttgggattaacttttttcacttagcataatgtcctcaaaatttatccacattgtcacatgtatcaaaagttcatacctgtgtattgctgagtagtattccatggtgtggttgtattatagtttgtttaactatcattgaaggatattagggttgtttctgatttggggctattacaaatacagctgctgtgaacatttgtatacaagtcttggtatggacatacgctgtcatttttcatgggtaaacacctaggagtggaattgctgggccacgtccttttgaggtatccccagactgttttccaaggtggctgcagcatttcacatttctaccagcagtatttgagtaatcagtttctctgcttcattaccagctattttagttatttttcgttctgatggatatgtagtaataactgactttgtgcctgaagcaaagctcaggggtgttataaggaaacgaaaaaaaaaaaaaagaaaattgtgcatattttatgtaaaatggaacaagtagaatctgtaggcaagagcagttcctgtgttggagtcctctgaggagaagctaaaagcagagctgttgtgagtgtaggagataaggggaggtaatccagagggcattgaggagagagtatcaaccaagtctaattcattagtaagctgacaccatggcagcttggatagatgagacagtttcttaggtgtctctgtccaaagatattcctccctgtaagggttgggggtagagagtagcactgcaagaagtggcttgtgcccatccttttgccattagtccttttgagcataggccttctgggaggttgcatgggggaaaatgacccatggtaatgggatattctctcttctttggaatgtactttaaggctggcaggctccttgttcaggatatttaaagaagacagagaatcaagtggcctgaaacaaagtagagtgtatttctttcatcagaggcttactgcctttaattttgaagactttaaaacatgttttactatagaattatttttcctcagcctacctttggaaaggctgttcttcagtgaggtagattggagttcaggcctagtggatataggaaattggtggtcttctcagtatgtctgtaggagtttgtaattgccttagccttagagaggaaggggtatttaaaaaggcagaggaaaaagatggaggcttataatcaaggatagcagcagtcttcttgattaggtcatacttcactgtagtccctttgcaagtgatgttagctgtttttagtagtggttgatttacttgtcaaatcacagaattacattttggagaaacatataacaacaacacttttatggcatttactgtgtgtcaggtacacttctaagcactttacaaattgctgacttactaattctctcagtaactacgaggtagatactgtcatcccgatgagaaaaaaatcacttaaaaataatcatggcaggcacaactcttaaaccttaaaaatagctgccatacattattgttttcattcacattgaagtaggctgaggttccaaggagttcagaataattggttcttaagaatgataacatagtaatctgttgggtaagagatactgcagtacattattttcttgtgtcgtcttgattacttcccttctaatttgcctgtttgtcaggtgggctggggcacatgtcccaccctctcttctcaggctttttgaaagaggctgtcttatgttgtgtgtattgcttgaaggacccctagtcttaaggccccaggctttctccaaaaagaatgattttctcttagtgtgttttatttttattttaatttttttctcgagtcatgttagtttcacgaggacccagaaatagtatcaagggaattaggatcaagatgcattccttattattcctcacccctctagctgctacccggatactattgtgccaggcccagacagatatctttttaggtggaactagctttagcttcccagatcttcagggctagttcctgtgatttaagttaggttttttttttaaaattctttttaaagtatgaatacatacctaaaagggcacaaatcacaagttcaaagaattaccacaaaatgagcacatttgtatggtcactgaggttaagagatagaacattaccagaaccccaaagcctctggtgtcgttatcccagtcaccactcccgccatcctccccatgactaaccactattttgacttttaatgccactgattatttttaagatgagatttgaatttctgacttatttaactggttcattaaaaatgcatctcctagtctttgatggaacagtaagttgatcatggtcttgcatctttcttttttagagtcgacttcaatgttcctatgaagaacaaccagataacaaacaaccagaggtaaggtccctgctaatccttgggctgggtttaagatgtgtgtaggtacacaggatgaaatgtttttcctttcatattgtattatggaactgtagcaacttaaaacaaatgattttggctttctatcaacccactctctgatctgctttcttatttatgagaatatacaaatataagcaaaatcttaagaaagtgattccccttcccttgttttttgaaaattagaagaatttggagttcattttctttttttgagatagggtctcactctgtcacccagactggagtgtagtggtgtgatcacggttcactgcagccttaaccttctgggctcaagcagtcctctggcctcagcttcccgaggagctggaacaacaggtgcacaccactacacctggttaaattaaaaaaaaatttttttttgtagagatggggtctcactatgttgcctaggctgttctcaaactcctggactcaagtgatcctcctgccttggcttcctaaagtgctgggaccacaggtgtaagcccccatacctggcagagttattcatttttaaagaatataaaagttggctgggtgcggtggctcacatctgtaatcccagcactttggaaggccgaggcaggaggattgcttgaggccagtagttcgagaacagcctggccaatatagtaagacaccatctctataaaacacacacaaaaaatataaaaatttaaggttacttggcttctcttgcaaaatgaagaactatgtaagagaaggattttaaaagtaccagtagttactaaggttatatgtagttttacaagcccccattcaaatggctcagataagtcaatttttgagaattttcatttgtttttgcttccaaaaaaacaaacaggaaagacttcagaagtacgttttcagtcagtttagctgctccagtgtcttggatcctagattcagaaacaaattttaagtgagagtactgctcttgcttttgactagattataaaaggtctttatttttgtctttactttctttttaatttttttaatttttaatttttgtagattttatatatatatatatatgggttacatgagatattttgataaaagcatgcaatacataatcacatcaggttaaatggggtatccatcaagaaggtttttatttaatttttttttttttttgagacagggcctcgttctgtcgcccaggctggagtgcagtggcacgatcttggctcactgcaatctctgcctcctgggctcaagcgatcctcccatctcagcctcccagggagctgagaccacaggcgtgggccaccacacctggctactttttcatattttttttgtagagacagcgttttgcccttttgcccaagctggccttgagctcctggaccccgcccaccttggcctcccaaagtgctgggaatacaggcatgagtcactgtgctccgcctattttaaattttaaatgaagggtttgtgttggcaaggtgctttctaatgatctagaccagtggtatctaatagaaatacaatgtgagccaaattgtgttaattaaattaaagggacatttaacttttttggtactaagtcttcaagatctggcatgtgtttttatactacagcacatctcaatttgatctagttatatatctggtactcaacagacacacatgactaaatgactgtcgtaatggacagtgcaggtctagcccagaacattttcaggtattggtcctagaatagagcctgtcattttgccaagcacatccctgctgtaccatagtggcagggtctttgtataaggcagatctgatcccgcttgatcttcattattgtgcaacacacagaaacgattggaaatatgcctatcaagttattttaagagtaaagaaacatgtttggaaatcttttcatttccggaaatccatggagttgattaacaaaatgaagcattagaaataataaaacttgctgataagggatagtcctgaaaactaattggttccattgcacaaactttgtacctgatacagatttttaaatttgatataaaggagttcttatatctgctaaatattaataacataagatattttaaaagtataacttttttaatcattccattctttgctcagatgtcatcatatcagactttccctggccatcctgtctaaaaatctcctctaccattgttccccggtcatttttgtcctcaaaagtaggggaacaaaaatggggaacaatggtttgttttttttctgtatctcaccatctgatatattacatgtacgcacacacacatacatgtttattgtctctctccattagaatttcacttccatgagaacagagagtttttaaaaaagttttctgtttcattctcagaacctggaatgatgcctggcacaaaagaagcattcaataaatatttgatgaataaataaatgcttttcttgatcaattttaatttcttataaactggcaaaatggcaagttagtagcaggtttataacaaaacttttaaatgtttaaagggagttaattttttgattaatttataatgtaatgaatgtgatacattatggaaaccaagctctagacagtgcaattattttttcctacataaaaaagtgacttaggatctattaataggtgcagaaaagttactacatgttttttatttttccccaaatttcctttgatggtttcaagatttgagaattttatgtattttccatagtcatataagaagtgttttcaggggtccccaagatcacccacatatctcatgatgatttgctaggactcagagttgttctcatggctaaagtttattacagtgaaagaatgcatgacaagattaggaagaggaaaagacatgggggagtctagagaaatccatgggcttccagtttcctgtgaggggacacatcaagtgttttcctttcttcagcagtgaaaaatgcagtaattgtctgcagtgtttctgcctggagaagcatgctagagactcagatcccaagatttttgttgggaactggtaacatagggatcctctgcctagcaactaccaaaattacaaacttctgctgggtgtggtggctcacgcctgtattcccagcagtttgggaggctgaggcctgcagataacttgagcccaggagttcaagaccagcctggacaacatggtaaaacccctacaaaaaatacaaaaattagctgggcatggtggtgcattcctgtagttccagctacttgggaggctgaggtaggaagatgacctaagcccctggggaggttgaagctgcagtgagctgagattgtgcctctccactccagcctgttgggtgacagagtgagaccctgtctcaacaaaaaaaggaaaagaaaaaaaaaattctagacttctagagtggggcaggtgttcagcataaatcaccatgtttgtatagacggtctaggaagagtgaatagcccttgttggtcttgtcagttaactttgaaagccaagttcccagataccagccaggatctaatcttgcagacaggtccttctgtagatagtagcctcaggcctgctgtgttaactcttgtctgtgaaaggggcagatacataatgagattgtacaatcctaggtggagggttggcattgcatttaacttcttaaggaccaccattgaattactgatagtagatttgaaggaacttggagaagaaaaggagctttatgctttatgaggttatcaataagctagttcccactaatttctaggagtaacttcattctgtttgttgtctctctttggttgcaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaagtaagtgccaggctctggtgctggtagactttgtggcgggggaagttgtcaagcacgttgttactggtttttaactttcatactgctcaagtgtcttcatctcttcctcttctcagggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggtaggacctgtgattttgacattattgggggtgagggcctgagtctgtaagagactgtggttgaagaatagagaaagctcatttattttaacttagacaccttttattgaagcatacaatgccgacacagcttgatgggttatctcaaagtaaacacacttgtgtaaccaccacccaggtcaaggaatagaatattaccagcatcccagaagccctccttcatgttcaggtggtgtttaaatatgtttgaaaaatatgtgaacacctttgaggtgaaagagtattcagtgaatatgatggtcatgatgatgtcaccttggatttaaggcattttcttaagatgtgtaaagtatgttcctttaaatctctctttaagatagaggtacaggtatcgacttatttcataaagaaactaagtctcaaaaaaaaaaaaacttaagtttctgaaaggcagtcatacgattaaagttagaggcagtggtgctgttggtctttagagctcagcccattcaatcagcaaactttttctataaatggccagatagttaatattttaggctttctgtgttgtgcagtcacttccatctgcatatagtctctgttggaactactcacctctgccgatgttgtgcaaaagcagccatagataactcaccaaacagattactgtgaactgacaaccagaattcaaatattcaatgataaaactggctctttgcagatgattttgaatttgcccattgactagaaaggaagctgaaggcattttttagtactttccactattctggtctttagtatctcggagaacaagatgctctgagtctagtgtctcagtctcctttggcttctcacatttattaaggtcattgggagtgcctgctttcaagcagtttctttttttagcaccaaagatgctggtcttgccttatcctgcttttggcatggtcttgctgcagtattaggagtcaaatgctgacctaaaatttggtgtccttttaatctggaactcatgatgcatgaactctagggcttagaagtggcaggaggcaaagggcatattgaagcaaaactttttatttaggaaatgatgagctgactatgtagtctatgacttttttagtaaactgacttgacattcactatctaatggcttttaatacctgaaatttcaggagtcagtcccaagttcaaaatggattaaaaaaacagtgaggctgggtgcggtgcctcatgcctgtaatcccagcgctttgggaggccgaggtgggtggatcacaaggtcaggagttcgagacctgcctggccaacatggtgaaaccctgtttctactaaaaatacaaaaaagtcgggcatggtggcaagtgcctgtaattccagctactccggaggctgaggcaggagaattgcttgaacccaggatgtggaggttgcagtgagccaagtttgcagcactgcattccagcctgggcaacagagcaagactctgtctcaaaaaaaccacaaaaacaaagtgaggatatgaggacataaacattttccctttatccaaagtgcccacattgatcttttaagggccttctctttcttctagttatttgcagatcagtaaatgagaaatgggttctgattgatattatttccatggcaccttttttcatgaagagctttcaatttaccctgtttttccttaaatatctttttaaagagacagggtcttgttctgttgcccatggtggagtgcagtggcatgacattaattattgcagcctcaaacttgagggctgaagtgatcctcctgcctcatccttgtagggagctaggactacaggcacataccaccatgtccaactgacctttacttttttttttttttcctggtagagacggggtcttgctatgttgcccaggctcatctcgaactcctgggcttaagtgatcctcccatattggcctcccaaagtgttgggattataggtgtgagctactgcccctggcctccttaaatagttcgtaaatggaggggttattatgcctttttgatagaagggaaaatttcagagcaacttcccaaaggtgacacaatgaattagtgtcagagctggacatagaactcaggtctccttacatttgagcattgttatcattactacatgtgtcatcttccaatcactagtggcagatgttattgtagtctacagagcttatgggagtgccacaatcttcaattttagcattagtgcctctgcaattctttggatctttagggaaaagccccattttttatggcagtccccttcacctccttgatacataggagcataggagtgggcagtgacttaaaatgaacatctgctttgtgctatgtactcttctgtgtcctgtcccctttcatctggcttgcttcctgtgcctctttgcttaatctcctgccagagactctctggtttgcttatcctcccatcttgctttctgtcccctttggggtatgccttgatggcaagctgacattttaaagctctatgtttaacttctacattttcttcctctctttttgtagaagtatatttcttgttttctcagatgcctagcttccagagaaggtcataaaatacctttttgtcaatgtgaagtgtttctgaggttcttttctgttgtcatgtttccatctgccttctctgtcccagcttgcccttgttgcttttatgaggaatatgtgtgagagccccttgcacttcgcagaaaggccttggtagccagcagcttgagtcaagtatgatactatcacaaggagaatgtttaaaatgaggaactaagtcaaggagagggaaggataatcagaaccttgagctgaaggctggggagaggctagtggggtgtggttaacttcatgtgattagaggtaaagccatcgttcaggaatattaggtttgcaatttgagggaagttaagggagagcagaaacatgcagaaatgaccaaagtatctggaatatttggaagaaagaacacatcctactgctggttgtaaaaaatcgctgtcccacctactcagggtctttagagatgttcaagaggactcttggtgtatgaaatgcttttatagttgtctttggagccatcacattttctgtttttgtttttctctataggttaaagccgagccagccaaaatagaagctttccgagcttcactttccaagctaggggatgtctatgtcaatgatgcttttggcactgctcacagagcccacaggtaccaagaaccttgtagactaccacactgagaacagtattcctatttacttgagtagcccaagctctgggttgtttttggagagttttgtattatactgtaatcctttcagcttctctaattggaactgccactatggctcttgttgagtagctctcatccaaagaggaaataaaggtaaaaaaatgttggtaattgtagggctttttgtggagtttcaggaagaggttgctctttctcaccttagatattttgtacagagttatccttttatgaacgttataagatcagactctcatgctgtcagtaggaagcaaattgaggaatcctcttctgctatcatcaaccggccaattacttactgtgatttgccctttggcctgcctgaagagtgttaactgggtatcttaaattctacctaagttcattacttttttactctttccctttgaccttgcactattagttaaaaatcttatcttgtacctaagtgttttttgttgcaatgtagggatgaaaaccatgatttcttgcagtccagaagtagaaatattttagtgataaggagctggcctctaggactaggaggaatgatagggattgactagaatctgaatgtctttgatcttttctagctccatggtaggagtcaatctgccacagaaggctggtgggtttttgatgaagaaggagctgaactactttgcaaaggccttggagagcccagagcgacccttcctggccatcctgggcgggtatgaagaactctttaagatcatgctttaagtattgtttgcctggtagtaggccataacttgggtggtttattgtcatatagctcagtcacactgggtaactgaggagaatttaataaaggaactacaggctgggcatggtggctcacacctgtaatcccagcacattgggagggcccaggcaggaagattgcttgagcccaggagtttgagatgggcccagacaacaaagtgagatctcatgtctacaaaaaaaaattagctgggcggtggtggtatgcacctgtggtcccagttaccagagaggctgaggtgggaggatcacttgagcctgggaggtagaggctgcagtgcactgtgatcacgccactgcactccagcctgggtgacagagcaagaccgtttctaaataaataaataaataaataaataaacaaacaaacgaacgaactacatacagaggtgtgggtagggttcagggaaaccacaaagggacagtacagtaatttggggctaccaacaggcatcaccatttctatgcctgaagggacaaagggaggggaatggttatcagaattcagagaggaaagttggtgtggagagagctatctgatgggaactgtagcctttggtcaaaggacacaagatctggtagggagggggagccagggcaataaatattctgatctcctttcagtctcctgctgctgcaccccctcccaccctcaatttggctgaaacccaaatggaagccagagcgcaagaaagctccttgatgtagtccatgcaggtcctcctcctgtgatgcaacagggtagagaaggatagaagatggctctgcagggaagaatgggaaagatccaccataggtgctcatttagcaattttgaagtgcttgagccttataacctggcagggtataactatataacctggcagggtataaccatataatctggcagggtataaccatataatctggcagggtataaccatataacctggcagggtataactatgaaaacctcttcatatgtgtttaatatataatttagacctcatttctccagattacatacctattttatcttttctcctatagggaaaggcagcaagtagataatgattttccaatgggttagttaaaaatagaaatttcagaattgagggttgagaggaggataaattttaggtgagagagctagcactgcttggataagacaatttcctgtgacttggtgtggtgatctaggtagcagtctctttatggctggaggcccattacccttctatgagcagggttttttcccccaggggagtgaacatactatctcctgatgaaaattgactctggagttgggtgtcaatttcaggtagcatagttgcttatactgtttggctctgtgtctccacccaaatctcatctcgaattatccccacgtgttgtgggagggacctggtgattggatcaagggggcggttcaccccatactgttcttgtgatagtgttgtttggcagttccaccctcgctcgcctctctcttgccaccatgtaagatgtgacttgcttcccctttgccttccgccacgattgtaaatttcctgaggcctctccagccatgcggaactgtgagtcaatttaacctttctttataaattaccaagtctcaggtagtcctttatagcattgtgaaaatgggctaatacagttgctttctaggctttatgagcccagtttcagagtcttaaaaataactcaggtagatacaggttgttgtgtcttgttcttggaaaaaggtatctattcctgggctttgttcttcaactttctgtagacctggaatatgggagtgagtgccacctagtgctaccttatggttaggtttttaggttcagactgaaatagctgttacggggaattggatgtgagatttttttgccacctttcttgtagtgtagtttccctaggccattaacagtttttgggaaaacttttatattttattaaacaaactttattgtaagaaacactcatatgtatggaagttgagagaatagtgtagtaaactcccaggtatccattaccctgtttcaacaattaattgacagttttgctaatcttgtttcttttatgtcctaactctgttttgtcaggaatgtacacacacacacacacacatatatatacacacacacacgtatatattcctgacaaagtgaatacaagtgaaataaatatgtgtatatatgtgtgtgtgtgtgtgtacatatatagatattttagatatatagacatatctatatatctagatctagatctatatatagatttttttttttctgatacagggtctcactctgctgcccaggctgaagtgcagtggcatgatcacagctcactgcagctttgaccttccaggctcaagcgatcctcccacctcagcctccctagtacctgggactacaggcatgcatcaccatgcctggctaatttttgaatctttttgtagagacagggtctcactgtgttgcccaggctggtctcgaactctggggctcaggcgatctgcctgccttggtctcccaaagtgttgagattacaggcgtgagcttgtgccctgctgtcaggaatgtttttaagttagccttagacatcatatactttcacttacataggttgagtatcttttatctgaaatgcttgggaccataaatgttttggatttcagatttatttttggattttggaatatttgcatggtacttaccagttgagcatcctaatctgaaaatatgaaatctgaaatgttccaatgatatttcctttgagctcaaacagttttgatcttggaggattttagatttttggattagggatactcaacctgtaatactcctgtatacatcttgtaactgctaagcagatttcttttaaataatcaccatattatacctaacaaatttagcagttttgttactatcatccaatacccaatctgtattcagatgttcttgatcatctcagaagtgtctttttacagttggtttgtttgaataaggattcaaatgaagtccatgcattgcctttggctgttaggtatctcttgtaataatctcctatttattactttcattctgttgatttgttgaagaaacaggcatttgagctgtaagctattctttagaagaaattgaactcctttctaactgctttcttccctttgtgtgtgtatgtgtgtgtgtgtgtgtgtgtgtatttaaaacaatctatctttacccttggtggtaaccaatctttacaactgaaataaatagtaaatagtttcttgccatctgttcacccacatcactgttgtttcatacctccttttcacaaatcctagcatagggtttctcactggataggcattatcttgtttattgaatgaagaaggaaacagacacaaggtggtttgtccacgtaagtgggatttagttatatgggaatgtttatggaaggcaggctattactttgtttctctttagtttggatcttttttgtctcatagggagatgcaagatacatgtgtatttatcttatttccatgtactagaaaataagatcccaaagggtagggatctttctgttgcctttgccctgtgatgtttctcaaagacctagaatagtgcttggcacagagtaggtgcccagtaaatgtgttgaattgggtgacccaataaaaataaatgccataaagaaaatgtcccaggctgggcatggtggcttaggcatgtaaccctagtgctttggaaggccaaggcaggaggatcacttgagcttaggagtttgaaactagcctgggcaacatagtgagaccttgtctctacaaaaaaatttaaaaagaaaaattatccaggggtagtgttgtacgcctgtggtcgcagctacttgagaggctgaggcaagaggattgcttgagcctaggagttccaggttacagtgagctatgattgtaccactgcactccagcctcggcaacagagtgagactttgtgttgaaaagagagagagaaaaaaatgtcccagcaactgagcatagggtatgactttaggaatatatatttttgttcagtatatatttatttagtatacagtccagtcaatccctgctctaaggttaggataattctgagtggctctgggatcccacaattagcaatcgtgcttagatacaattagcaatcttgatgctctgaatttgtgtgtgtgtgtgtgtgtgtgtgtgtgtgtgtgtgtgtgtgttggggaatgtgcaaaatagatgtggaacccatagtttccttagacaagagtaggtcttctgagccctgcttaaaaaaagaatatggatttaaatctgttgtccatcagcttctaggtagaattaaaaaaaaatgtattgatggtaagtggggtgaggaatttttaaaaagatacactgatgtctggagccataccttaaaaggatttcttagaaatggattgagtttttgggttggagaaacatagggcaaagttaggcagtacttttgtcactttgagactttctctgttcctgtgccttgaaatagaaactcagtttctatgtaataccacttctctagtccattcttctttaagtgatgattcttgctttctcttgtagagctaaagttgcagacaagatccagctcatcaataatatgctggacaaagtcaatgagatgattattggtggtggaatggcttttaccttccttaaggtgctcaacaacatggaggtaggaaacaaatgccaagtggatgtgaaatagctctccatgataatagcaggttgtataaatgtaaaaagaaaacagtcttttgacatgagccctgaaaattcccatttttatttattttggcaagtctttcgtctttgcattgttcctttatattgtattgtgtctggttcctgtctgctttgtgaggcagtcttgttcttagtatagatgctgacctccatcattttggctcccctgtgtagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatggtgagtcacttgagtgggttggtagtgtgagtgaacagaaactctgtggtgtcatttattcattgattcagccaatcaacaagcattttaaaacaatctctataggagatctgtcagagagggctctgcatgttgcagtgagtccctcatggaagaatccatgggagaaaagcagtgctattggattactggccttcagtaatgcagtaatgtgttgcaaaactttgttgttgttgtttttttttttttttttgagacagagtctcgctgtgtcaccaggctggagtgcagtggcatgatctcggctcactgcaacctctgcctcccaggttcaagtgattctcctgcctaaccctccccagtagctgggactacaggtgtgcaccaccatgcccagctaatttttgtatttttcatagagacggggtttcaccatgttggtcaggatgatctcaatctcttgacctcatgatccacctgctgcggcctcccaaagtgctgggattacaggcgtgagccactgtgcccggcccatttttagttttatctgttttttcttcatctgtttaatgtgtattaagtacttactgcgtactggagatagtgtcatgtactttcatggtttgggttgttttggattatgttgctatctagaaagctatataagaaaactttctcatatgaaaaaattaagtatactgattacaagcagggagaaatgtaagtgtatattaaagactaatatagttgattttagggtgctccaaatatcattttgattgctgtataaaattgtatcatgtttttacatgctagtttgcttatttttcttttcaggcattcacgtattatttagttcagtgtttctcaaagtatgttcctaagaccagcagtatcagtatcatttttggaacttgttaaaaatgcaagttcttgggtcccaccccagacctaccgaatcaggaactgagggtggggccaaacagtctgtttgaataagccctcctggtgattctcatgcatggcaaagtttgagtactactgatctagtttactgtcattcccaacactattgacatctgttgttttgtgggggactgttgaattgtaaggttgtttaaagcatccttggccactagatgccagtagcaccctcccaagttgcaacaacaatatttctagacattgccacatgcctatctattatgaaggggcagaactgacctggttgagaaccattgatctagttttcactaacataaatagtgtggctaagaatgtctttattaaataacttttgaggttttccgttagacttgatcttccatacagtagaatttttgagtataaagggcatgaacaggtttataaagactgaagggtactatttgtttctagaagaaactttggtgtgcagccctgagttctggtcttggtggaggtggtgtttaagtagcttttcttgatagctcatcttctctttcacctctacccctcagggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtaagcggtcctatacaaagctaatacccatataagctggcagaattctgatcagaggaaggtggaatggagaacttcttctatgtctctttattctgggtaaatgttaagaggtaaacaggtaggtaatttacagaggagcctcttggtaagatagagttgggggtttatcagctaccttttgggttggggagcacactgccttacagttttggtgccaatcccttttttttcttttctctcttttccctttttacctggctttcattcaacaggtggtggagacactgccacttgctgtgccaaatggaacacggaggataaagtcagccatgtgagcactgggggtggtgccagtttggagctcctggaaggtgagggtcttctgttttttggcttgtttgggataagggtggactgtgcagtgagaggtgggtagaatggagtggagaaagttagaaggtagtgttgtcattagcagtcattactacctgggcagtacagaggaacttcagataaagctcctggcatccactgaggcggggagggacagatagaaacttggtctgagagttatggtctagtagacctggaatccacaatgtaaaagttggccagctcctggccatatatcctaaaaaagagctggcatgttattgggaagataaagtgggggaaatctggcttactgggccctatagtaatgctgtctatgtatgtgtgctctctcaaaaacaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttttattgtctttggcattaacagtgtttcaaaaaattttctgtgtatacccatcagtgattcattcccaaatcttctagaagcataagtgtctcaatatattaaaacatattgaataatccttgttagagttatccctgcaggagtccttagtgctcctttatccaatttgtacttgatgccctctaggcagggtgtacagctagctgttgctctggtatttcctataaccttcttggggatttcttttacctcctgtgttagactcctgttttctggattcccccttttccctctttcttggtctactttttgtagaacacaagactctactagcttcctgagaaagggtgcctgggaggcaaaatctctaagactttgtaagtctgaaaatgtctttattcgacccttatacttgattcctagtttggctatatatagaattttagcctgagtatcactttttgagactcgaagccactgtttcattgtcactattgagaatctaaatggccattcggattctttcatcatctttataattttaccttcctatttctttcctgtccttttaatggagttttgggagagagcagaggtaaacatgatttgaaaaagccatgtctgaccagaaattctgtgctggcaagatatgtatttcacctttagggacaaagaaataaacttttggacaggaccacagagctagtaagtaacagcagggattcaagtccaggtttgtctggttccagtggctgatgcttttccaatgtgcctccgtccctgacatgatgcttctaggctatagatgcttctagactctatccctgacatgatgcttctagactattttgtttaaccctggatagaatagcaaaagaaaattttggtggttgctctaaacaaaacagaaatttgaaagctcaagttttttcttcatttgtattttagttaatactgtacccatatttgtagttaattttaaattgtaccatgtttctgcatacctctatgggtactcaggaattctagtccaatttttgtgactttttcctactgattacctttcctccaacgttttaaaaattatttcaaatggaactgaaagaagcataaactcccataaacccagcacctagactctacaattgccaacattatctatccaacaatctctgactgtaccttttaagtactttctactggactgtttccaggatcacccctcatttatttgggttgttaacctaaagaatgaatgggggaatctccagtcataaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaaggcgggcagatcacctgtcaggagtttgggaccagcctggccaacatggtgaaaccccgtttctaccaaaaatacaaaaattagccgggcgtggtggcgtgtgccactgtagtcccagctattcagaaggctgaggcaggagaatcacttgaacccgggaggtggaggttgcagtgagctgagatcacgctactgcattcctgcttgggcgacagagtgagactctgcctcaaaacaaaaaccccacaaaacagtataaggatgtgctttctaatttggaattatgaattattggtaaaatattgcaaaggtgtatgctttaagttgtaaattcacctttaaccctagactatatatgtgtgtttatatgcagaaaaaaataattcccatgtcgtaagtgaacaatttggttctttagctcagtgttttcctgttttcttcatttccaaaatttccctctagcacaggggtttacacatgatcaaaaaggagtatacaatgaagacaccttcctcagtcccctacctaccagtttccctccccagaagcaacctctggaagaccagtttctttcaatctaaggctatttaatatacattaagaggccgggcgcagtggctcacgcctgtaatcccaacaacactttgggaggcccaggcaggcgggtcatgaggtcaggagattgagaccatcctggctaacacggtgaaaccctgtctctactaaaaatacaaaaaattagctgggcgtgatggtgggcgcctgtagtcccagctactcgggaggctgaggcaggagaatggcgtgaacctgggaagcggagctcgcagtgagccgagatcacgccactgcactccagcctgggcaacagtgagactctgcataaagagcatacccatgtgtgtacctatctatctatctatctatctatctatctatctatctatctgtatatagatatattaaaatgtaaatggtggcatacctgctgttctgtagttgattagtgttttctttcctgcctcttgaatattccctgtcaccttggatcccttagaacatagtgtgcatcacatcttccattctcaccccgccccatgctg

SEQ ID NO: 13037 - DNA, 47030 bp, Human
cccacatgagtagaacatcatagcgccctgcatttgcatattaaaaggctagggtggaatggccagttttattagggggctacatgaatgacatgcgtggtcaaaccagtcccctgagccctatgcaaatcagacaccgcctcctgcatcctcctcctataactggctggtatctcccacgcactctgggtctcctctctcagctttggagcacccatccctctgtctctgtacaggggagctgcttctttctttcttctcccttccttcttgcttattaaactctccgctccttaaaaccactccacgtttgtccatgtcgttttatgtaattcgactcaagacgaaaaaggctagtattcctccactcggtatcatcaccacattctgttgagtctctttacgtccaaagaatctctcaaaatgggctatttccatctttaagacactctcttaaaccaccatcgtctctcccaagattccttcaacagcaactgcttttttctgcagccagtgatctttctaaaaggcaaacatgaccacatgtcttcttttaaaatatttatatagctccccacatcctttaaaaggtacactttggccaggtgcggtggctcacgcctgtaattccaggactttgggaggccaaggcaggtggatcacctgaggctgggggttcgagaccagcctggccaacatggtacaacctcttctctactaagaatacaaaaatagttggacttcgtggtgcacgcctgtaatcccagctgtttgggaggctgaggcaagagaatcacttgaacccaggaagcagaagttgcagtgagcggggagattgtgccactgcactccagcctgggggacagagagagggccgtctcaaaaaaaaaaaaaaaaaaagtacaccttaatctggtttcaaggtgcaagatctgcacctatccttccatttaagtttcatcaaaccgctgctacctccccgtctcccacacaatttatgggacttctaagttccctctaaagggtccgaacacctacactggtaacaagccacctggatttgaatcctggcaagacaacttactatctgaccttggacattgtgctgttcttaacctctccgtgcctcggtttcctcatgtgtatgaataacatcaacacctacatcaaagtttgctgtattaaatttgataatatatgcaaagcatttagaaaagtgcctagctcatagaaagccttatgtaaatattaactatcattttttttcttttttggggtggtgggggaggggtttcgcttttgttgcccaggctggcgtgcaatggcacgatctcggctcaccacaacctcggcctcccgggttcaagcgattctcctgcctcagcctcccgagtacctgggattacaggcatgcaccaccacgcccgggtaattttgtatttttagtggagacggggtttctccatgttggtcaggctgatctcaaactcccgacctcaggtgatccgcccgcctcggcctcccaaagtgctgggattacaagcgtgaagcacctcgcccggcctagctatcatttttatacaagtgctaggttttgggagaatgtaatgatggcttttttcttactaaactttcagtgcaggaggaggagaaagaaagtaaatagttatatgaacacagtagaaagtcaaagtggaaaacaaaaagaacatagaacccaggtgagcggtccagacctccccccagaaacctaagaatccatagaaatgggtgggaagcggagaagatcctccagacagcaggtggcgatgtagcatcccccagaaggcccgctaacagaagctaggaggacgcgctaccaaggtcacgtgtccccggcgttcactcgctcttcgcttcacgacactcgcatcctcacgggtgattggtctgcgtgcggcacgtgggcggggtaccggggcgggccggggaggggcggggtgggcggaggagaggggcagggggcggagctggagggggtggttcggcgtgggggccgttggctccagacaaataaacatggagtccatcttccacgagaaagtgagtgtccgcgttcggtggggagctgtctgccgcgcggtggcgggcgtggagcgcggcatcaccgcctctcggagggctgggtggggcccgagtcgcccccatgccgatctcgcccggcgaggggcgacgccgcagcctcccgcctcctcggctcgaggaggggagcatcacctacgcccctacttcccccgcggcccccgccctgggagccgggagggagtatgggcggggccgggggcgtctcgggacacgggagtggggtggcgcccagtgggtttgcttctgcctttctccgtcactttccatcgcttttcggaggattccttcacccctccccaatccttccctctccctagggtctagctagagtcatctctgggacacctccctcaacccctcctaccctaatcctggcagaattaacttttcctcctccggactgctcaattctatattggagtcttccctacacgtagatctttggggtcttgttcgtgtctttcccctgcactaggtccgcgagcctcccgagggaggagaccttggctcgcccactgtagggcctgacatttaggaagtgaagtaggaaacccggcgtgcccctaaacagggaagtcgtcacaagagtttttattacgggatgtttgggtttggtttcttttggtactcccatctttccggagcaggcggccagctttgtttttaggtattaggagtggactgggatgattttgttgtagtctgcctagcctgctgtccctttaactcttccgtgaccatgcacttgaagatactgtttgtgatatgtaaagaaactcctcgtttctctcatactattatccagccatttgtgtgtgagtgaagccttccccaggacagctttggcacatggtatcatgtttcataatagtttcgtgtttggaaagagttgctggtaaggctgttatttaataggaggagcaaagggtttttgttttattaaatacttataaatgatcatttatcccagacatttaaaattcacacacacacaacaaataaagcaaagacaaaagaatacatttaccaaatgtaaatctgtagcataaattttttttaatttttattttaaagatggggtctcattctgtcacccaggcaggtgtgcaatggagagatcatggctcactgcagccttgatctcctaggcacaagcgatcctcccgcctctgcctccagagtagctgggactacaggtgcatatcgccagggccaggtaatgtttttgggagagacggggtctcgctgtgttgcccaggctggtctcgaactcctggactcaggtgattctcccacctcggcctctcgaagtgctgtgattacaggcgtgagccactgtgcctggaacaaattgttaagtacaatgcttttcattgtagaaaacatctcggaaacttttgaaataggctgatgttcagtgggggaggaaggactcagtcgtatagttgtcactaattttttgacttgattgacatgactcgtaaatcatagacaatagagatttggttgcttggctgagtagagtgcgtgaaaaatacacacgtactttttttttttttttttgagatggagtttggctcttgtcacccaggctggagtgcaatggcgccatcatggctcactgcaacctccgcctccccgttcaagcgattctcctgcctcagtctccccagtagctgagattacaggcgcccgccaccacgcccagctaatttttgtatttttagtagagacagggtttcaccatgttggccaggctggtctccaactcctgacaggtggtccgcccgcctcggcctcccaaagtgctgggattacaggcgtgagccaccgcacccggccatatttttgttattaattttcaaaggctttggtgtgggaccacatttcaacatggaaggccttaaacatgttccacactacttcctgagaattagacaagatttttaacaatattgttacctagttgggacacatttgtactgacccatgggatgaaaaaaagctgagtgctagcctagtgaaaatctacttacccgaaagaaatccctcttagtctgggtgcagtggctcacaccagtgctttgggaggcccagacgggcggatcatgaggtcagtagtttgagaccagcctggccaacatggtgaaaccccgtctctactaaaaatacaaaaaattagccaggtgtggtggcaggcgcctgtaatcccaggtactctggaggctgaggcaggagaattgcttgaacccgagaggcagaggttgcagtgagccgagaccgtgccactgcacttcagcctgggcaacagagcgagactccgtctcaaaaaaaagaaaaggaaaaaagagtccctcttaattatcagcatgtgtataggcctacagatacttcaggaatacctttaccattatcatcaacttgtatctacatagcatgtgaagattcaacaatttagttttttgggcgtcctcaagagtacgcacctataaccatatggcccaattgttaatctcctatacagtccattctgggaatgtttgggcttactgtgccatttttccgttcactgccttcccctctgcaatatacctttaacccttgctaggtcctgggtttggagagccagagaaccaactttggccctaaagaagctgtgtaggtagcaatatctgcctacgaagggccttgcaaccatttcctcttggaaccttggtttcctctttctgagtagtcactttgagtaccctttattaagttagaatgtaaaaacagtttctcactgatatatctgcagtgcctgagagagggcctggcacagagtaagtactcaataaatatttgaatggggccgggcgtggtgagacctgtctctacaagaatgaacaaaattagctgggcgtgttagcacatgcctgtagacttgggaggctgaggtgggaggattgcatgagtctgggaggtcgaggctgtagtgagccatgatcgcaccactgcactccagcctaggggacagagcaagatcctgtctcaaaagaaaaaaatgtatatatttgaatggataaagagatggctttgagtttctgagatatatatggtgctgtttatctaaagtaaacaagttttctgtaaatattttaaggctttgcaggccagctgtagtctctgtcacacattcttatttgtgcatgtttttcccaaccatgtaaaaatgtaaagtgcattcttagctactggggcaggttgaatttggcccatgggctagagtttgccaacccctaacttaaacctttgtactaactttatgaccactactggatttttgttgttgtttgttttagttctggtgcctgctttgtttttttttttttttttaatcctcttgctgatgtttcttggtgcagttactgtgccatttgtattggtgcttttaatgtaatgcaaactggtaataatatctaaacttgctggggttgtacataaaattattgaaaagattgaaaagatgctgagcattgactctgtggcattcattatgcccttttgtgattgctggattttagccatctttaggacatttgagctttaggagaagccaaattctgtataaatgacttgaagtgctaatagcacaggttttgaaacctctgcctgggtttgagtctcagctctgccttttactacctgtgtgatcctgagcaagttacttagtatccctgtcctctagtttcctcctctgtagtgtggggataataacatagacataacctgagagttagagtgtagagaaggctccctggcagatagtgctgtagaagtactggccattgccattactcaggtgcttgtgtttgctgaacctcatagtaagggctcggagagcactaagaggaggtgagaaatgctgctagattgacagcttgtccccagatagcccattcccgagagcaccttaggtttatacctgatttgtgttgtagttagtagtgtctctggtaatttgaactagtttcaggttggtcttgaaaacctggggaggttgggggtaaatgatttggtagcagttctcttttgtgattttatacattatctttgtagaactgcagtttgctaattctctgagcccaacacaatgaagtctgggcctaaaatcatagaatttcttttatttttttttttgtttttaatttatttattccctccctccctcctttcttcctttcttccttttctttctttctttccttccttccttccttctttcttttctttctttcttttctttctttggagtctcactctgtcaccaggctggagtgcagtggcacgaactttcttcagagtctcactttgtcaccaggctggagtgcagtggcgcgaactcagctcactgcaacctccgtctcctgagttcaagagattctcctgcctcagcctcccgagtagctgggactataggcatgtgccaccatgcccagctaattttcttatttttagtagagacgaggtttcaccatgttggccaggatggtcttgatctcttgacctcgtgatccacctgcctcagcctcccaaagtgcggggattacaggcgtgagctaccacgcccagcctattttttattttttgaggcagagtctcactctgtcacccaggctggagtgcagtggtgcaatctcagctcactgcaacctccgcctcctgggttcaggtgattctcctgccttagcctcctgagcacctgggactacaggcgcctgccaccacacctggctaattcttatatttttagtagaggcggggtttcaccatgttggccaggctggtctcgaactcctgatctcaagtgatcaacctgccttggcctcccaaagtgctggaattacagccatgagccaccatgcccagccaaatcatgagatttcaataccgctgaactttgattatggcaaagtgaacttctgctttgattaaagcttgatgagagaggtggctggggatagtttgagataagggcaaggcaggaaaatgcataatcttacgtgggctcattgtcattgtacaattcttttggtccatgtggaatttgatccgtcctatgacttaagttatgtttatttttgtttttatttttatttattttgtgtctttttgagagacatgatgttgctctgtcacctgggccagaatacagtggcacaatcttagctccgtgtagccttgaactcctgggctcaagtgatcctcccacctcagcccctcaaacagttgagattatagtatgaaccactgtgcctagccttaagtgatttttaaatttgtactgaacagtttgtcctttccttccattaaatcatattagaagtacagaacttgatatttcctgtagcaatacagtttttctttgatgaagtttgatttcaagtacttatttttcataatttaaagctattttttatagagagaattttaatcaaatatttggatgtcactattgctatatatggtattaagtatggtgaccatagtttgtaaactccaaactgacagcaagacaggaaatttgtgttagcaaaggcttttttcttactgtttgaattttttaaaaattagatacaatacagagaggagcacacaaatcattaagagtacagctcagcgaattttcacacagtgaacatgtgtaaacagcaagtaacaaaagatttacctgcatcctataacctcccattattcccttttctaggtactgtctctccactgcattcccaccaaatataaccactatgctgaattctgacatcataaatgagttttgcctgattttgagcttttgtgactggaagtgtacagtgtatataccctttcgattctgtcctctttagtttaccattgtttgagaaatttatccatactgttccagaattaactactgttaattattgttaattaactactgttgtagttaattcatcctcattgttatctagtattcttttgtgagtaaacacaatttccattctactgtgatcccagctatccatttgggtcgtttccagtttggggtccattacaaatagtaatgctatctgtaatgctattttgtattactacaaatagtaatgctatttgtggcacaaaaatactgcttttgtgaacattcttatacatgtcttttgatgaatgtatgtttgcattgctgttgtttacattatgtacctagtaatggaattgctagatcataggagatgtatatattaagctttagtggatgcattacataattattagttattattggttataccaatttatcctctcatcagtagtatacaacagtttctgtatctctaatctccaacattttagccattttagagtttgtgtactaacacattgtggttttaatttacatttccctgatgactaataaagttgagtacctcttttgtgttctttatagccatttgactgtcttgtgaagtgcttgtttgtcttgcctatttttcttttctttctttctttttcttccttccttcctttctttctttcttctttctttccttccttcttttctttctttctgtctttctttcttgtctttcttgtctttctgtctttcttggtcttgccctgtcacccatgctggagtgcagtggtgcagtctcagcttactgtagcctcgacctttttggggctcaagttatcctcctttctcagcctcccaagaagctggactacaagcacgcaccaccatgctcagttaattttttattttttgtagaaatggggtttcaccatgttgtccaggctggtctcaaacttctgggctcaagtaatcctcctgccttggcctcccaaaatgctgggattacaggcatgagccaccgcagccagccttggctatttttcaaaaggatataagtagaacatctgtatatcccttcaatttgcatattattcagtaagagttgcactctggtagtagaaatatataaggaggagaaagaagtggaaacaaaaagtctattctcatgagaagacttgggggatagtgttctctctagctccaagctacttattccttacgaaaagttgaagataaacttatctcagactgaggctgtctcaatgttgtcttcctattccattatacacatataacccatatttttttcaccagctgaattttgctcctagaaaattgattcatcaggaaaaatatccgtcttgcaaggtggttctctttagagtctgctgtgtgacatagctcaggacaaattgtgtgatgtcagataggttgggttaaggaatagaccttattggggaaagagagaacttggagggccaaggttagcaggagaaggaaatgttctctcatctgccgtcaattcagggaggggcaaacctggtgtctgtgttcacagggagggatccatccatctgtgattctcccttcttatcaggtagcatgggaaagctacactgttgcggggaggagggtcacacgcaggctacttagtaccaggcaccctggacttggattcaggttgccagttgtgtgagaaactgcccagcacctgaaggccctgaacccatgagaagttgtacctacctcccatgaggaggaatcctgtcatcccatgggagctgagcttgggtgcagtccctcttgctggcttgtccaggagtgagctccagggttgtttgggacagttctgctcattgctttacactgtgtatacattatctgtagagttccatgaagagaacttcagcactgtaactgcaagttttaacatggaacagaatttttctcacctgtattaattcttaagatttgaagttctatcaacaagcatttagattgtgtggagatttttttatttttatttttggagacagagtcttgctctgttacccagactggagtggcagtggcatggtcttggctcactgcaggctctacttcctgggttcaagcgattctcatgcctcagtgtcctgattagctaggactacaggtacacaccaccatgctggctaatttttgtatttttagtagagacgaggtttcaccgtattggtcaggctggtctcgaactcccagcctcaagcagtccacccacctcggcctcccaaactgctgggattacaggtgtgagccaccatgcttgactgacatcatcatgttaaaagaataaatgttctagggagctgggcacagtgtcatgtttctgtagttctagctgctcgggaggctgaggcaggaagatcccttgagccctggagttcaagtccagcctgggcaacatagtgagatctctttttttaaataaataaataactgttctagggactaaaatttcctttcaccattagtaatttactgtagaatctccaagaatgaacttattttaggtactgaaaatgagggagactaaatgttttatacagtagtttttagtaaaatatgagatttgatgcatttgatagatgatgtttgtttaaaataattcttaaatttttgatcatgtaattatagtttcattaatggtagatttgtaaaataaatgttaccaaatgaaaatgcatgtacctatgttaattatccttatctaaagctgaaagttcagttcaactatgttaaaacatagtaggggcctggcagggtggctcttgcctgtaatcccagaacttagggaggccaaggtgggcagatcacgaggtcaggagatcgagaccatcctggctaacattgtgaaaccgtatcgctactaaaaatacaaaaaattagccgggcatggcggtgggcacctgtagtcgcagctacttggtaggctgaggcaggagaatggcgtgaactcaggaggcagagcttacagtgagccgagatcatgccactgcactccaggctgggtgacagagcaagactccatctcaaaaaaaaaaaaaaagttggccaggtgtggcggctcacacctgtaatcccagcacttttggaggccgaggcaggcggatcacaagatcaggagtttgagaccagcctggctaacagagtgaaaccctgtatatactaaaaatacaaaaattagccaggcatggtggtgcatgcctgtagtcccagctacttgagaggctgaggcaggagaatcacttgaacccgggaggcggaggttgtggtaagctgagattgctccactgcactccagcctggacaacagagcaagactctgtctcaaaaaaaaaaaaaattaatgattaaattatttaggggagccgggcgcagtggctcatgcctgtaatcccagcactttgggaggccaaggcgggcggatcacgaggtcaggagatcaagaccatcctggctaacacaggatgaaaccccgtctctactaaaaatacaaaaatttagccgggcgtggtggcgggtgcctgtagtaccagctactcgggaggctgaggcaggagaatggcatgaacccgggtggcggagcttgcagtgagccaagatagcgccactgcactccggcctgggtgaaagagtgagactccgtctcaaaaaaaaaaaaaaaattatttaggggaagatactatacaattctgtttaacaagtcacattttaattttttcttttggaaatattagcaagaaggctcactttgtgctcaacattgcctgaataacttattgcaaggagaatattttagccctgtggaattatcctcaattgcacatcagctggatgaggaggagaggatgagaatggcagaaggaggagttactagtgaagattatcgcacgtttttacaggtactgattttaaactcactaagtcacatttcttttttttttttttttttgagacggagtctcgccctgttgcccatgctggagtgcaatggcgcgatctcggctcactgcaacctctgcctcccgggttcaagcgattctcctgcctcagcctcccaagtagctgggattacaggcacacggcactatgcccggctaattttttgtatctttgttagagatggggtttcaccatgttggtcaggttggtctcaaactcctgaccttatgatccacctgtcttggcctcccaaagtgctgggattataggtgtgagccaccacacccggcttacatttcttttaaaaatgtggataccatttagaaaaggatgggccattcttcctatagggatctgactggtgaattataactgtgctgttaactttggaaatgggaatgcacaagatattgttttaaatatgcacgctaatgacagtttgtatccttctttccccacccccacccttgcttcaactacctgtcaaaattaacagcagccttctggaaatatggatgacagtggttttttctctattcaggtaagtagtcacaagcatgtactatgtgttgcttacatcccaggcaccgtttcacagcctttcaatagtcactgtaacaaggcgaccttcggaagttcttctgtctacagagtatagattatactctagagtactagattttttttttcttgagacagagtctcgttctgtcacctaggctggagtgcagtggcgtgatcttggctcactgtagcctctgcctcccgggttcaagcgatcctcctgcctcagcctcccaagtagctgggattacaggcacccgccaccacaccagttaatatttgtatttttagtagagatagtggggtttcaccgtgttggccagtctggtctccaactcctgacctcagcctcccaaagtgctgggattacaggtgtgagccactgcacctggccaactagagtactagatttttatatagataaacatgaaaggattgtagaatcttcatattagagtggggcatttaaaaattccttcttgagaaagattaatttgcatctggatgctaataataaccttaattctggccgggcgcggtggctcacacctgtaatcccagcactttgggaggccgaggtgggcggatcacgaggtcaggagattgagaccatcctggctaacatggtgaaaccccgtctctactaaaaatacaaaaattagctggacgtggtgacacgtgcctgtaatcccagctactcgggaggctgaggcaggagaatcgcttgaaccagggagtcgtaggttgcagtgagccaagatcgcgccactgcactctagcctggtgacagagcgagactccatctcaaagaaaaaaagaaatccttaattctaataagtcacaatgtctcaaacttaccatctgttgggtaaatttgagaaaatgcaataccttgctaccatccttttaaatcagcctaccagactggatttccttattatggtttgtggcttttgattttttttttttaatgtatagctctctttgaattctttggtggttatatatatatgtactcgcaagattcttttatctgtgggtctttcattctttttctaacactgtgagttgtatccagagtactttcggaacctctcctgagcgacctatctctgcagatatctttgtttatgtttcccttgtactgccctcctggactcttcctcatccaccagcatttccatctagtgctttaccgtgccactgctaacaggtaatggctactgcagggctgaaatcagaggccagagtaggcccagcacttggcgtttcctatttgtgccttgctgctcttggtgcctgttcatgtgtgcccactaccttgcactcaatttctgtctttgctggtacctggctcacttgcttctttgttggctaccttggagggcagatagtgaattttcagaaatttccctttttttgtcagacagattgaaataaacaggtttgcattttgttttttctacaagcggcaagcccatgaccctagaagtctgacatctatggaaccttcagtttaaatgcccagggagaacttattttggtagatatgatttctgacattgcaggtagcaagttgaatataatttttctaaagtagcacccacagcagccaaattatcagatgtatatagtagactagttttaagaaaagcacttatgggtagaatatacatctggatttttgaggcagttttatttaggaattgtgtggttttctggaacatctcagagacctggtatgaaaagcactcttctaatatatatgtgtttttttttatggatttagtgatatatctatacacacacactttttaaaacctatagccggctgggcgtggtggctcatgcctgtaatcccagtactttgggaggcccaggcgggtggatcacaaggtcaggagattgagaccagcctggccaacaaggtgaaaccctgtctctactaaaaatacaaaaatagctgggtgtggtggcgtgtgcttgtaatcccagctactcgggagcctcaggaggagaatcgcttgaacctgggaggcggaggttgcagcgagccgagatcgtgccactatactccagcctgggcgacagagcaagactctgtcacaaaaaaaaaaaaaaaaacctatagccttctagagaaatttatatatgaagtacacaactaacatagctacacttcctaaatttggaatggagtggtttagcttatgaaaagttgctatttttcttaacaggttataagcaatgccttgaaagtttggggtttagaactaatcctgttcaacagtccagagtatcagaggctcaggatcgatcctatgtaagattctgttttgcatttcatacatttcttttcccaaatttgatttttaaagttgtaatttcttaaagaagagaaatacattttgaatacttttgttttgatgttccctgtttcattcactcagactttcctatttcacctttgtgatgtccatgagcatctgccctgtagccttcctggcaccccagtgtctgtggcagcacagagctgaccccataagtggtgcatgaggccatcttgtggcacagcatcactaagctgctgcagagacgttcatatggttgtgtgatcttttaaaaacatcagtgacacttaactataaatataatcttaaattatcacaaattttatataatatttgccagtagacaacataaatatgaattcaatatttcaagttaatattgtctgttttcttttttagaaatgaaagatcatttatatgcaattataaggaacactggtttacagttagaaaattaggaaaacaggtaacatttcttacccttccttgtctttttttcttatattgtaccccatttaaaactaaaatgtgggccaggtgtggtggctcatgccaacagtttgggaggctgaggtggggggatcacttgaagccaggagtttgagaccagcctgggcaacaaagggaggtcctgtctcttaaaaaaaaaataaaaataaaaataaaaataaataaaaaaaaaaacaaagagccaggcatggtggctcacatctgtaattccagcttacttggaaggctgagtcagaaggatcacttgagctcaggagtttgaggctgcagtgaactatgattttgtcactgtaccccagcctgggtgacagagtaagactgttctataaaacataaaaataaaaaaaatatatttaaaaattaaaaaaaaaaaaggattgctgactttaaaattaggaaactgaccagtaatgtgtgtgtgtgtagcatggtttatccttcttgatagatagaaattgtcattttaaaagataatatcagttttccttataaatttatttgtgacaagtatatgcaatttaactatatcataagaaaaattctatattaaagataatacaaatgtggttacttttaagtgggtttttatgtgatgactatgttctgtcagttaattattacatttatagatttgtatttagcatagtgctgtcacaaagcctgaaatagtgtcaagcatgaataaagcattcaattatgtttgctttagtgtaagattattcattatgattccaaaagccatgtaatacgtacgtctacagaaaatcacttctattttttaaataaaacatgaaatatgtcttgagcaagctattttaagaaacaatcatttaacgtccttgttattagaattttgaatctttgaaagagggttattgaaaaccagctaggacagtaaaaaagaataaactagtgatacatgcagcaatatggatgaatctcaaaataattatgctgaaagaataacccacaaacaaaatactacctgctgtatggtatcatttattaaaagtctagaaaagtgcagattcatctgtagtgatggaaagcagattgaccagcggttgcctggggacgagaaggctatggaggagtgagaggggagggttacagagaggcacgggaaacatggcaatgaggaatgtgttcactatcttggttgtagtaatggtttcatgggagtacagtatacaaatgtgaaaacatttcagaggccagatgcagtggctcatgcctgtaatcccagcacttttggaggccaaggcaggaggattgcttgagctcaaggagttcaggaccagcctgggcaatggcacaagaccccatctctaaaaaaaaaatgaaagaaaaaaaaattggctaggcgtggtgatgcatggccgtagtcccaggtgctagggaggctgaggagggagcacagaggtcaagcctgcagtgaatcatgatcgtgctactgcactccagcttgggtgacagaaggagatcctgtctcaaaaaaaaagtttcaaattatacactttaaatatgtgcagtttattatatgtcacttataccccaataaatctgttttttttaaaatgtaaatacaagccaaaaaaggtataagtcaagaaaatatattgaattaaatctgtaagagataattcaaaaacaaaaaccctattgttatcttttaagtcacccaaatcaaatttgggaaaagtcacctacttagcttcatcctaagttggttctttctttctttctttccttcttttgagacggattcttgctctatcgcccaggctggattgcagtggcgggatcttggctccctgcaacctccgccacctgggttcaagcaattctcttgtctcagcctcccaaatagctgtgtctacagccacgcaccaccacacccagctaatttttgtatttttagtagagacggggtttcgccatgttggtcaggctggtcttgaactcctgacctcaggtgatccgtccgtctctgcctctcaaagtgctggggttacaggcgtgagccaccatgccgagccctaagttggttctttcttaaagttcttcctgaggagccaagagcaagttaaggagatgtaacctagaagcttacagtggaggctagctgggtgcagtggttcacgcctgtaatcccagcactttaggaggctgaggcagggagatcactgaggccaggagcttgagagcagcttggcccaacacagtgacaccttgtctctacaaaaaaaaaaaaaaaaaaaggcagcttacagcagtagaggctgatgcgagtgggaatcacctctaggtaaaaaccagtgtagcgtactgctgagattatttaacctctgggttttatttatgtgtttttaaaaattatgatccagtattttttacttttttttgtataaagtaagcactgaatttttaaggttgtattaatttgcaaataaatgtctatcttattattttgagagatttaaaaaattttagttcttcaaaattgcattttcacattttgaattacgttatctttgacaaatacagaagatgtcaaattttggtttattttctttggttctaatttatatttttgtttaaaactatatttttcactatagactctttctgtctctcgaggtccctgtataatgaaaaagaaggctggaaaaagtattaacattgtcaaaatccaggaaaagtagttggtcatgatattgatcgttaactttagaaactttttgtatcttgtgggttaaattaggattactatgtggtagtgataaatgatgttaattagggccgagtgcagtggctaacacctgtaattccagcatgtagggaggctgaggtgggaggatgtcttgaatccaggagtttgagaccagcctgtacaacatagtgtaagaccccttctccacacaaaaaaattagaaaatttgtcaagcatcttggtgcacacctgtagtcccagctgcttgggaggatgaagcgagagaatcacttaagcccaggtgttcgaggctgcagtgagctatgattgcaccactgcactccagactagatgaccatctcttttaaaaaaatgtgtttatatgttatatgtgatagtgctttttaaaaacatttttaaattatagagacagggtctcactatgttacagcccaggctggtctcaaattcctgggctcaagcaatcctcccaccttagctaacctcccaaagtgctcggattataggcatgagctgcatgcccagctaatttagtgatttttaaaaactgagctggtaattataaattctcttcctggaacttctgactttctcacaattggaatcttttgacaaaaattatcagtaatgggaaaactttgtgtagttgtcatttttcctcccatcagtgtgatagatatgattggagttatgttggactgatattttgaaaaaagatttaattatagctattaataaagacatttaaactactgactatgcatttttattcttttgggagggtttaatgtttatagtttaaagcaaactgttgtttttaaaaaagtatctaacagggccgggcgcggtggctcacacctgtaatcccagcactttgggaggcctaggcgggcggatcacaaggtcaagagatcaagaccatcctggctaacatggtgaaaccctgtctctactaaaaatacaaaaaaatagctgggtgtggcggcgtgcgcctgtagtcccagctactcgggaggctgaggcaggaggatggcatgaacccgggaggcggagcttgcagtgagccgagatcgcgccactgcactccagcctgggcgacagagcaatactctgtctaaaaaaaaaaaaaaaaaaaaaaaaagagtatttagcagaggccaggtgcagtggctcatgtttgtaatcccagaactttgggaggctgaggcgggcggatcatttgaggtcaggagtttgagaccagcctggccaatgtggcaaatgtgctgtctctaactaaaaatacaaaaattagctgggtgtggtggtgcagacctgtagtcccagctacttgggaggctgaggcaggagaatcacttgaacctgggaggcagaggttgcagtgatccgagatcatgccactgcactccagcctgggttacagagtgagactcttctcaaaaaaaaaaaaaagtatttaatagtgataaatctgcagtattctcttgtagtttttaagatcatattattcagtcaaagaaaagagctcaacttgaaatatttccagagtttaaacaatcttactaagctttgatgggttgtatctattcttaacatgtgaaacttccttattacctataatatacactaacttaaatattgacaatttttttccagtggtttaacttgaattctctcttgacgggtccagaattaatatcagatacatatcttgcacttttcttggctcaattacaacaggaaggtaagtaacggctgaacattttgtaatgttacctttcgaagtagttaaataaccaggcacattagatgacagtgtgataaaactgtttttctggcagtggcagtgaaacaatctttagttttgacgtggtgataggctgtgatttgggtgacgctgttcagttagagttctcactgacacctggcccttcctcttctgaggatgctgctttctttgcagcccttctaagtaatggctttttcttttatacatcacatatcacacggctgagaggagggatagatgtttttcttctttgcctcttctaggccactgttcttccttataaactccagtttctttgaaatacatgcccctaacggctgggcacggtggctcacgcctgtaatcccagcactttgggaggctgaggcaggcggatcacgatgtcaggagatcgagaccatcctggctaacacggtgaaatcctgtctctactaaaaataacaaaaaattagccggggtgtggtggcggacgcctgtagtccgagctactcgggaggctgaggcaggagaatggcgtgaacccaggaggcggagcttgcagtgagctgagatcgcgccactgccctccagcctgggcgacagagcgagactccgtctcaaaaaaaaaaagaaaagaaaaaaaaaagaaatacatgcccctagattaaactatcccttgtccttttgcactcatccacaagtctcttttcatcagtgattttaggatctgactcgttgtctttttctctacttcaactacttttatcattcttaattatttctgtatcgtcaatcaatccagtacctgcctcttagtttcaaaatcacttactcttgcttagctattaccagtaatcataaccactgtcaaatctcaattgcaagcatattactctttaactaccacctcctatctttaaaccatgttttgtctgtttttttattccagccattctttaaaccctactgtggggcccaagcatttcctttatacgcattcttcctttcttctactgcttattttctgtaatccgtcatcataatcactccattgcattcttcaacgtgtttcccctctctccctccatcatacttgaatgacaaaaatctcaaccctggttaaaccacatcttggccttgtccattcctgtaccagagtagctggacgtggctaaaaaataacataaaacatgatgattggttttacttttttcttaaatgatctatccatccattcacccatccatctatcaaagtgactaggcctatttctgaagcccaggctggagtgcagcagcataatcacagctcattgcagctccaaactcctgggctcaagtgattctcttgccttagcctgttgagtagctgggactacaggcttgtgctaccacacctagctaaggttttactttaaatttattataatcacaaaattcagatgagcctttagtgctgtctgatatttctactatgttttcttagtgatgtaccaccctccaaggtgtttataaaaaattatgtaccactctccaagatgtttataaaaaataatgtgccaccctccaaggtgactaatttcacagcttatgtctttaaacctttaagcactttcctctcccttacacaccttccttgtggctttccgttacattctgctgagaacatagaagcaattaaaattatgttctttctaccagcaaatttatcaatttgcttatatcttcacctgtgctttgagcctatttaaatagatgaatggtcccctacctctaaccaaaaccagtccctcacttgtgggctggatcccagctcttctcacctactcaagatgttcctgctttcatctctccactctcttatataatcagttccccccccctttttttgtaatattcctataagcagtaaaataagctttttatttccattgattaaaaataaaaatcctctcttaattccatgaaactccagctgcctccccatttttattttttccttaggattgtctctagtgtgccttctccttttcttgaactctgcctcctgggttcaagcgattctcctgcctcaacctcccgagtagctgggattacaggcgtgcaccaccatgaccggctaattttttttttttttttttgagatggagtttccctcttgttgctccggctggagtgcaatggcgtgatctcggctcaccgtaacttctgcctcctgggttcaagcgattttcttgcctcagcctcccgagtagctggatttacaggcatgtgccaccatgcctggctaattttgtattttagtagagatggaaggggtttctccatgtttgttaggctggtctccaactcctgacctcaggtgagccgcccacctcggccccctaaagtgctgggattacaggcatgagccactgcgcctggccccggctaaattttttttttttttttttgtatttttagtagagacagggtttcaccatattggccaggttggtctcgaattcctggcctcgagtgatccacctgcctcagcctcccaaagtgctgggattacaggcgtgagtcaccttgcctagccatcttttagtaatggtatttggagatcacaatttgagtgctggcatgcttattgctgctgggtttgttatgtagttattgtgaattcacatttaggaatatagggtttttaattctttgattttagatacttgtatcttttttcttttatatttaaaaccttggttcctgatgatatcccttcttagaaaccctgtctacctttggccttcagcccaccatgctgtggttttcctaacttgctgcctgcacttttcagattcctttcatggatcttaaatatcatctgtaaataagatctatgtgtcaataattaccaaacttttatctttagtcttgacatctaccctgaacacctagctttgactaactcctagctttggcatctccacttggaaatccaaaaagtgtttcaaactgaacatgtctatgaaagacttatttttttctctctatccatgctatccatcaggttttccatttccataagggtgactcttgtactctggttcctatatattataccgacagagcagcccagagtgcttcttaaccagtgtaaggcctgttatgtcccaccctcactctttgtccttcagtggcttcccagcacacttagaataaaatctgaagtcttaggccgggcttggtggctcatgcctgcaatcccagcactttgggaggatgagggggcagatcacttgaggtcaggagttgatgagaccagcctggccaacatggtgaaaccctgtctctaccaaaaaatacaaaaattaactgggtgtggtgttgtgcacctgtagtcccagctactcgggaggctgagataggagaatcacttgaacccgggaggcagaggttacagcgagccaagatcataccactgcactccagcctgggtgacagaacgagactctcaaaaaaaaattaaaaaaaaaaaatatgtgaagtcttgaataaaacccaagatctttaccatggcccctgaacagggcagagtatccattcttcagacactcttcatagaataccatggtgagctggcatatttattatacaatacagaaacaattttactggcagaaaacacattaaaccgtctaaactctgaatacagttgtcctcataaaaaatgttcaacatactattttgaggttttccattaatagttcttataatctttgtcccattatgtgttaatccaacaaaggatatccaataacaaacaccaaagtttaagaaaaatgtgctaggcgcggtggctcacacctgtaatcccagcactttgggaggccgaggtgggcagatcacctgaggtcaggagttcgagaccagcccagccaacatggtgaaaccctgcctctcctaaaaatacaaacattaactgggtgtggtggtgggtgcctgtaatcccagctactcaggaggctgaggcaggagaatcgcttgaacctcctgggaggcagaggttgcagtgagctaatattgcaccactgcactccagcctgggtgacagagtgagactccatctcaaattaaaaaaaaaaaaaaattaatgatagagaaacttaaatcagttagattgttttaggtatagcccatccttggtttttgtgtgtagcatctagcttggggaaaccctggatttctggaatcatatttagacacagtcacactagactaatgtaattcttttgggatgcaaaccacacgtttgacaccttaaatagcttttaggtatttggcttcccagcccctatttttagttacaaggggtgtacatgtgtgggtcagggtgggggtagctctttccgcagatgattagttttagccatgttactagttattgcacacattatctgtgtcctcacagcagccctgtgagtaagtgtattagggttctctagagggacagaactaataaggtagatgtatatatgaagggtaatgtattaaggagtatcgactcgtatgatcacaaggtgaagtcccacaataggctctctgcaggctgaggaaccaggaagccagtccaagtcccaaaacctcaaaagtagggaagctgacagtgcagccttcagtctgtggcaaaaggcctgagagcccctggcaaaccactggtgtaagttcaagagtccaaaagatgaagaacttggagtctgatgtttgagggcaggaagcatccagcatgggagaaagatgaaggctcagcaagtctagtacttccacactcttatttctgcctgctttattctagctgagctggcagctgattagatggtgaccacccagtttgagggtgggtctacctctcccagttcactggcttaaatgttaatctcctttggcaacaccctcgcagacacacccagaaacaataatttgtagccttcaatccaatcaagttgataatattaaccatcacaggaaggtactagtatcatatgtttaacagtagaaaccaagacaaatgcagctaggaagtgggagaactgggatcagatgcaggcagtctgattctaaatcagttgctgttacccactctgacaacagtaagtgagtagcctgctcagtcaagtactatattagtagggccctttacagacatatttatttctcacagtcactcaatgagacggctcttccagtcttacaatggagaaagtgaggctcagagactttaagtaacttaccttagacgactttactagtaagtataagaatcattatttggactaaagtctttctgaatcctcagcttgtatttttttccagtgttctgtgctgcctttttatctactagtgttttacatcaattttgaatctctttactaactggttaggttgatttttgccttttttttttaggttattctatatttgtcgttaagggtgatctgccagattgcgaagctgaccaactcctgcagatgattagggtccaacagatgcatcgaccaaaacttattggagaagaattagcacaactaaaagagcaaaggtaaaaatgaggcctgcagtatggaatatatggtagtatttcattatgagaattaaattttcatgcttagattgaatatgtggtccttgtgttgttggcgactctattttggaccttatattttagtgaagtttattagtttaaacttgaatcaactctttgaaatacttaaatatattaacttagttagctggtatggtatattcctagcacttcgggaggctgaggcaggctgattgcttcaacccaggagttcgagaccagcctgggcaacatggcaaaacctcatctctacaaatagtacaaaaattagccagatgtggtggtgtatgcctatagtcccagctacttgggaggcagaggaagaaggatcacctgaaactggggaggtagagactacagtgagccataatcacactaccgcactccagcctggtcgagagagtcagaccctgtctcaaaaaaaaaaaaaaaaagaaacggaaaaaaaaaacttagttggattcaaattgcaacacaatcattatattactagagcttatttgccagaaaacattttaagttttgacttacttaaagcctttacattacaaatgcctttatgttatgtctaaaatagaagattggttgcagttattaccagtgcttttgttctttagagtccataaaacagacctggaacgagtgttagaagcaaatgatggctcaggaatgttagacgaagatgaggaggatttgcagagggctctggcactaagtcgccaagaaattgacatggaagatgaggaagcagatctccgcagggctattcagctaagtatgcaaggtaaagacattctgatgtgtgttgtattcattgctgaagaattgattccaattattcttagatttcatggaagttaatgtactcttagaggtgttttgacaattactgcagaagcaatagctatatagtgggctttccctttagatttcttataatggaaatcactttttacaacctatattttattaggagtagttatatttttactcctggttattttatttggtttcaacactgtactaacacaatagtaaattgtggttttaatctttgtgggtatcagttgacccttatccaaatcagctgttacataaatatgtgccattagacactatggaagggcctggacagggaatataaactgattttacaaaaacccaacatttattggctatgcaacttaaaccgtaagcccactttggtgggcccagttttttagtgatataaactatcaatagagaaaagcgaaaacatatcccctagacaatctaggcaaagaaaaatgttaagacatagctcaaagtagcttaattaaaagtttgaagtgggttttttgttttatttttttctaactcatatgtatttgcttctactttctaatgaaattatttatcagttgatttccttagatatctaaataaaattgaaatttcattaatgggaagattatttttatcctgaacttttcttgcctctatgcatgcctctgagtactccatatggtgtgcaatcccatttttgattaatagagtcctgctggattagcagggacagaaatcagctttagatttctttcttttttttttttctttctttttttttttttttttttttgagtcagagtctcactgtcgcccagcctggagtgcagtgatcttggctcactgcaacccctgcctccgaggttcaagcgattctcctgcctcagcctcctgagtagctgggactacaggcgcctaccaccacgcccagctaattttttgtacttttagtagagatagggttttgcccttttggccaggctggtcttgaactcctgacctcaggtgatccacctgccttggcctcccaaagtgctgggattacatgtgtgagccaccacgcccagccagaagagtagaatattcttaaagagaaaacgttttaaaggcttactcaaatgagtataaacaaacatattgttgcttgaattggtaaatacagtgattggtttttgttgtgttgtgttttgttttcaggtagttccagaaacatatctcaagatatgacacagacatcaggtacaaatcttacttcagaagagcttcggaagagacgagaagcctactttgaaaagtaaagtagttggtacaagttaaagtagcatgtttaatatttgctttggctattttgtctatttgtaaatggttactgcctgaatcctgtgaatatttgaatgtattttttaaaaatttacagcaaataggacgggcacggtggcttacgcctgtgatgctagcagtttgggaggccaaggcgggcagattgcctgaggtcaggagttcgagaccagcctgggcaacacagtgaaaccccatctctactaaaaatacaaaagaatcagctgggcatggaagcgtgcgcctgtagtcccagctgcttgggaggctgagccaggagaattgcttgaacccgggacgtggaggttgcagtgagccgagatcgcaccactgccctccagactgggtgacagagtgagactccgtctccaaaaatatatgtatatatatataaataaaaataaaaatttacggcaaataacatgaaacaaaaaaaccttgccccaatactggataaattttttaaactgagtgaaggaaaccttataaaatttcatttattaaaagaaaaatgaaattaggacaagacaagaagaatgccaattgatcctttggatgtacttcttgcttacctgattaaccctgcaaaattcctctaccaatcagtacgaaaaacagctttggaggtatgggagcgcattcccaaatagacgtggtagttcatttagctgctcatggccgcttcaggcagtcctgtaagcctgttagcatcaggggaatggatgcaaaccataaatctggatcaactcctaaaaccttaccttgtgcccagccttgtaagtgcttgctaaataggaattccaccatatgaaaatacattcttttcaagtaactatcattcagacttttgtcccccactttttttttttaaagaaaaataaaaggctgggcacggtggcttacgtctgtaatcccaccattttaggaggccaaggcaggtggatcacctgaggtcaggaattcaagaccagcctgaccaacatggtgaaacctcatctctactaaaaatacaaaaattagccgggcatggtggtgggtgcctgtaatcccagctacttgggaggctcagacaggagaatcgcttgaatctgggaggcagaagttgcagtgagctgagataacgccattgcactccagcctgggggacaagagcgagacttcgtctcaaaaaaaaagagaaagaaaacttcatgttaaagattacaagataaataatcagacccactgatcctaggtcagaaaacagagtcatagctcaatctgacttactatttgctgtatttcatccattctgagatgcacatagtttcacatttcaatgtctctgaaattgagaagcatcttacagtcataattgacagtatattagcagcacctataaatattggctcattttacatttgatggtataatgaagaaaatatttacctttttttctgttttgtttttaagtcacaactcagaagtagatgaaggaaaattctgatcagctgacatcctcttaatgtgagatatttctagtctttattcagtatagattaatggctaattatatgttaaatttcaaagtagtgcttattagtgctttttacttttaagtttcaaaattaacttttttattataataaactccaaatttatacaaaagtagaaaaactagcatactcctgtttatgacccagattcaacaaatactagcacacggccaatcttgcttttttttttttttttttttgagatggagtcttgctctgttgcccaggctggagtgcaatggcacaatttctgctcactgcaacctctgcctcctgagttcaagcgattctcccacttcagcctcccaagtagctgggattacaggtacacaccaccatgcctggctaattcttgtatttttagtagacacgggatttcaccatgtcgtccaggctggccttaaactcctgacctcaagtgatccacctgcctcggcctcccagagtgctgggattacaggcatgagccactgagcccggcccaatctcgttttataatactcccatctcccattctttccactgtcccacctgcaagtttggattattttgtaacaaatctcaatcatcatattattctataaccattttaatatgtgtctctaaaatatattagctttatttttaacatagttaaatgctattgtcataaaataataatcataataattaattgtaattctatatcatcaattatctagttaatgtaaaaaataaatctaaggccaggcgcggtggctcacacctgtaatcccagcactttgggaggctgaggtgggcagatcacctgagatcaggagttcaagaccagcctgaccaacatggagaaaccccatctctactaaaaatacaaaaaattagccaggcgtggtggcgcatgcttgtaatcccagctacttgagaggctgaggcaggagaatcacttgaacccgggaggcgaggttgcggtgagccgagatcgtgccattgcactctagcctgggcaaaaagagtgaaactccatctcaaataaataaataaataaataaataataaaaaataacttaaatctacttaattagaaaaactaacattctaaaaattttattttaagaaatatcaaaattggctgggcacggtggctcacgcctctaatccctgcactttggaaggctgaggtgggcggatcacctgaggtcaggagggtcaggagtacaagaccagcctggccaacatggcgaaaccctgtctccactaaaaatacaaaaattagccaggcatgatgatgggcacctgtaatcccagctactcaggaggctgagacagaagaatcgcttgaacccaggaggtagaggttgcagtgagctgagatcaccccactgcactccagcctgggtgacagagtgaaactccgcctcaaaaaaaaaaaaaagagaaaagaaatatagaaattaaagcatacatggccaggcgtagtggctcatgtctgtaatcccagcactttgggaggctgaggcaggcagatcacttgaggccatgagttcaagaccaacctggccaacatggcgaaagcctgtctctactaaaaatacaaaaaaattagttgggcatggtggtgcacacctgtaatcacagctactttggaggctgaggcaggagaatcgtttgaacccagaggtggaggttgcagtgagccgagattgtgccactgcactctatcctgggtgacagagcgagatactgtctcaaaaagaaaaaaaaaaggctgggcgcggtagttcatgcctgcaatcccagcactttgggaggccgaggcaggcagattacgaagtcaggagatggagaccatcctggctaatacagtgaaaccccgtctctactaaaaaatacacaaaaattagctgggtgtggtggcaggcacctgtagtcccagctactctggaggctgaggcaggagaatggcatgaacccgggaggtggagcttgcagtgagcagagatcacaccactgcactccagtctgggcgacagagcgaggctctgtctcaaaaaaaaaaaagaaagcatactctcacctccttcagtgactgatgttagtattttggcacattctttttctgtgacatatacacacttaccttgtaagtgttgtactcatttcctatgacagtaaatagtctttgtaacaggctgcatgatatttcataaaatgaatggatgtggcataatttatatgtgagccttttgaattctgctattataattaatattgcaatgaacaattcttatattgcctctacacctcaaatgtcttatcatttcttctagtttttctgaggatgtcagattattgggttaaaggatatgaacatttttaaggccttggaacagatttctaaattgctttccagaataattcccatgtgatactttcaccatgtttatttcagacttttttttttttttttttttgagacgaaatctcactctgtcacccaggctggagtgtagtggcatgatctcggctcactgcaacctccgcctcctgagtttaagcgattattctgcctcagcctcccaagtagctgcggttacaggcaagtgcctccatgcctggctaatttttgtgtcttttgtagacatggggtttcaccatgttgcccaggctggtttcgaactcctgagctcaggcaatctgcctacctcggcctcccaaagttctgggattacaggcgtgcaccaccgcgcccagccatcagagtcttttttgtcaaaataaaatggtctaaagacatacatcatagagaaactataatacaaaatttacaggtatatctaagaaaagaaaagtatatttaaagcataaaaataaactgctcttttacttaaaattttttaaaaactggattaaaaatatgaaacttccaacaaattgagcttttttttttttttttttcttttttgagacgaggtctcgcttttgtcacccagtctggagtgcagtggcgcgatctcggctcactgcaacctccacctccctggttcaagcaattcccctgcctcagcctcccaagtagctgggattacaggcgcatgccaccacgtcgggctaatttttttgtatttttagtagagagggggtttcaccatgttggccagactggtctcgaactcctgatctcaggcaatctgccagcctgggtctcccaacatgctgggattacaggcatgagccactgcacccggcctgaactttttatagtagtaacgataattcagtaatgtccaataatgactaagtaagttataacaagtacaatgtcagcaataactagtgctttttagtaaacagggtcaggcaaccttgtacccttttaaaaatgttcgaatatcgatatacctccttcctacttggtggaggattgattgaggaggaaagtgtgcagtgatggttaccagcttcagcctcttggcttgactttgcaaatactggtgagaatttggaaagagcttgagaatatcttacatagtcacatgttgctgagaagagttaagaactaacttcttgatgttcatttttaacaatggcttgcattcaaaaccttgtagagctcattagtaggagctaagaagctaatatttgcctttcactaaaattcctgattacttagcctaggtagttcgttgtctctctaggttctgtctttgggagcttgggtctaaggttatcaagctaactctttcttccctctcacccttcccaaattgaccctggtgctgatttgttattcatacgattttctagtttttcttttccctttttgagtatttgaagcttcatactgaatatagtaatcatagtattcatgcataaagaaaatcataaagtaattgcataaatgcataaagtaatcatagttttcatgcattaaaaaaactagttttggctgggcgctatggctcacgcttgtaatcccagcactttcggaggccaaggcaggcgaatcatctgaggtcaggagttcgagactagcctggccaacatggcgaaacctcttctctactaaaaatacaaaaaaattagccgagtatggtggcgggcgcctgtaatcctagctatttggcaggctgaggcaggagaatcacttgaacctgggaggcagaggttgcagtgagccgaggttgtgccattgcactacagcctaggcgacaagagcaagactccatctcaaaaaaaaaaaaaaaaaaaaaaaaactccctattacagattcataatttatgagtcattaaataatattttcaagccatgacattttttccagcagtagtctctaaatctgttttaccatcataaaaccccaagcaaaactctactacatcagctgtgtcactgtaaaacctgccttaactcacagaagcatgaaattaagcaatgtgtgtgaaactattttataaactgtaaagtattccatacatacatgttggcagttattaatgtcttctctaggtgtggctttgaaatggatgcagatgctttctgttacaaaaaacataagttgcaaatgttctataacaaggagagacacaaatatcttcatggacatggattgctatgagtgtttgattgcctaatacttgagccaccacttcagtgatatggtataatttatcaaacagtgttgagaaacagaaactactggggatgttttaaagaggaaaatacttaatatagaaattaggggtttacataatcttaagaaaggatgaaggtgcagctcttagccaggcctccacagtaccacaaaccaacttgcaggaagagctgtaaccactgccccagttgggacaatgggtaatgaggatattaaatttaagaacatactgctatagcaatgatccttggcatagaaagctgccaccacaattgcctagagatgggaacatgaagtctggcccccattgcaacagcagtgaagcagaattttgggactggcatctcccaaatggctttgcttgccaccagagaacaaccaaagtggagggagatggctaggcctcatttctgcctattttattttattttttgagacggagtcttgtctgtcgcccaggctggagtgcagtagtgtgatctcggctcactgcagcctccgcctcccagcttcaaacaattctcctgcctcagcctcctgagtagctgggattacaggcacccgccactgtgcccagccaattttcttatttttagtagaggtggggttttgccacgttggccaggctggtcttgaactcctgacctcaggtgatctgcccgcctcagcctcccaaagtgttgtgattacaggtatgagccaccatgcctggcccatttctcccttttttttttttttttttttttgaggtggagtctcactctgttgcccagactggagtgcagtggtgcaatcttggcgcattgcaacctctgcctcccagtttcaagcaattcttctgcttcagcctcctgagtagctgggactacaggtgtgtagcaccacacctggctaatttttgtttttgttttgttttttttgagacagagtctcactctgtcacccaggctggagtgtagtggcatgatctgggctcactacaacctccgcctcccgggttcaagcaattctcctgcctcagcctccagagtagctgggattacaggtgtgcgccaacacacctggctaatttttttgtatttttaatagagatggggtttcaccatgttggccaggctggtctcgaactcctgacctcgtgatccgcccgcctcggcctcccaaagtgctgggattacaggcatgagccaccgtgcccagacaaggtttgtatttttagtagagacagttttgccatgttggccaggctggtcttgaactcctcacctcaggtgatccgcctgccttggcctcccaaagtgctgggattacaggcgcaagccactgtgcctgacccgtttctgctttttaaagctcatgtgagcacttaatttgtaaccagaatcctacttgtaaaataatctaagacatgtagcttttagctttgtaacctctataatattgatggcacagtgggagtggatgctgagtaccacttgaacatgttccacctcagtgtcttcacagctggaaggtgtctacattgtttcaaggtggacaattgatttacttctcatttttcataaactaaaagtagaataaaggctattcctctaaaattgctatctcacctgtcactcccttgcattctcacataccttcttgagtggaggggcagagggcatggagtgatagcagatgtgccaggaattctccataactcagtccgtccctcttgtgctatgttgcagcatcaggatttgctaatgggaggatactgcccttacgtgcatcattagccatgcacactaaggtcttacacctacacacaggtcagtattctggctcagagaccaacagggagaaattgcagttctcattagttgaactttctttattgttcacagttttaaaacacaaaattgagaggaactctataaaaaatgtgccattctattaataattgttgctggtaatttaaaaatccttgttccttttcaaattcttatataccttttttttttaaacacttgatcttagccaaaagaccgagaagcaatcttttttttttttttttttttaacctatagcttctcactgagattgtcagctgtttgtaagttttggtttttggttttctgtgtttgtatttacatatatgaaatacagattgagtatcccttatccaaaatgcttaagactggaagtgttttagatttggggttttttaggatttgtgaatatttgcactatacttaccagttaagcattccaaatccaaaatttcaaatctgaagtgttccactgagcacctcttttgagtatcatgttggtgctcaaaaagtttctgattttggagcatttggatttctgattctcggatttaggatgcttgacctgtaatttcagatttacataaaagcagaaatagtacacagagctccttatatccttcacccagattccccaattattggcctttctgaaccatttgggaataatatgcagatatgattttccattatgtctcagttgttcagtgtatattttctaagtacaagaatatattcctacatatttacatgataaccgtcatgtttaaacattttaaaatggggatttgtattacattgtttctctttttgaaaaaattacagaggagcttaatgcaatcagtattacttaaaatctgataatgtgtgttaaatagtagttttcatttatttcatttatcaggtgttcagtgaatgcttactatgtaacagcacagttatcagcactggggaaatagatgagtaagataagatttgcactttcattagcttacatgccataaagagggaaataaagagaacaccagatgatgataagtttatgctgagaattaaaatgaagtgatgaaataatgggaatgtcaggtggctacttttggtgggatggtcaggaaaggcatctctggggagataaattttaagctcagacctgagtgaaaagaatgagccagccatggaaacattatgttaactcacatggtagtttgaaatgctttatctgatcaaaggtacttatttttggtgactttcaacaatattaagggtctataaaccaacactcatttgcataagaataactaccagtgaatctttttgtatgataggttttttgtttgttgtttttttgagacagagtctcgctctgtcgcccaggctggagtgcagtggcgcgatcttggctcactgcaacctctacctccccggttcaagtgattctcctgcctcagcctcccaaagtagctgggattacaggtgcctgccaccacgcctggctaatttttgtatttttagtagagatggggtttcaccgtgttgtccaggctcgtgtcaaacttctgacctcaagccatccacccgcctcggcctcccaaagtgctgggattacaggtgtgagccaccactcctggccatgataggttattttgtgatgaaaatacctacctcttaatttgtctgataaatttaaattttatgtctagatttcctaagatcagcacttccatattttaaagtaatctgtatcagactaactgctcttgcattcttttaataccagtgactactttgattcgtgaaacaatgtattttccttatgaatagtttttctcatggtgtatttattcttttaagttttgttttttaaatatacttcacttttgaatgtttcagacagcagcaaaagcagcaacagcagcagcagcagcagcagcagggggacctatcaggacagagttcacatccatgtgaaaggccagccaccagttcaggagcacttgggagtgatctaggtaaggcctgctcaccattcatcatgttcgctaccttcacactttatctgacatacgagctccatgtgatttttgctttacattattcttcattccctctttaatcatattaagaatcttaagtaaatttgtaatctactaaatttccctggattaaggagcagttaccaaaagaaaaaaaaaaaaaaaagctagatgtggtggctcacatctgtaatcccagcactttgggaaaccaaggcaggagaggattgctagaacatttaatgaatactttaacataataatttaaacttcacagtaatttgtacagtctccaaaaattccttagacatcatggatatttttctttttttgagatggagtcttgctctgtcacccaggctggagtgcagtgtcgcgatctcggctcactgcaagctctgcttcctgggttcatggcattctcctgcctcagcctcctgagtagctgggactacaggcgcccgccacatcgcctggctaattttttgtatttttagtagagacagggtttcaccatgttagccaggatggtctcaatctcctgacctcatgatccgcccgcctcggcctcccaaagtgctgggattacaggcgtgagccatcacgtccggccagaaatcatgaatattagtaggtgaaaaataaacacattttaccacctggaaaatgaaaaatacttgagtataatctaaataacaatgggaagtgcagagttactttccaggtctcggtttaaatatgtcttaaactttggccaattagtagtagaagttgagagaaaaagtaactatctgacaaagaaattataagcagaatatataaagaactcttaaaactgaataatcagaaaacaactcaataaaaaggtgaaggatttgaaaagatatttcaccaaataagacatagggatgacaaataagcacatgaaaagactctcagcatcactagtcacagggaaatgcacgataaaaccacagtgagacaccatggcacccctgtaggtatggctttaatgaagaaataaaactgacaataccaagtgttggcaaggatccaagcagctgagactcatatactgttaatgggaatgtaaaagtgtacagctttggaaaacagtttggcatttttttgataaatgtatacttagccatgtgatccagcagtcccaatcatgtatatataaccaaaagaaaagaaaacttaggttcacataaaaacttatatcaaatgcttatagctgaccaggcatggtggcccatgcctataatcccagcactttgggaggccgaggttggcagatacctgaagtcaagtgttcgagaccagcctggccaacatggcaaaaccctgtctctacttaaaatacaaaaattagccaggcgtgatggcaggcacctgtagtccagctattcaggaggctgaggcaggagaatcacgtgaacccgggaggcagaggttgcagtgagccgagatcgtgccactatactccagcctgggtgacagagcaaaactctgtctcaaaaaaaaaaaaaaaaaaaagggctggacacggtggcttacgcctgttatcccggcactttgggaggccaaggctgatggatcacctgaggtcaggagttcaagaccagcctggccaacatggtgaaaccccatctctactaaaaatacaaaaatttgctgggcatggtggtgggcacctgtaatcccaggaggctgaggcaggagaatcacttgaacccgggaggcggagattgcagtgagccaagattgtgccattgaactccagcctgggtgacaagaccaaaactccttctcaaaaaaaaaaaaagattatagcatctttattcatcattgcccaaaattacaaactgcctaaatgtagaccttcatttagttaatgaatgcacaaactgtggtatatccaaacaattgaataaaaaaaggaatgaactggtacttttttctattcctcctgtttaagtacagccaaaacacctcaacatttgtataaaacatgagctgggctgggtgcggtggctcacacgtgtaatcccagcactttgggaggctgaggcgggtggatcacctaaggttgggagttcaagaccggtctgaccaacatggagaaaccctgtctcaactaaaaatacaagattagtcgggcatggtggcgcatgcctgtaatcccagcttcttgggaggctgaggcaggagaattgcttgatcccgggaagcgaaggttgcagtaagctgagattgcaccattgcactccagcctgggcaacaagagcaaaactctgtctcaaaaagaaaaaaaaaaccattcagctgaatctcaaaggcagagagaagacagactggctagggaccttggaaccagaggagcagtgtggtggggagtggactggattttctttttgcctcatttatcctggacttggtgctggagaagctatgggttcagaccaagagaaaaccccatgaaaagcctgctctctctagccaaaagaggcaacctagcaagataaaaacctttagataataagcacttgactccagtcaaacaaaacagaataaactggccccattcacccctgtcagcaaaggccaagtgggagccaagatatgtaccccaacctggaagtcataaggtacacttctcccctttcccagccaaggtggtgttagagaaggctgactggggagctgggattctcattccctccaggaggtgataacactcctttcacatggtgtcagtggtcacagggaggctgaacttccacccagtaatacataggcatctctctggctcctatatgggtgatgttggagaagaggccgagtagagaatccagactgttgctgacacccagcagtaacaaggacacctccacaatgtccgtggaggccatgtggagatcagtaacaaggcactgctctccctcccagtcagagagatgtcagtggaggactagggggctagaactcccatgtgcgttcagcagtaatccccatgaccgccactccttgacatcacaggccttgaagaaacctggactttcactcccctctggttgtagcgaggtggcactcccttttccctgttgccagtgctgtgtcagtggaggcttgctaaattggaagatgtaaataagattcacattctcataacataataccccaaattttcaggatttaattgaaaatcactaagctgggcatggtggctcacacctgtaatcccagcactttgggaggccaaggtgggccaaacacttaaggtcaggaattcaagaccagcctggccagcatggtgaaaccctgtctctactaaaaatacaaaaattagctgggcgtggtggcacatgcctgtaatcccagctactgggaaggctaaggcaggaaaatcactggaacctgggagacggaggttgcagtgatccaagatcgcactagtgtactgcagcctgggcaacagagcaagactccatctaaatttgtgtcaggattcccagaaggagatgagaaagggtggggctgaaaaaaattgaggaagaagtcatggctgaaaatttcccaaatttggcaaaagtcagaaacctacagattgaaaaagctgaatgaagctcaaatatgataaactcaaagaagttcacacagagacacatcacagtcagatttctgaacactgcagacaaaaaatgaagatctcgaaattagcaagaaatgaccttacctaagcaatttgaatgacagcagatttcccatcagagatcataaaggccagaaggaaggggtacatacaacattttttctagtgctgaaagacaaaaactctaggctgggcacggtggcacacacctgtaatcccagcacttttggaggctgaggcaggcagatcacctgaagtcaggagttcgagaccagcctggccaacatggggaaaccctgtctctactaaaaatacaaaaattagccaggtgtggtggcacgcacctataatcctagctacttgggaggctgaggcaggggaatcgcttgaacctgggaggcgacggttgcagtgagccaaggtcgcgccactgcactccagcctgggcagttgagcgagactccatctcaaaaaaaaaaaaattatccaggcttggtggtgggcgcctatagtcccagctacttgggaggctgaggcaagagaattggttgaacccaggaggtggaggttgcagtgagccaagctcatgccactgtactccagcctgggtgacagagcgagaccttgtctcaaaaaaaaaaaaaaaaaaaaaaccaagaaaaaaactctaaacccagagttacatatccagtgaaatatccttcaggagtgaagggaaaattaacgatttgtcttcaggagacctaccctaaaagaatggctaaaggaatttctctaaacagaaaagaaatgataaaagaagtaattttggaacatcaggaaggaagaaagaacaataaaaagagtaaaatatgggtaaacacaatagactttcccctccttttgaattttctaaattgtatgatggttgaagcaagaattatagcactgatttggttttcagtatatatattggaaatatttaaggcattatgttacagatgaaggagggtcaaaggatataaagggaggtaacctttctatatttcttttgtactgatgcaggcactttggaaaataatttcactatttgtttaaaaactgaacataccctgaccatatgacatagcatctatactcctgggcatttatcccagagaaacagaaatttatttattttttttttagtattacactccgtaagtgctgtaatactagcacttagggaggctgaggcaagcagattgcttgagcccaggagttcaagaccagcctgggcaatgctgcacagtcaaaaaagaaaaacaaacatttagaaaactattttaaaagtctttaattgctgaatgcctctttggctaatatttggaagatcattattattatttttcttttttaggcagagtcttgctctgtcactgaggctggagtgcagtggcgccatctcggcttactgcaacctctgcctcccgggttcacgccattctcctgcctcagcctcccgagtagctgggactacaggcgtgtgccaccatgcccggctaattttttgtgtttttagtagagatggggtttcactatgttagtcaggatggtctccatctcctaacctcgtgatccgcccacctcggcttcccaaaatgctgggattacaggcgtgagccactgtgcccagcctggaagatcattatttagtcctacaactgacacattgttccactgacgcaattgcccaggctggtcttgaactcctgggctcaagcaatctgcctgcctcggcctccctaagtgctagtattacaggcttgagccactgtgcccagccaaaaatagaaatttatattctcacaaaaacatgtacatgaatgtttatagcagctttacttgtcataatcaaaaactggaaacaaccaaaatgtcctacagtgaaacaaactgtagtacatccatagcatgtaatactctactgtcaggattaaaaagaaacccactgttggcacaggcagcaccgtggctggatctcaggggcattatgctgagtgcaaaaaagcctcaaagggtcttacactgtatgattccacttgttcaactaaaaatgacagctgtatagagatagagaacatattagtggtttccactagttagagaaagtgggtaaaagataggtgggtgggaatataaatcgatagcagggagatctttgtggtattataacacttctatgtcttgattgtagtggtggtggttacatgaatacacgtgtgataaaatgccatgtagaactacatataacgttgtgccaatgtcaatatctaggttttagtttgatctttagttacataagatgtaactattgggtgaaattgggcaaaagagtacacgaaacctctcttaaatatctttacaacttcctttgaattgacagtttttcaaaatagaaagttgggtttttgtaaatacatgaattgttgatatacacaacaaatctcaaatgcattatgctacgtgaaagaagccatattcaaaaggctacatacctactgatgccttttatatgacgtgcaggaaaagataaaactgtaggacagagaatatactggtggctatctgggattaggaaatggggatcgaccacaaaggggcagcatgggggaattttctggggcaatggaatggttgtgtatcttgatggtgtatttgtcaaaatatatagaactataaaagtaaattttgctttatatgtattaaatcaaaaaaagaaactcgtgctcaaatagaaatacattttctgagaacttgccttttgatgactttgagaattttctggaaattttaaagaaatgtggttttgtttcccaacaggtgatgctatgagtgaagaagacatgcttcaggcagctgtgaccatgtctttagaaactgtcagaaatgatttgaaaacagaaggaaaaaaataatacctttaaaaaataatttagatattcatactttccaacattatcctgtgtgattacagcatagggtccactttggtaatgtgtcaaagagatgaggaaataagacttttagcggtttgcaaacaaaatgatgggaaagtggaacaatgcgtcggttgtaggactaaataatgatcttccaaatattagccaaagaggcattcagcaattaaagacatttaaaatagttttctaaatgtttctttttcttttttgagtgtgcaatatgtaacatgtctaaagttagggcatttttcttggatctttttgcagactagctaattagctctcgcctcaggctttttccatatagtttgttttctttttctgtcttgtaggtaagttggctcacatcatgtaatagtggctttcatttcttattaaccaaattaacctttcaggaaagtatctctactttcctgatgttgataatagtaatggttctagaaggatgaacagttctcccttcaactgtataccgtgtgctccagtgttttcttgtgttgttttctctgatcacaacttttctgctacctggttttcattattttcccacaattcttttgaaagatggtaatcttttctgaggtttagcgttttaagccctacgatgggatcattatttcatgactggtgcgttcctaaactctgaaatcagccttgcacaagtacttgagaataaatgagcattttttaaaatgtgtgagcatgtgctttcccagatgctttatgaatgtcttttcacttatatcaaaaccttacagctttgttgcaaccccttcttcctgcgccttattttttcctttcttctccaattgagaaaactaggagaagcatagtatgcaggcaagtctccttctgttagaagactaaacatacgtacccaccatgaatgtatgatacatgaaatttggccttcaattttaatagcagttttattttattttttctcctatgactggagctttgtgttctctttacagttgagtcatggaatgtaggtgtctgcttcacatcttttagtaggtatagcttgtcaaagatggtgatctggaacatgaaaataatttactaatgaaaatatgtttaaatttatactgtgatttgacacttgcatcatgtttagatagcttaagaacaatggaagtcacagtacttagtggatctataaataagaaagtccatagttttgataaatattctctttaattgagatgtacagagagtttcttgctgggtcaataggatagtatcattttggtgaaaaccatgtctctgaaattgatgttttagtttcagtgttccctatccctcattctccatctccttttgaagctcttttgaatgttgaattgttcataagctaaaatccaagaaatttcagctgacaacttcgaaaattataatatggtatattgccctcctggtgtgtggctgcacacattttatcagggaaagttttttgatctaggatttattgctaactaactgaaaagagaagaaaaaatatcttttatttatgattataaaatagctttttcttcgatataacagattttttaagtcattattttgtgccaatcagttttctgaagtttcccttacacaaaaggatagctttattttaaaatctaaagtttcttttaatagttaaaaatgtttcagaagaattataaaactttaaaactgcaagggatgttggagtttagtactactccctcaagatttaaaaagctaaatattttaagactgaacatttatgttaattattaccagtgtgtttgtcatattttccatggatatttgttcattacctttttccattgaaaagttacattaaacttttcatacacttgaattgatgagctacctaatataaaaatgagaaaaccaatatgcattttaaagttttaactttagagtttataaagttcatatataccctagttaaagcacttaagaaaatatggcatgtttgacttttagttcctagagagtttttgtttttgtttttgtttttttttgagacggagtcttgctatgtctcccaggctggagggcagtggcatgatctcggctcactacaacttccacctcccgggttcaagcaattctcctgcctcagcctccagagtagctgggattacaggcgcccaccaccacacccggcagatttttgtatttttggtagagacgcggtttcatcatgtttggccaggctggtctcgaactcctgacctcaggtgatccgcctgccttggcctcccaaagtgttgggattacaggcatgagccactgcgcctggccagctagagagtttttaaagcagagctgagcacacactggatgcgtttgaatgtgtttgtgtagtttgttgtgaaattgttacatttagcaggcagatccagaagcactagtgaactgtcatcttggtggggttggcttaaatttaattgactgtttagattccatttcttaattgattggccagtatgaaaagatgccagtgcaagtaaccatagtatcaaaaaagttaaaaattattcaaagctatagtttatacatcaggtactgccatttactgtaaaccacctgcaagaaagtcaggaacaactaaattcacaagaactgtcctgctaagaagtgtattaaagatttccattttgttttactaattgggaacatcttaatgtttaatatt

SEQ ID NO: 13038 - DNA, 47030 bp, Human; identical to SEQ ID NO: 13037

SEQ ID NO: 13039 - DNA, 178884 bp, Human
catttaaagtcgatgcctgtaatccctactgctgacttcaagtatcaagtttatagttgctgcccccatccccttcgtttttactcccttagccgccttctttttttttttttttttttgagacggagtctcactctgttgcccaggctagagtgcagtggcacgatctcagctcactgccagctctgcctcccaggttcacgccattctcctgccttagcctcccaagtagctgggactacaggcgcccgccaccacgcccggctaattttttgtatttttagtagagacagggtttcaccgtgttagccaggatgatctcaatctcctgacctcatgatgtgcccacctcggcctcccaaagtgctgggattacaggcatgagccaccatgcgcagcctcccttagccttcttttatccatcttgtgcctcggccctaggggtccttgctatgatcttccctttatccagctttccatgtcccccccaggagccaggcattctaagccacagagctgaccctggaacctgtcaccacttaccttctaggctcccatggcctatgaaactcgcagtacccttgcctaaggcatgcagtgcccgtccctagctggccccctggaggagtcctgtttcccacccatcgtcttttccactctccatccatccgttttctctaccttgttaaagaaaaaaactaatcagattctcgttaaagatggcagggaagccaggcggggtggctcaggtctacaatcccagcactttgggaggcccaggtgggaggacagcttgaggccaggagttcgagacctgcctgggcaacacagtgtagtcccagctgctcgggaggctgaggtgggaggatcagtttagcaggggtgttcgaggctgcagtgagctatgactgcaccattgcactccagcctgggcagcatagagagatccttgtcttttttttttgagacggagtttcttaatgtaggccggccagggtgatcacataccaagcgtggagatattcttgacagcaggattctggctaaaactggactaagaaggccaaggacagagcccaaggtcggggcctggtcagaaagaggtctcggaggagcctgactcaagtgtgatcaagggaagtcttggtcacccgctggcaacttggctttttcttgtctcccagcctcaattcaagctcatcccccttccctgctccatcaaaatctccttgatttccaaggccagcttcagtgtctcctctcaaacttttctgagccttccctccacgggaatccatttttcctgcctgggcctggggagagaagtccatttctccttcccaaacccagagaccattgaggcaggaaagctccctggctgccccatagggcagggcagggtaggcggggtttagtgactccccggcgccgacgctgacccgcacccctgaggaaggggtctccggggacggccgctgttgtcgctgtcgcctccagtccccgccccttcccccctcagtgaaggggacctagagtgagaactggtggtcacgtcctacgcctaggagggcccctgggtgttcacccacccccccgggggccccatcctgggccagggtccgcttcctcgagggaaggggcgaattcctggaaggtctccttccgggcgcagttgcaatggattgccttgggggtgctgaaccctgctgggggtacagagacgtttccgaaactcagcggctcggtcgcccccaaaggccaggcggaacacacgcccacaccgcggctcccttcccgaagtaagaccgccgggccacggccgcccccaggaagccccgcgccccgcaccccacacccggggacacaaacaggcgccgggtagccgcgagggccggcgcggcgcctttaagaggcggcgggcggcgctgccccctggcggccgccccgccgcttcctcgccgccgcgggctcaagcggggcggccgggccagcgcggggcggcggcgggcaggggcggcgagtgcgcgggcgctcgccgccgcccttctcggcgggcagcgcgcgaggaccaggccgaggaggaagtggcggcggcggcggcgggtgaggatctctggccgggccgagtggccgcgtgcgccccgccggggtccaagcgcgcccaggggttacggcccggctgggaacatcagagggcgaggacccgggcgggaggaggagggaggaagggctcggaggccgcgcttctgccgccgcctgagggcgtgtggctcgggcccgcgcggcgggagggcgggcagggcgggggcggtgtctgcggaggcccggcttcccctcctgcgggccctggccccagctccgactcagactcaggctcagccgtgccccagcctcagccggcaggccgggcggcgcggcgctcgcgagccggtgggcgggcgggcgagcccgcaggcggcgggggcgtgggcggtggcagcttggcccagccagtggccttccgcgctgagcgccgctccctcctcccggccgcccgccgcgccccgctcacgctcgctccgcgcggcaggactgcgcgccccagctccgatccccgttccgcgtccccgccgccgggaggaggtgcccactcgctcgcggcgcgcgccggccgccagactcggcctgtgggcgatttcctccggacccaggctccccgcccgaggaggaagatgcagacctttctgaaagggaagagagttggctactggctgagcgagaagaaaatcaagaagctgaatttccaggccttcgccgagctgtgcaggtaaggagggacgcggcgccggcgcccggggacccccggcccgagcccggtgacccccggcccgagcccggtgcagcctcattagttgttttgggagatcggagccaaacgggaagaagcggcgcgcggggagactgagtccgagcagccaggtggcggtggcggccgccggccgcgttccagggaagcggtggccggtgcgggcgaggtggcacggaccggggcgttcaggtgcactgtgacccggctggggaggcccccagcagcccagggcgcggtgggagtgctactgagggttgcggagggacctgggaaatcggggcatccacgctgtggggtaagggcttgagggtacttttggaccggagtgtttttcttccttcgtccccttccctttcatgaagaaagggcacccacgtttgtggaccacctactatgtgccccgcgtgtgctcggctcttgaggctgtcattgcatatcatgaggttaagcccagttgaagcgagtagcaattcttggcatgtatgtggtgatttgctgtctcattagagcctcgcagcagccctgcaaattggccagggtggtgattctgggccacctgtctgagaacggggaccgatcggcagaggagcggggtacctagcttggggtcccgcagctagggagtggctggtgcgtagaaagtgctgggtaaatgcccgtggtgtggagtggccttctgccatctgggctgtgtgcccctgctcccaccatgctggtgctccttggcggagtctccggtgtttaacagatcacgttcttaataaattacagaactactgagtcttgggtcaggtaggccttcccttgctccacaactgtagctttgcctctgagaagcagttaagcccttttctcaatgcaagcctaagagaatctagctctgaaagccttttgcaaactccaggtggaaaccttttgtgatgcagcttgttagactgatttttgaaaatgggctctacttgcatttttgtccctgtgggggccccacacatcttggagaattgaacagttgggtttccgtaacccctggtgctcctgggggcccgtggctggtctgagctggcatgcgcaggtgagcctggcagcacctctgtgtgcctcatgcctttcccaagggcctgctgctcctttgccccgtgcaagccccgcaggcgctcttcctgcagccagaggggcacagcttgtacaggatagtgcctggttctttatcccttggtctggggatggggttggctgccttctcccaggccggtttccctagaagacaggctcttcatgatcaatagggcatgcagagtggccccagcaattcatgaagaaatcaggaggagctcgaagccagagctttgaaaatgagtcttaggacccttggaacattacaaaagggtacttgaacgttgtaccgcggatacactcacttgtgggaagggcattctaagacactaaagaaatttggagcagctgctttggcatgttctcgaagtccagttctgatgtgaggcaccggagctccccctgcagtcatgtaagacttgggaaatcccagcgaatacctcgcaccctttgtactgctgtctgtatttatgtcatcttgtgtctgcaactcaagcttgaggcttgtcattgggttggcttgttttgcttggtaattaggaggctctcgcaaaatattcttcgccgagactcacaactaggtcctcgtgctggacctgcagattggcttgaccttgtagacattcttcctttaaaggggtgggaggttcagagcaagctatgctatcaacgttctggggagtagagcattactttctctgaaagagttgttgtcttcaaagtctagttgccttcctttggccaaaatattggcttcaaagaaggcagaagtcatcagggccattctagaacccgagaaagcccactttgtgttttcactagggaagctttagatattttatcacttaagcctaagaaggaaaagaaaacaccaaagagtttttccgtttcttatttattactttcagggcagtgccccctggtggccacatttctatactggctgcaaaatgctgcaactgttgagccagtgaccagggagccccgtgaggttgttttgtttggtgtgagggccaatgagactttagtggctgagagacagtgcaaaggacattatcatgttttccacattcagaatctgggggcgcagggcttctgtactgacgacgggtgatgaattgtctatgaattccctaatgaaaaagtctaaaggtatttgaaaatggccctgctttgggccgggtgccgtgtcttctgtctgtaatcccagcactttgggagtccaaggtgggtgggtcacgaggtcaggagatcgagaccatcctggctaacatggtgaaaccccatctctactaaaaatacaaaaattagccgggcatgatggcaggcgcctgtagtcccagctactcaggaggctgaggcaggagaatcacttgaacccgggaggcagaggttgcagtaagtcgagatggtgccactgcactctagcttgggtgacagagcgagactccatctcaaaaaaaaaaaaaaaaaaaatggccctgctcttaatgtttgggcaaagaatgacccgaatggtccggcccggggtgggttgtttagctgaatgtccggccttgtaaaaatctgatctcagagcaggaagagatgttggccatcatctcatctagcccctttgtcttacagatggggaaacccatcaagagagggggcaggttccggactcttggtcttttcctttaacttctagaatgggtccaacctggctaccttgagattgcctttctgattgggcatctccgacaataaggcagtctccctcattatctttccaggggtctggtggctgctatttagcccccaggacacattccttgcaaagctgagcccctctgcaagtgtaatccttgtcttggggggagggtttggggggtagtgcacgttgatggcaacagtgggtggttagagccacttcatgggccatgaagtgccccacctgccgtaggtagggacaggcgccagccttttcagatgtgcactctgataggatggggctctgctagccagcagatgggcctttgaatccacttgtttgtcagtggtactgtttgttcctgttgccatcctgtttcttcccctttctctggggacacggctctggttgtgttctcttgtacccctcccacctgccttccctagcctgggagcaaccttgtaggtctcccacaccaccccctctttgtggctttttttttttttttttgaggtggagtctcgctttgtcgcccagcctggagtgcagtggcgcaatctcggctcactgcaacctccgcctcccaggttcaagctattctcctgcctcagcctcctgagtagctgggattacaggtgcgcaccaccacgcctggctaatttttgtatttttagtggagatggagttttaccatgttgtccaggctggtctcgaactcctgacctcaggtgatccgcctgccttgccctcccagagtgctgggattacaggcattcctggcctttgtggctttttctagatgctcagaaggggcttcagagggggagtgaagaaattaaagctgttagttggaaatactgggtgatattaatttaattttaaattttgtagttctgtacagtgcctcactggggaatactggctggccccagtttcctcagctcatgttttctgtgcctcctcctctcctcctctctgtcccattctttctgtggctgaacctacgttgcaggaggtgggggcggaagaggcacatgacttggtgaagctttccatataaaatttgggtgaaccttatctgtctttactgtaataattgctgatttttaatgaagtgcttccagggacctcatctcatttaatccttccagcagcccagggatggagggatgagggatggagggatgagggatggagggatgagggatgagggatgaggacatccctcgttgggatggagggatgaggaaacagaggctccgggagtctataggacctgcacagccagctagagggctttcttgagtccactcctgaggcctttgcgctgagaatgtggcttcccttgtttatttgcccaggttaggctggggcttccaggaggctacagaagcacaagaatgtctgtgagtttctcatcctccagagacttggaggccagctgggctgacttggcttgcaagaaacgtgtttctggagcagtctcagaccttggtatcccaccagggacccttttgtcccaataccttagaagggactgaggagttcattaatgttcacgtttatgaccacccttggtaggtagcccaggcctgcatctgctctcatgggtctgggagtttggtgtcaacagtaaactggcttgggaggcgtgccagtgagagtgtagcatgccaccgggcctgtcccttccccttgggccctacatttgttcctttaaaatagggccatctccaaggtccttttctacagggatggcttagcattctggtctggaattctttcgggagattctctgcagggaggaaggaggatcttttccaggattaagtgatgctggtctgtgggtgggtatttttttatttgttttaatgtctggatttgccaccatttcgggggtgcagaggtgggaagaggtgctgacttaggttttctttgcagcagtgcacagggagtattcataacccagccttgcaaatgaacactttctaccagcctcctggggagcaaacagaacttcacataggaggaagcgtccgtgtgcacatggatctattgaagggactgcctcagtttcaggcctgactccacgactgactgcctatgtgccccatgaccctcgacacattccctacccctctgtgcctcactttcctcatctgtgagggtaataatttagcttagggttgcgagcatcaaatgagggaatttgctaaagggtccaggatagtgcctggaattctgtcagtggcggcggccgctgctgtcgtcgtccctgtggagtgagtgagtgggtctctgcccatggatgcctctctattcagggacctttggcctttgtagatttagtgttcttggttttggcagtttgcaagtcaccctgaaggccacgatggctgaactgatcatcttgcagggatgtgggtttgaggatttgaaactgttcagtgggcatagctaaggagggggcccaggcttgcctggtggcctttcagcatcacagcggggttctgttctccttcagcacatggcccatctgaatattacagccccccaggaggtggaggtgctgtccccacctactttatggatggggaagctgagaaatttatgttaagatgctacttgtatttttttaagtttggagattgagaagagtttgttctggatttcctgaaaatgccaagtctccactggtaatcttgttactattactagctaacatttattgttttctgtatctttttgaatatttaagacatgcacatattaaaaaaaattcagaggactcaaagtatacaatgaaacgtcagccctgttcgcttctcattgctgagttccagttccctggggcagtctgtctctataggtgtttatgcacactcaggggcgcgtgcacgtgtaggtctctccatatgtattactgttgtgctcttgcacattgcatgggactgtgtgtcttggagaaactccacatcgctgcttcatttggagaaagttttgtatcattacctctttttttttaaacagctgtgtggtccagttcttaaaaggatggaacatgtttcttccgctggtgttggtttctgctggtatgggcagcatgacaataccccgtccccttgcctgggtgtacattgctagatgaggagggctgggtcagagggcacaggcattttactttttcatactttttgtgtgtatgtgtgagacagagtctccctctgtcgcctagactggagtgcagtggcacgatcttggctcaccgcaacctccgcctcctgggttcaagtgattctcctgtcttagcctcccgagtagctggaactacagtcatgcaccaccacacctggctaatttttctatttttagtagagactgggtttcgccatcttggccaggttggtttcgaactcctggcctcaattgatctgcccacctcggcctcccaaagtgctgggattacaggtgtgagccactacgcccagctttttcatacatgttctgaaactgctcacaaagaaatttcaatatgtcagtcccaatgacagtgaatgggagagcctgtgctgcgcaccctcctgcgctcagggccgggacaaatctgtgggtgagatggtcctctggattcatatttcacctagtgagatagtgagattgaggagtttaggttgctgggggctgactgcaggcacctggaagagctgggtgcacctgcatggcaggatgggcatcaatgtttctaaccactgggccatcctgcctttaccggttatttctcccacatggtttagcaggtttgggacattcagtaaatacttaaagtcaagtgccccatgagcacagttcctgaacagctggatgtaaatagggtttcagttcccactcattttgaattcagctggaaagctacatttgagagaatactatgacacttcccttttaaaaagtagcattcattttaggaagcaaagcattcaagagctgtgcacctccttctttccctcgcaaagtcactgtcttaaacaccttccccatcctgcatgaattgggcccagcccagcctctcccactctggtggcccttggggagccggcccgggtgtgtgtggccttgctctggagagggtgtgggactcccgagaactggcccatggtcacacagtggaaatgtgggaggggaacttgcctcgctccaagccgagtgctccccactcaccactggccaaagcctccttgtgaacaggcctttcctcccggctgcggcccacggtgtgtattagagtggccaggccatacctgtggggccctttgagtctttctggggcttcgtcttgctgctctgagcctgctcagaaagcagctgcccttgtggcctgcatctccccagcagagcctcatgggctggtttctgtaggcccatcctctggatggcccctgggagtgctcccacagccatttttagggttcggtggggtggatctgagattcgtgtcagagatcccgtggagccgtggagcgtcaagaatcactctcacaagggagctccagactccagaccccgctccgcatccccccacccctccaggcccttgagtgctgggtgccccaccctgttaattgctcatgatgttccagggcacacctgtggcagaggccacctgcagactcagctgccccagagggtgaatcgggacccacaggccaaaggccctcccagacagcttcagggagatgtcttcgttccaaacctctctcgccgtcagaatcttcactgatacttaggcccccaccactgggcctgttcttcctctctgacttgctcattgtcctgcttattttaagtctgtcttgtttttaagtagttggttctatgaaggtagagattttggcagctttatttactgctgaaaccccagtgcctataccagtgcacataggagctcaaaaaagaatctgttagtggctgggtgtgatggcttacacctgtaatcccagcactttgggaggctgaggcgggcagattgcttgaggtcaggagttcaagaccagcctgggcaacatggtgaatacctatctctactaaaaatacaaaaattagcagggcatggtggcaggtgcttgttatcccagctacttgggacgctgaggcaggagaattgcttgagctcgggaggtggagattgcagtgagccaagattgcaccattgcactccagcctgggtgacagagctggactctgtctcaaaaaaaaaaagtatgttagtggatcaataactgcctggtggtttttggaagcctttttcatgtccctatggctcagccaaagccacttgtgactctggaatgctctgggccaggaaggaaaccccaggggtgggggagatggggagagagttaggtggtaagtcccaggttccggaggggcttgtgggcaagtcctgagcatctgccctggccaggcctgtgctgggtgctggtccttgccggcatgtacacctgcaggaggtgaaggcaaaccagctctcagatgcactggaaatgctgcaaggtgtgactagagccaggaaacctgcaaacaggagagaactatggcgcagtggctgcagccactttagcactctgtggtcagagaaggcctctctaaggaggcgacattcagcaagaggggcctagagctctctccaggagctaaaggacccacagggtgggcggtgtccactttgtagaggccacacaccctggcctctaccataagccttataagcctctgccataagccctgggttccatgtggattggagggcaggcagctctgggcagaactgaggccggtttccaccttagacagggtggttcaaggaggtgtcggggtgtccttctagagccttgtttcctgacagtgtgaccttcctcccatccgagggaggctgcagttatgccctcggggccagggataggaagacaaaatgctccccgtgggtctggttcagtccagcctttgtgttctggaaatgagccgctctgggctgtggggtggtggggtggatggggtggtagtgggtgggtcagctgacctttctcaagaatcaggttaggtctcaggtgcccaagggagccgagggaagccgcgcctgacctgtgtgctctttggcagtcatcgatcttcctccaagttacttgtttgccaaacttgcccaacaaaagagacaccaggggatgggcgtggtggctcacgcctataatcccagcactttgggaggctgaggcgggcggatcacctgaggtcaggagttcaagaccagcttggccaacatggtgaaacccagtctctactaaaaatacaaaaaatcagctgggtgtggtgactggcacctgtaatcccagctgctcgggaggctgaggcaggagaaacgcttgaacccgggaggtggatgttgcagtgagccgagatcgcgccactgtactccagcctgggtgacatgagtgaaactctgtctcaaaaaaaaaaaaaaaaaaccccacaaaaattagccaggcgtggtggtgggtgcctgtaatcccagctactactcggcaggctgaggtgggagaatcgcttgaactcaggaggcggaggttgtggtgagccgagattgcgtcactgcagtccagcctggtgacagagcaagactccgtctccaaaaaaaaaaaaaaaaagctccaggggcactggggagaagggagaagtacacatcctgaagtctcccttccctgtgagatgaagattctcctgggaagggggctggggagctccttgtgaagtaccctgatgatttttatgggaaactactcactgtcatttcatgaagtgcctcagaagaccttaccccaaaactgtcaggcgtggggaagcaccgagttagccaaggctgaagcagtgtgtttcagacttctcaggggcaggtcccctccaggaggtttgctggagccagaggttcccaggctggctcctgggtctctgtaccctgagctcactgtgggaatctccagtctggcaccgttcacctgaggcctcactggagccccctcatgcaggagggagacatggcaggggcaccaggtcgtcagcccagcccagttctacctgctgttgctaccttttgccaaattccttctcaaaagaagccttttcagatttcttgcctctggctgctggtttgcccggagtgtatagaaaggagctagttttgcacaagagacattcctgggaccgatctggccagatagacacttgtggcgttttcctcagcagtttacgctgcaaacccatggactcctcagcaaccattcttattagcctggggtcactctgggcgctcttggagcccaagccagaaactgggactctgggtttgttcaggcggcctgctgtgctttggcagggctgtgttgcttcctctctgcccccttgtacattcatggctcatgccagatctcagaggatcctgagaacctaccatgggggtcaggcactattgcagatgggataactaccctccaggatggctgaggggtctccatttgctagatgagggccctgagactcagggagaggccaggtgctgtgagcagcacagcttggattcaccctcagggatgggtgactcctgaaaccatgctgtttccactccgccaggttgcctttgtcttcaacacagcatccagctgccgtcgatcgatgtcaggaaaatcaaggagttctgttctttttttttttgagatggagtttcgctattgtcacccaggccggagtgcaaggtgtgatctttgttcactgcaacctccacctcagcctccccagtagctgggattacaggcacccaccatcacacccagcgaatttttgtatttttagtggagaagatggggtttcaccatgttggccaggctagtctcaaactcctgacctcaggtgatctgctcaacttggcctcacaaaatgctgggattacaagtgtgagcgaccgcgccctgcctcaaggggttcttttctgagcatcctttgtgtgcagttgttgggcccaggaggatagtgcatggtggagatggcagtgaagttggagcatgagacttgtcctgagcctctgccctcccaactgtaaggtgggtgcagtgcacccgccctagggccaaatgataggattccccctccacccaagaggccacctcacctgccctcctacccgcccaaggcagggcctggggcctctgacacatctctgctgggagctgccacccatctttttctgggggatcctccagtggtcagcttgctgcttcctgggcagggcggggcatggtagatgggtgcagagagaaccctcctgtggcagtttcactttcatttctgcctcacaccctgtttccatccaacagtcaagggctgggctgcggaggtgaggaaacatccggtctccaccctggggtacttgtcctagtgcaggttcccaggcctccccctcccctggaatgaatctggggtgggccgtggcatcttctttttaaaaaacaccccattcattcctttatgcacttacatgccacatacttactgagtgcctgctgtatgctgggcactcctgggttctggggattgatacagcagtgagcaccacagtctcctggagccccagggtcagtcttagggagagcttcagggcagttgtctcaccactgggagctcttgcccacagtgtgctgggtcacgtacctctcagggtcctgggctcgtgagtttcttcttcttcttattttttttttgagatggagacggagtcttgctctattgcccaggctggagtgcagtggtgcaatctcactgcaacctctgcctcccgggttcaagcgattctcctgcctcagcctcctgagtagctgggattacaagcacgcgccaccacgcccggctaatttttgtatttttagtagagatggggtttcactgtgttggtcaggctggtcttgaactcgtgatctgcccgtctcagcctcccaaagtgctgggattacaggcgtaagccaccatgcccggccctatttttctttttttctttctttctttctttttttttttttttttttgagatggagtcttgctttgtcgcccaggctggagtgcagtggcgcgatcttggctcactgcaagctccgcctcccaggttcatgccattcttctgcctcagcctcccgagtagctgggactacaggcgcctgccaccatgcccggctaattttttgtatttttagtagagacagggtttcaccgtgttagccaggatggtctcgatctcctgaccttgtgatccgcccacctcggcctcccaaagtgctgggatgacaggcgtgagccaccactcccagacttgtttctgtcttttttgccgttgttgtagagacagggtttcactgtgttggccaggtttggctgtaactcctgagcttgatcgatcgcccgtctcagcctcccgaagtgttgggattataggcttgagccactgtgcctagccagcctattttctttttcttttttgttagtcttgctctgtcatccaggttggagtgcagtggtgtgatcttggctcactgcaacctccacctcccaggtttaagtgattctcggacctcaggtgatccttccacctcagcctcccaaagagttgggattacaggtgtgagccaccacgcccagcccagcctattttctttaagattttaaagtcctaacattcgtcatgggatccttgaaaagaaaaggaattatggccttgccactagaggcctttgccgcctccctgcaggaaggtgtgtcccgcggcattgggatcgtgttggagaaaggttttgcttcctgcacagtcagctcccaagcaccctttttatcaccttgacctgggcgcagccaagccgtggcctgtgcttgcggagatttgggtgccccatcctctcgctgctctggggaagcctgtagctgtggagaggccagtccaggccccagcttctgacctttgtctacatatcaggaggagccctcctggtgaggaatgtgcctcgttcttttgggggagctgacgaggtgcctgtagtgtggagggttaggggcaggggagtccctccagaaatgcacttaagcttgcagagtcaccctgccctgcattgttaagtggtataaggacagttagctccagaaacagcagtggctcctgtctctggagctctagcttcatgcctgacatggtgctgagcgctaacatgtggctctttgaagctgtcagtccgtatgtggagactgaggctcagagagggtaagtgactttcccggggtttcatagccgatcaccctgggggtggggttcaaacatcagtttgcacagtgccgcgatctcaggtcactgcaacctccacctcctggattcaagcgattctcctgcctcagccttccgagtagctggagtcacaagcgcacgcctccacgcccagctaattttttgtatttttagtagagatggggttttgccacattggccaggctggtctcgaactcctgacctcaaatgatccacttggcttggcttcccaaagtgctggcattacaggcgtgaaccaccgtgcccggcctcggcttcttactaggtggatgactgtgggtgtgtttcagctcctctctgggccttaatttccttgtcagtaagaggtgaccttgtgctcatgcataggagggggtcagcacatgcaaacttcccttctgtgcagggcagaggccatctctggaaggaagaagggggaaagtggccccttactcacctgtgtcaggtggtatcagagtaaacctccacagagtccagaggtacagagattcacgatcttagaggagtaacttttgaaaacctttgagccagaagaggcctttgcgtgtaagggtttgcagctcagagtggctggccttgcagggtcacacatgtagagctttgggctgacagcttcgcagcccagaagtacacctgtggcctccagggaacctctaggagtgtgaagaggcgagggtgtgttctgttctgggccatgattggtggaccccatcccggccaggatgagttatttttgttgatgggccctgtggtctctcctaaccttgctgggaatgtgacaggaaccaattctttggatttgggatgctctcctgggaaggatgggggagtgagtgggtgccccttccctgacgcagccatctgggacgtgggcagttctgtgagtgcttctgcatgtgcttcaggctgggaccccctggacagtgagacctatggagtgggccacatggctgcaaatctgtttccattgctgtgtgctccagtcctctcactctcaattaaccaacagatgtgatgagtcattggggtctcgtcagctaatgatctgagcagtaagtcgattgtatggctgattcctagagccacaggggtggatgggttctgacaggagcctcagtgctgagcgggttcggtaataaaggggatgtattggttcctgagtcagatccttggggcattctggcttcaggtgtaggtagactcaggcgacagtccaatagggcctggtctgtctgtctgtctgtctctctctctctctgtctctctctctctctctctccctcctctctccccccggccccctccctgcttccctggtctcttttacattggcttcattctcaggcccatgtggtgcaaggtgagtcctcaccctcaatccttattctcagccaggcactgtggcgttccttaggtgtgtgatctcatttgatccgcattaacagccctgggagggtggtggttttagcattcctgtttctcatagaagggctaagtaacttgcctggggtcacacagctggtaggggcagagctgggattcagagctggttgggttggctccagggtcccccatccctcatgctccaggtccacagggacagggattccttctgttggcctctgatttgtcatcctgggccacatacctgtctctgaaccagtctctggggctggggaatgcagcgcctcattcccttctacatggcctgagtgtgggcagggtggatccccaaaaggatgctgcaggggcactgtttcccagaggcaggggagggatgtttggcagctgaggtgggagtggacgtgctccctgtttctgggcttcagtggctggccagagtgaggctgggggctgctctccctcagcttccagctctggacccagcttgcaaagacttggacgggggcctgagggttcgcacacagagtccagggctaggacgttgttcccaagaagggagtggagagtacctacccccacaagtctgagccccaggctggcctaccctgtgctgggcacctctgcttggggttccagaattctcggaggcagctgggtgggagtgctggtgggaagctccggaagggaggctgctcggggcctccctgtggctgtggctgcatgggcagccccgaagcggcttcctggaccccaccttgtgcctcagttaaacctgaatctggcttattcccacggccagcccgacacaggcagattctgagagtcctggctgcgcccagcagccagctgggtgggtggacatactggagggctgatgtcctatttgtgggctggggtttttccgggccttgggaaatgctgcctgagttcctggagaaggatgacatctttcctgccccactgtcgctgtcgctgtgcagaaccttggtgttttgacactgatgtgttctggagctaaacaatctcgtgttatgtaaacacaattagcctgttgctgtttgaccctgtcctgcttggggagggttgagaaggtgtctttttgctggatcctgggaattctgagagcctggagcagctgtgaactagtggctgggggttgtcggagctggaggggagtgttggtctggggagggccactcctgtccaggacactccgctccgatatactaagccagaccctggccccccacagctgagcaggcctggtggaactgcggggaggacatgctggactatttccacccggaaggggagaggaaatgaacggtgagtggctggtggccacaaacccaggatgttccatatatcagggccccagttccgagggccccgggcaaaggggctgggctggaggttgggagaagtgcagggtgacaggccctggttagagtatgggtcccttatggttcctttctgaaacgagtggggcaggtgagggcaaggcctgctcagagccccttgccccgggcctgcttaactgctgtgggtgcctctgcttggtgttccagaattttcagaggcggctgcatgggagtgctggagggaagctcgggaagggaagccgttctgccctgccttggttgcggccgtgtggacagccctgaagtagcttcatgggcctttcggtgctgcacaaggtggcagaagctgggaccagcgctcagacccctgctttgccgctgagctgtgcggccctgcaccatggtctctatttgagggccctcagctcaaaggctctgggaaatgagtttgggacccattgcttctggtttagctggtggggctggtggacctgtcaggttggacaagcaattcttgtgccttagcctcccaagtagctggggttacaggcgcccaccaccacgcccggctaatttttgtgtgttttttttttttgagacggaatctcgctctgtcgcccaggttggagtgcggcagcgtgatctcggctcactacaagctccgcctcccgggttcacgccattctcctgcctcaaccttccgagtagctgggactacaggtgcccgccaccatgcccggctactttttttgtagttttagtagagacggggtttcactgtgttagccaggatggtctcgatctcctgacctcgtgatctgcctgtcttggcctcccaaagtgctgggattacaggcatgaaccaccgcacccggccattaatttttgcatttttagtagagacagggtttcaccatgttggtcaggctggtctcaaactcctgacctcaagtgatctgcctgccttggcctcccaaagtggtgggattatatgcatgagccacctggcccagcccacacttggctaattttcttttttttgagatggagttttgctcttgtcgcccaggctggagtgcattggcggcaatcttggctcactgcaacctctgcctcccaggttcaagtgattctcctgcctcagcctcctgagtagttgggattacaggcacctgccaccatgcctggctaatttttgtacttgtagtagagacagggtttcaccatgttggccaggctgttctctaacctctgacccaaagtgatccgcccaccttggccttccaaaatgctgggattacaggcatgaatcactgtgcctggccgatttttcccattttcttgctgttgtaggtacagctgcattgggcatctttgtgaatataaatgtcttccttccctttctgattccgttacgtgtaggtaaaagtttttatcagttattgatgcataacaacccatcctaaaaactactggctttaagcaataagcattttttcatcccacagttctgtgggctttgctgcgtagctctggtcttgctaggaatcccttgcgtgtgtgtggtcagcttgcagtctggtaaggggtctctgccctggggcttgacctttggctaaccgaaggcgctgggcatgacctggcctccttcttggctttcctcaggctgctgggcttgttcctgacactaacagtggatgtttccaaggcctctggaggcccgtttgtgtctctacagtttgttggccaaaacaagacccaaggccagctaacattcaaggggtaagaaaataaactttaccccttggcggaggtgtcaaagtcattgcaaagggcctggatacagggagggtcaagccctgggaacatgtctgcacacagagtgtgtgatccgggtctgcgcgttggccggcagcccatagacctttcccaaattagtacctggcaggtgcccagctggtgctgggctgggtatggggaggggcggagaagtcgggttcataaggaacaactgtcatcattcagaaagcttttcgaagtgtccgctgtgtgcccagctctaccgacccaggtattgtcagtcctggttcttcaggaacttggcttttgcttacagagggaaggctctgtgggtgactgaccaagggactcggtgacgtcagtgtcctgtgtggtggtgggaagttttgttcctggattggggcctggtgttatctttgtggcaatcccccacctccatgatgaagttcatttttctcagctggaagaggaggttagaacattggagcccctacattctagaacattcgagcccctacattcttgaacattccaactgggagagcccttgggattttcagtggggaaaccagcggtgaatctgcagccaggactagctcctgcgctctctccttctccttgtgctgctgggtgcctgtgttgtttccagattgcatccagacccaggatttcctgttgttgttcttcgtgtgtgtttcttcattagaacaactcctgcatcctctgcagagctgtttacaggcatctattggcctccctccgtgccaggcctcgtggtgcatgtggccaagtgatggccaagatggacaaggtcttgtcatttggagctttagtctgtgagggctatagggagggtacagacatgtcaaccagtgagttacagggatgattttatctgggatcggaaaatgaagtgatgacagtgatatgaaggggtctggggactgtcctcacatagtcagagaagacctttcccaaggagagagctgtggctgctgctgacaggtcagaaaggagtcagtcgcagaaagctggggctgcggcatctcaggcaggggaagcgggtttagcaagtgcagaggccccaggggcacaggagggagccggagcttggtgtgttggtgagctgtggttggaggacgtggccggggcaaggcctgggaggacagggccgtgaggaagcaggcagggccaggtttctcagcgctttccaggccccagcatgcagtttgagattattttacaggaggtagaaggcaaaggctctcatcaaattaccccacaacatagtccgtgaaatactactcagccatgaaaaagaacacaaccccatcctttgcagcaacatggatgcagctggaggccattatcctaagcaaattaacgcaggaacagaaaaccaaatgtttcatgttcttacttatagatgggaactaaaccttgggtatatatggacacaaagatgggaagagtcaacactggggactactagagggggaaatgggagaggggggcaagggctgaaaaactacccattgggtactatgctcagtacctgggtgatgagatcattcatactccaaacctcagtgtcacacattatacttgtaacaaacctgcacatgtacccctgaatctaagataaaagttgaatttattaaaaaaaaaaaaaaaaaacctagtccgtgactctaggtgacccttttaaaagctttgggtggtgctgataagtgtgactgtgtcctggagcggcttcattacttcccatccctccagctgcctgccacagggcccagaagctggctttggaattggagggactgggtcaaacttgcttctgctcctgtctagcaagttagcgagcttctctgagcctgtttctttgtctgtaggataaaaaaagcacttcttaacttctgtggttggtgtgtcagttgaaataattattaatggtataaagttccatagttcactgcctgctagatttatttacaattactacaaataactcatcgtaggccccaatcagcggtagatggtattactgtggtggtggtggtggtatgtaggtggtgctgtggtctgggtttcagacaccatgcggggtgctggagcaccgagttcctcctgcaccccgggagcccagttggtgcggagacagagacaggaggtgaagtgttagatgaactctgctcgaggaacagagcaagtttctctatctgggaagatggaagaaagctttccacaggtggtgacccttgagaggtatgtttgagggcgcagggagctcgctcacggacaggtatggatggaaggtagtggagaaagcgggcaagcctgtgccaaggcgtgacgctgtggagccaggagtccttcaacacggactctgggcatgtagggccggtgcagatgggtggctgtggggagcccctggaagcctgggctgagagcctctaggaagcagtgggctggctgtgggaggaacacccctgcctctccctgtgcctgcagtgggtcccgtccccacgctgtgactgccaggtgtggacacatgctcgtcaagtggtgaagaacgtggagccggtgggctcaccggcttggggcctggctgcctcactgggaagcttggtggccctgggaggtcattgagtgtccctaagcttccgccagggagatgatcgtagggctggtgtgaggggagatgaggagtctgtgtctagcacccagcacagggcatgcactgataaaatgatggcttcacccggctcccaggggccacgtccagctgacagctccttggtgacttagctgtatgggtggtgtgcagctggcactgcttgctggtctgggggagacatcctaggctggcctgtggaggacgttccctctcagcctcctctgagccatgggcataggtgagttttcagaaaagcccataccgacggtgattcagctctgcttcttgcttccttctgtcttattcttaagtcacccacagggcagccacctgccagtgtctgtcctccaatcccctgctccaaggaactgctctaggcagggaagagagaggaggaggaggccccgcatatcctcgggtagaacggaggaggaaactgaggctcctcacagaggttaactaacctctgctagaccacccaggtgtaagagctgggatgcccccagaccctcccttctcccgggagcggtggagccgaggcggtgggggcctggctggagcgccccaggagctgagagaagtttagtccacctggagcttggcaatcggggtgaggatccctttgaggccgggttgcacaggatcctataagccatcattgtacacgcttgggctttgccctgaaggctgggggagccatagcagttgtgtgaggttggctgctgggtggaagccaggggcttgtgggattggagggggaggctgctgcgattgtccaggcagtggtggtctagatcgtgcagtggtggtggatatcaactcttcagagtccatccaggtctgaggactcattagcaacctcggctattcctcgactactcaggatgttgtctgtatggggccggtggcctcagcactcctggttcctcagcatcgccacgccctctgtatccacggactcagaatctgtgttttaacaagacccccaagaggtgccagtacacacggcacattcatgtttgcaaacactggtttagggaacctgttgacctcagcgcagggctgaggggggaagaaaggactgaggtcaaggcctgacttcatgaggaaggggaggttggggagcgggggaagaggagatgatgtcggagcactcagacttctgactgggaggagggctacatcaccccacgccaggggcggcttgaggactagtgcagttataacacaaagggccgaaacggcctggccgctggggcagggcagagagctgggctccacagggcagcctgcacaccccatctctgcccttggaggccctagaaccctgtggaccctgtcctttgtcctttctgccgtgtccatgtaggtgtgggtcgtgtctgccccacaggttgggtatttgccgttgtgctgtcagcagatgggtgttgagcccatgcaggcctggacttggtcacagaacggcatcctgcttgttgagtagccatcctggtcatgaggggtcatgtggtaatgagtgtatggagagctgggggcgtcattgtgaagaccaagtgaagcagcagtcggatctgggacagaggttcctctagggaaagactattatggtctggggcaccctggaggcacgcgccgtggctggagggtgggtgagtctgtggctggtgggttcggctgaggcaggggagtgcgctcttcagcccagccccctggcctgggccctgccgtgctggagtctcctggtgcctggaggctgagtcgaatgcagtggggctgggcagagggtgccctggctgtcgtggggtggaagcttggctgacccagtggacatcagccaggaccacattaggcccagctttggctgggttccccacagctgtgcccaacggcatccctggcctccacctactggatgccagtactactctcgtcttccaagaatgtctgcaggtacttccagatgtcctctgggtggggggtaaaattgctccgttgagggccagtgctggctgagggttcttcatcattcccttctggtcccagcctggctgcactgccacctggcgagctctgtttccaggcagtgggtcaggcctgctttgggggctggcatgctgtcctccctcacccatgtcaaggcccgtgtggccatgtgctgacatgtgcttgatgtgacctgggagtcagagcgcctggcttcctgctccaggcttccgtggtgccgtaaggacctcaggtctgggggtcaggaggcctggatggaaaatcctggcactctggtccttgtaggggaccctgagcctcgattttgcatctttggcgtggggctgtggtagcctttccatgggtgctggtggaggctgcgaatgccagtgtgcccaccctccccatgctgggcttagcgtgggtgcctggtgacagtgtgttaatctccccttgacttctctgtgacctcagataagtccctctcagttctgggccttgcttataaaagggttcttgggctctcttctgtgtaaaaagtggggaatgaggtggagagcctgggggacaggggagtcatggggttggacaccgtgccagagcctgtggtgctttaaaatcaaggctcaaacccagggtcctgaagagggccgagcagcagctgaggtccgagtgcacccggcctgccagtgctgcccaggagtggcacctcccgtcatccctcacgcccagcaaggacccagtgtgacaagagcatggagtctggacctggcagagctaggtttgcctccttgctcttctatgactagctgcatggctcctggagcctgtctgagcttcaggtgccacacctgaagactgaggttaaatgggaggcggggaggagctggtgacactgactggatgccactatgtgccagcctcattcattccaccctctggcagtgtcctgagttacatgcccagccaccgtgctattttccaggccggaaaaccgaggtgtagagcccagcactcggcgtaggaggcacacagcaagtgaagccatccttgttgacatgagctggttgctcttggcatttgagtctgaatatcaaaggccctgaagattaaaaagagagaatgaagaatgatgtgcctggtgccttcttgggaagagcccgaggccagctgtggaggggagcaagactggttctgggctgggcttcctggcctggtgctttcctgggcagctggaagtgcttctgtgggagctgtctggccctggcgccgttgttggcttcattattttttgcctgcaggggcctgagtattctgtactgacgggaaaacatttgttgggctgacgctgtaatcacaccacaagggacacttgaaattatatctgtatttgggaagctaattttaaagaactttttctcttcataattatatgcaatcagccagctagtgttattggggattctctttttccctcttcagctgagaggccatctgccttcctcttcctgcctttccttccagcacacggtgagccatctccctgggagagggaccactggcccttggctgcctgcaagccccagggaaacctttccatggtgattgcggaggaagggatgaggaggaagagcaggggaggatgatgggggcctctggcttggctacaggatgagtccgttttcaagactggaggcgcaggttggtgatggaaatgatggagtgtagcgtttcgatttggacattgaagcagccagggctcttgtgaatgcaagtggcagaaaatccaattcagatgagtttaagcaaaaagaaaaaaaaaatacatttcttggcccaggtaaccaaactggcacaggaatagtcttatccctcaggtccccagacattcctcctgtccctggagttttattcctcatcaggaggaatttagttccagaaaacgctggccaaaaaaagaaaagaaaagcccccgttgcccaccccctgcaaatggggctcattcctctctatcttgagctctgatcctgacaagtagggtttctccaggatggtggctagcacaccagtcagggatacgggctggacatttagggttggcacgaagtggactctgtggattgtccttcacacgggaggcattcaggtcaggagaatataccatgtgctggcccttcaggtctcgatctgaccaccctttccaacaccctgggttcctctgtgtccttcctcttggaccgccctctgagaggatggtgcgaggaagaggcttccgtgttgtgcatggtaggcagggatgggggcgttccaggggcggacagcatgggcaggtggtcagaagtgtgaaagaaccgacctgtggggcacggcaggaagcccggtgtgctaggaacagatggggcgagacttgctgggtgaggaggtgtgcacctgctgcagaggcccaagtggtgggggtgagggaagcccagggggtgagtctgggcaggggctggggggtgatgagccatgtttcagatgcagaaggtgcagagtgtgtgtgcagggacagcagggagaccgcctggtggcctgcaccgcagagctgtgtgtctcagggagtgggaagccctgcctgtgctggcctcagttcttccgctcttctggaattctgcatccttcttttgacatttctctctaatgcccagggtcctggctcttggctttggcttggtggcagctgtgaccccctgcatggggctctgagggattattccagctgtttggggactgtagccatggctcccagctgcagagcctgacaggcctggaggccggcaggaagaagatgggggctgtgcccgcctgccgagagctggctctgagactgactcttggcactggggtcctctgaggccccaggctcattctcacctcctccagagacccagctgacataccattctcatgagctgcagtcctgtgacccagctgatttctgtctcattggtggaaccctttagaggtggggtagggctcctaaaacattagccctactgccttccccacagattggcctctcttccctgcctgtgggcatctggcatctgcttgaatccttcttgtcacggggtgctcatcacctcttgactgccttcctatggaagccagcaacctcttcctatggttgagctgaaatctacttcataggaagggttccttctgcctggaaggtttgatattggacaggactgtcaaccgtgtggagaggggaggaacagggtgctggctcccccggcttctgggctggattgacccagggcgtgtctaccccacagcatcctgacatgccagaggctggaccttaggaagtgccttccgggcccttcactgcaggcctgctcaggggctgctcctcaggtcttggggcccctggggcaatggcatccatccttttggcctcctggggtcaaggttctgagggaggattagggcagcaggtggttgggtggagaggcagctctgtccagaacaaccctgttccagaaatcccagagcctcatccccaacagacccggtgggccccccaccatcacacaggtcccctttctccccaggaagtcacacagtgctgtgggatgaggagggtttcctgacagatttggggagagcgggcctgggtggggagtaagggagcctgggaattactggtatttggatgggtttagattgtggttctgcttcttacctgctgtgagtctttggtcaggatactgaactgctctgaatttccccacttgaaaagaggtgacaggccaggcgcggtggctcacatctgtaatcccagcactctgggaggccaaggcgggaggattgcttgagcctgggagtttgagaccagcaacctactgggcaacatagtgagaccctgtctctacaaaaaataaaaaaagaggcctggtgcagaggctcatgcctgtaatcctagcactttggggggccaaggcaggcagatcacttgatgttgggagttcgagaccagcctggtcaccatggcaaaaccccgtctctcctaaaaacacaaaaattaacagagtatggtggcgcacgactgtagtcccagctacttgggtggccaagtagctcctgcttgaacgcgggagaattgcttgaacccaggaggtcaaggctgcaatgagccgaaatcgtgtcactgcactctagcctgggtgacagagggagaccctgtctcaaaaaaaaaaaaaaaacaaaacaaaaccaaaaaagaaaagatgcaaccattgtacccacccagtggttgctgagatccagtgtgagggggacgaagtgcctggcactcacaaatcctgccccgccactgcctcgtctgtccctgtttctgcctgggacagggagagcaggcctgggtggggaacgagagagctcggggattactggtgttagcctctcatttatttgggtcgtgctcaggcccctggaatcctctctgaaactggagagtctctcgggtagccgatgaagcgctgcctgttttagggtcaggtgcctgggcacctctgatggacctcaggatgagcccaagtgtcagtaattatcacccagctccccggtttgcagccaaggcttccaggcctggagcctttggtctccagcacccagttcccccacatcccttccctgggcttctttcccgccattcccatcagggacccctgcggccatgctgggctgtacccagtgccccttgggaatctgcgggtaccgtgcaaagctgtgctgtgctcctccccatcaactcctcattgactgttgaaggcccctacaaactcctgacaggtcctcattcattcctgcctgacacatgaatgcttccaggcgatgtctgagaatcctgggatggcagagctgtgggagccttggggttgtggtgggcaaagtaaggcccctgccactccccaccaaagacagcaggttctaatcctcagagcctgtgagtgtgctgccttacatggtaaaagggtatgacatgactacagatgggatttttaaatttttatttttcagagatgggggtctcactgtgtcacccaggctggagtgcagtggctattcacaggtctgatcataacgcactgcagcatcaaactcacggcctcaagtgatcctctcgccttagcctcccaagtagctgggattataggcatgtgccactgctcttggcttacagatgtgaaggagtgaggcatcttgaaatagaaaatgttcctgcattacctgggtgggcctggtgtaattacaaggaggcaggagggccagaggagatgtgacagtggaagcagaggttggggtgttgtggccacaagccaaggaatgtggacagcctttagaactagagaaagcggaggaatcgatttctccctggagcctccaaaaggaagcctgcctctgacctcagaaccctaagagaataatacatttgtgttgtttttagccactactgttgtgatttgttacagcagcaatgggaagtgaatacagttttctcctaccctgctcttcttagggcttgtgggtgaatctgtgactgagaagggagggactgggtcagggtcaaggtcaaggccagagcccatgtgacccgacaccttgggactttcctttgacctgccatcccgaaaatatctgaggggccagggagatactccagtaaggtgccttgtggtttaagttttctgagatggggtcagggctgactcatgcctgtggctggggggccccaggaaaccccagtgcccatgacctggtctttgcctttgcttctcctggtgcttagcaggccttctctagcgtgccctggcagcctccctctccctcccctccagggcctggctcacacagcagctctactgaaacttccctgtgcctcctgctgtcccccaggtgtttgtgctatttaagggcctgtggcacacccgccagagggcatggcatgtagcccactggtctgccctgtggcagctagcatctcggggcagggtttgcggtctggggtccccctctggtcccaggccagcccagtgcgtgacagagaagcccagcaaatgtttgaccaaaatcagaccaggaaactctcgctgcctgtggttggaggtgcagcagcagggcaaagacaactaaactttaagggcttgggatccagggaccaggagctgcccccagccctcaggccaggtaaggagtgttggcagcagaatttgggtgaagtctttcggtctcctctggaacacagcctttcaaagagtgtcagcatccaggacacaggctggggacacacacacttatgctgctattttaggagtgtggggtaccttgaggataggtgctagaacaattcaggctttcctgagcaggcttctccctcccccagtgagtccaagggagggaaatgtcacgggaatttctgcctcccttcctgcagtagcctaccttgctcattaggctgatactaaatgactttgcattcttgggattaagaagctgctgtgaagagaaccaactgaatcattagccctgaggctggctggctgacggaggagggggagtgggggtagcggggaggggaggaggtgctagaaccaagcctgccagcaccccccactacctccctctcccagcagccaactcccctgcttcccacaatttaggtcccatccctaattaggggaaagaaaaattaccgcacctgcaaggggatagtaaaagactcaaaaacaatttcaagtcgagaatttccacactaaaaagcggggatgtcgagagccattaagggaatagatttaacgtttgtgatcagcaagaagtcaggatgattcctgatctgaagtggtggccccttggatgtggcagaacactgccttgcgtgatctcctgccctcgcctcacttcctccttcctgaaaattgaactgaggaggggagtctcaaaggcacctcagttcctgtgctgctttcagcccctgcagctctgatgacctctccgggaggtgccaaaggtgggtcacccactctgtctctctcttgtgcctgttcactgggaaaagctgcttccaggcacccctggaagctgttctgggtctgagggagtgtactgactcaggctgctgtgcctgcactgaggggcgcccggactttggggccggcctgcctcccctgggtggggcacccggtcggggggagggtcttcaggtaaggtggttggtgactccccagtcaaaggaaagatgcccccactcaataaaaaagacacatggcagcttccagtttatctggttcttccctagagctgtccagacaattcaaatgtttgtactggctttaaaattctgttcgtatgttgtctttatatcgggccatttcagtttctggcactgttaataggaggaaaatccaaattaccaaacaatcagcaagtaaaccaagatgccgcagggcaggcgggcaggggtgacacggggctggagcctggcccaggaacccggcagcactcggggagtgtttgcagagagcctgccaggcccagggtctgcagggggcacagggatgctgaaataaagagccatctttggcctcgaggggctcatggtctgatgctgagcatggagcaggcttcagtggaagccattattcctgcctcttgatgaggaaggcacttgagctgctcttggtgggtgggcaggagtttgccagctgaggaagggtgcctggcagggggatcagtttgtgcaaaggcagacttaggtcaagccttggcatttggagattggggtccctcctgggagggtttgagaggctgctgctgcctccccctcgtgtcttctgagctgcacctccaaatgcccatgtggcaggtgttttgctaagaatttggggctgtggacacagggcacaagctgtgtccctgaaagagtgcttgttagtcaggataggccaggttaggctgcagtgacaagtagtgtcgaaaggctggcggaaataggtttactcacaactcattcagcatgcactctggatccagagactctcgggggctgtggtctgccctgcagtggctcagtgtgtatcccacttcttaagttcagcactgtggaccttttgtgctggataattctttgttttagggggctgtcctctgcattacaggggccctttcctcactggattctagtagcactttcctcggtgtgacaatcaaaaagctcttcaggtgttgctaaatctccttgtgggggacacacagttgcccatagttgggaaccagcgctagctggaggtcctcttcatcagttgtttctttctggttcccagcctggcttcgtcgccactcagcccgcgttgtttccaggtggcgggtctggctggctctgctggtgggtggcagcctcatgtgcttccttgtttctgaggtcagggaggcctcggtgctggcagtggaatgctttttccaggaggggacatggtcacctctgttcacatctcattgcccaaggcaagtcctgtggccatgcctgactgggggcagggacaacacagtggcactgagtgtccaggagggaaattgccggctttgatggccaccattgatgttcaccaccgagcattagcctggtggggtcagtgcaatggagtccagcagcctttctctctgcccagtgctgggtgtgggcagcttggggcagtggggcctgaggagggtgggagccaaggcaggtttctccagaggagctgacctggggggtcaggtggtgatgtggggatggcatttgaggaagggaacagtgtggccatcaacacacatgggtgacggggcttagtcatctgtttaggagccccaagtcctggggagacatcctgggcttctgtggggtacggtgtgggccctgccctctgcaggcagggaaaggggaccataacttggggctttttccccagtgcctggtacctggaggtgccaaagggtcttgttatttggggtgcctgaaatcagtagttactgaactgtgccacacgttgcttggatgaggatgtgcctggcttcccacttccccgagttgttctccgtagaaccttcctcccttgcttcttcaccatttcatgtacttcacttgctgcagcgctcaggtccccaccctgccctggggagggcctcttgggtgggaaaggtcatatccttttaacggatatgaaagctgagaccccgagcggctcagcagcacatcccatgcctgctgctggtcatggtccctgagccttttgtgccctgctgtgctgtgtggcaggcctgctgctggatggggtctgtcatcccagagtgtcttgtgttaacctcctgacgccacacctggtactgtgctgcagtggcttggtggtggcgtggatgccgtggacgtgtctctgctcctcatcactcttttctacttctgccctgatcatctttattgttttcccttatcatcccctctccctcagtgctgggtcatccagagtaattttcatcatcttcagaagtggtaaccactgtcactcacagggtccctgctgctcagcggccagcgacagaaagctttagctggcttgagcagaaatctgcagctgaaggtctagagaggacgagccccactgcggccgggtctggccggggaatttgccctcctggagccctcttggccctttctcctggttggcctctggctcatctggattctcgccacatagaagcaatggtgtcctccagcatttccaggcagtgccatttgtactgcagacagtcccccaggacccgtccggtaaaggaccaggaccggcttggcttgggtcctgctcccatgctgctgctaagtgaggtgacaggtcatgtgcccacccctggagtgggcgtgccgcccccagtcatgtggactggaggaggcagttctggaagggtaggaaggcagggtggcagggcagagtgcaggtcacaagacccccatccctggcatgagccaggtactgtgccaggcctggactctgtttcccttaaagcccgtgtgggatgagttctaggattctcccattttacagataagaaaacagaggcacaaggtacaggggggtctggttccatgttctgctctcaggggctcacccacctcttccgctcccgcctacgcccccgaattgtgttcatctaagcctctgaatgctgcgaagctcagtcctgggcttctaaccacttcctggcaccaccacggttgaaaagtggactgctgctgccttcttgcagtgttctctcgtctcctgggcctggcgcagggcctcagtctgctccttccagactgtgagcgtcacaactatttctggttcttaggtttcctttacccttttcccaagacctgcaagggctgccccccaccccacccctgctatgtcctcccctagcaaatcagatcctgcttccactggtcacagagaagcacatggagtcgctcttgtggacaagcagctgtccccatacccagctgctcctgagcaacacccggagtgcgatgaaccctgaatccttcccaggccctgccctaggcctcctggatcagaggcctcagggtgggcctcgaatgaggatttttgacacgctccagtggtggttctcaggttatctgccctggcatttgggacccactggcccataggtaaaggctgggccacagggtgacatcctgggcctctgaggcgtgccccacctttatcctctgtcctgcgtctcagcccccgccccctgagagggctttaagcttccagagccccagacaccctttggggagggcgcaggactcaccttactcctctctaagtactcttctcagcaccggtctgtagttacccttcagttgctctgccagatggcaaatgctgcctcctctttgaagccttcctttattgccagcctcctcctctgaaaggatcgaatcattttgtgagtattttcacttcctgaagggttcgtgctccttggacttctggggacaggcttccctgtgcaaagcggatcatccctttgttaataatccagcttttggaaaagcatgtttatacttagctattcctattttattaatattcatattaatatattgtatttatatattagtgtaatatttatcaatacaatgacagtttagagcctgtaaaattattcgcaggtgcaggttttgtgttttttttgagacggcatctcgctctgttgcccaggctggagtgcagtggcacgatcttggctcactgcaacccccgcctcctgggttaaagcaattctcctgcctcagcctcccaagtagctgggattacaggcacctgctgttatgcccagctaatttttatattcttatagagacgaggttttaccatgttggccaggctggtctcgaactcctgacctcaggtgatttgggaggcccacctcggcctcccaaagtgctgggattacaggcgtgagccaccatgcccggctgcaggtttttaatgaaacttaaaaattattaaattgtaggctgggtgcagtggctcagcctgtaatcccagcacttttgaggtcaggagttcaagaccagcctggccaacatggtgaaaccttgtctctactaaaaatacaaaaattggctggcatcatggcaaatgcctgtagtcccagctactcgggaggccgaagcaggagaattgcttgaacccaggaggcggaggttgcagtgagctgagatcatgccactgtactccagcctgggcgatagagccagactctgtctcaaaaaaaaaaaatgtaacttttattgttactttccctatagttttgagggtagcgtatatgttcattgtagaaaatctggaaaacacagggaagtatgaaggaaaaaccacagccccgtggccacagttaacactgcagcacacgcacctcagtctgttttccaggtatcggaatgtttccacgggcttagaacccatagcgagtgctgcagcctggtggtccccactgcaggcatcatttcagctcctctttgggacagcacttggaagcttttcatgatacatcctgagctctgctgtcttgtgtcctccattgatcgattgcttcgtgcttttatcaagcatctatttaagaaacaattaaaaaatatattttccagtttttgataacatgttataggcacatggcacaacattgaagcaatgtatgaggggacacagtgaaaaggaagtccctcggccaccccagctgcccttgcccttgaccaggggccctgccatgattgttttcctgtagcgccctcaggttcactctgtgtgtacacaagcacacatgcttgtcctggatgttgttcttaacacagataattatctacagcacacagggttttgcatcttacctgtttcacacagcaacgtcttggagataattcctcgtgggtgcatggaggccttctgtgttcttttttactgctgcatactattcctttgactgtgtgtggtttgttaatgtcccctcttgggggaagtttaatttgctgctagtgttttgctatcacatacagtttggtaattaacagggcagagccggaaacatattgcacacttgagcctgtctgtggggtgatgaggtgggatcatggagccagggttttcaggaggaacagtcacttgacaaccaatgctctgatttgtgttccctcctcctgtctcccatgtcccttccttctccctcttcccctttggcttcatcattcaatttctgaactttctggttatggcaggactttaggaacttgcttcttggggaatcgaggttgttggtgcctttgctctgcacgagtttcccagtgaaaaatgagccccgacaggttgttttattttcccgagaggctgtggtggtgcatgtgggattccaccaccagaggggatgcagttttccgctgccacctcctggtccttccattgcactgaggccctggaggctggagaccaggccttccagcttggtgccacccttgcccacggtggtgcacctggtggtgaacacgtgggtgtggggagagccctgttccgggccagctcctgcacttcctgagtctcccaggcctcggcctgctctgcaggtaatggggtaaccactgtcccaccctcatgaggctgcagaaggtattggtgagtggtgagcttcaaggggtgtgtagcatacgtgggtggccccctcttttctgccactgttgcaacttatcctttttttggagctctgagcgacagaggaactgctgtggctcctgggagatcaaccccacttaagattgcagccgatcttttctctagattacttttttgttgctttcttattttatgtgttccatctgttttcagtgagagactgtttttttaggactaagggagggagagctgcctgggatgatgtaaaatgtggactgattggaattgacctcagtaaagagaggagagtcacacgctgggataacccagatgccagcagggttgactcagagggaaaccgaggccctggcccagagcccagtggaagtctgcgctcctctgtcaccggcctttcccattgtgcggttcacagtctcggtgatttgggacttgagttttctgtcctggagcagggccgctggagtttgggctggctcctcaaggtcctctgctgtgtgtcctgggtcaggttcccgtcagtgacgcttccttcagttttctcgtccctgcggggggaggggcaggatgattgggaatgaggcaggggctgaggtgtccacaggtgctcagaaacggtgcaggttgtgagcgggtggttgggtgtagcacaggttcctcatgatgctatctgtcactgtgctgtgggctgtggtggcccagggctatgctgttgtgtatctcccctgtccctcatgaaaccgtggaagcagatggatattggccaccattcctacaggaactgcagacaagctaagagacactgagggtccctgaatgcctcaaccagggtggttctcaaactggattcctcggggcccaggtttctgttgaggtgtcgggggtttgagggaaggtgggctgggtgcttcccacagtgggacctggtcagctctccttggcctctgtcttcctgtctcatggagtggctcctttgtgaggttccgctcagtgccttgctatcagaaggtgttgaggaagccctcactgaatgagctgacaaacagatgtaggaattggtgggcggcgcctcagctgtgccatgaaacaagggagcaagggtgcccaaaggttcctgtggggcttgtgcccatctcctccctaagaccttgagcctctcaagggcccagactgtggaggttgcatttgttgtaccctccgagtgctgggcccaggagctgagctaaattgttacacatttacaccttcatctgccagcagccgttgaggagtgtctgtgtgccaggtgggcatcataattgggcacgggcacacatagctttaaagtttggcatagtccctgctccaaggagcttgggtgagtaaaccacacattcctgaccttgcctggctgcagccatctttgagcatctgctggaggcctttcttcccagcacaatgtgcacagtatgctgtcttgggtgcctcggtccctgcaggtcctggtggccctacaccagtgcttgtccctggctcgtagcaatcaataccccagaacaaagggccgagacagtggtagccttaagttcttccaggttaggaggcgtcctggagaggctatgctgagccgaatcctcaaggctggggtgggaggtgggcaccagggccagggaggagaaagccctgtgtgccagagctgcacaggtgggcacttcctgggcccacagtaagaaatgtgggatgggggaggctggacgtggtggctcgcgcctgtaatcccagcactttgggaggctgaggcaggcggatcacctgaggtcaggagtttgagaccagcctggccaacatggtgaaaccccatctctactaaaaatacaaaaattagccgggcgtggtggtgggtgcctgtagtcccagctacttgggaggctgaggcaggagaatcgcttgaacccgggaggcggaggttgtagtgagctgagatcgtaacattccactccagcctaggcaacagagtgagactctgtctcaaaaaaaaagaaatgggtcaggaagagaagggtaggagtcaacagaaagcctttgtgtgttctgggcaaaccccgacccaggccatgaggctcctaaaattgggtggcaagagtcaggttacgtggtggccgtgggactgcatgtgagcggggaagatgtagaggacatgagtgcagcttggaggctgttggcgaggccagggcaggcatcagtggagcattgggaaggcagcgggcaggactgtgtgggcctcccgtgtgtggcagtggatgggttggggcatgactggctgtggcaggtcctggggcgagacctgatggggaggacatggggacctatgggggttgagctcggcagggacggcaggtggtgaggatggtggtgaacttggtggcaggggccttgggacgacccaggctggagctcggctgacagaggcccggcccaggagtggagggaggtggctggcgtggggcctccagaggactccagcaagtccctctgcagagccagccctctcagtgggaaggtggtttgaggagtggctgggagtggaaggcatggctgttctgggacagtagcaggagaggcgcagctgccggctccctcctgaaaccctctcatggtcctgccctcagccggctgtcgggaaccttcggaaaggacgtgtccagcctgctggagtaacgcttgttttctttgtttttctccacaggaagcgagggatggaggttgtgcaggtgagtacagaccgcgtccccgtggttctttgggtagtggggcccttggtgcccacctctctgtctctccttctctcctccagcattgggcacggctttctctcttcttcacgtgcagcttgtttttagctcccctgtggatttgatgtggtttctgccctggcctgggcagactccgacaggggcttctcgggtttggagggttgctgtggctttgtcagtggggagagggttggtttgggagtcctgaggggggtgtgcatggcagtggtcaggttagggtgggtgtgggaagggtgagggggcagtaggcacccagctagatgtccagttgtcttgtgctctgtgtagcctcaccctgggtggacttggttcaggtgctcattaactagaaaaagaaggatggatggaagaagaaggaagaatggatggagggggaaggaaggatcttggagggaggggaaaggtggacagatggagggagaaggaaggatggagggagaaggaaggatggatggaggggaggaaggatagaaggatggatggagagaagagggaaggatggatggagggggaagaaggaaacatcaaaatactctcagactctatgtgaggggcaggctgtgttatttgcactaaaggctgtacctggcacctaatgggtacttggtaaacctgatggtggcctggccatgtcctctgttccccacgctgtccccgtggagggtgactgtggtctgtgcagctgggctggcatcccatctccttgtcttacgggcctcatctgcctgtagctgcagagaggggaactcaagctggggactagatcagggcagtggaggtgctggcccctgctagaatatctaaggggctttcaaaaagcccactggggagctcttccagcccacccctgttaacttcagctccaggccttccctcagcggtcataggagagcagcgtccccattcctgcaggttcagcattgcaggccccaggtttcccctgctcctgggaccagactggggctggttgacgggtggggctggtaaaggatcctcctgacctccctcctggtagtttgtgggttgaacttgtcactggaagactgagatttgttttggggtaaggaggtagtttctggaagcctctcagcagctctaggtttttgtccaggctcttcttggctctggagaattgcatgttctgcactagatttttcttttttctcttcctttttttttttttttttttttttttttttttttgagaaggagtctcgctctggagtggaggctggaatgcagtggagctatctcagctcactgcaacctctgcctcctgggttcaagtgattctcgtgcctcagcctcctgagtagctgggattagaggcgtgtgccaccacacccagctggtttttgtgtttttagtagagatggggtttcaccatgttcctcaggctgatcttgaactcccgacctcaggtgatccacccacctcggccttccaaaagtgctgggattacaggtgtgagccaccgcgcccaacctgcattgaatttttctgtgggctttaatttctccatcatcaagtgggggatactggaattcaggaatggcttaggggtgtgtgttcagggaccatttctgtttgattggttttggcagcctggaggatcctaaatctgtgagtgggtgggaacaggggttgatctgtagtgcctgccaggggtacaggcgtggaaagaggaggtgtggttattcatctcatcacggggttagatggtctctaaccattgcacctctaggatgcggtggcttctatttcccttttagccctctatgatggttcactgggaaatccacggatcctttacagatgctgctttacccacaataagcctgagactgacagctggggctcactgtgctcaggaaggccccgggttgccctgtggttccgcccagccacttgggagggtccatgggggaactgctgtgggagccattttcagaggaagtgagttcaggcgctccccagcaaacacactgcctgagagggcaagacagccttcccccatgcctgatcctgtccatacgcgacctcaaactgtcacacagtgggtgtcacccccaccgctcgaggagaggatgagagatggacaggggtcggcgggtttcatttatgtggcattctgggaagatttagactaaaatctttaatccgctcggtctgtgggaggaacaggagactggagccattgtgtcagaatgtccggggcagaagaagcattgcgaaatctttctagacatgtatgctgttcatttaggtggtggcttgggggaggaagtggtggctggggaccagaacgaagccaaactggacactttacacttcagcatctaaaaataaaacctaccacgatacctctctgttcacctcctcctggcatccctgcatttggagaacttttagattttaagacattgagaaagactctgcaaaaacaggaagccaagccacttggctggcttttcaaaatcagctgggcttctgtgcgcaggatctccaggctgctgggccctgggagctgggggtgtttgcagtcctctgggttcaggtgctggtgactgaagaggacacacgtccccttgctgccagccgtcttcctgtgtttcctgtgtctggtccctgaggggcgtctcccgttctgtgcagccacccagggatgatgtggtgttaagtacccttttgaggtggggaaactgaggctcagaatgctgtgctttctcttggggatttcagctggccgtggtggagttgggatttgagtgcaggtctgtctgtctcaaaagcctgtggcccatggttttctgctgaacggtctcctctgcatgttcataggttctccatttactaaatgcttctgttcctcttattacctggactttggctgctatctaaaaaaaaggatgttggggccaagggtcaggactcaagactgcaaaacgctggtgaccggaggtcggttggtcatgggagttgtttctcttcctgttatttaatggcaacagtaacagtccttttattgaggactccagtgtaccaggcatcatgggtttactttaaggaagcatttgtgtgtaaccttcccgaggtgggtgtgggagcatatttaagaaagtggattttgcagatctcagtgtcctcaggtgcctgtgctggaggctgaggagctcgggagcccttcttccctgccacccctgtgcctcttcacctcgttcctcctcccacctctgcagaggattgtgcactctgtgaggcgcagggccgcctggggtcaggttcctgtctgtgtgaccttgggccagttgcttaacgacgctgtgtctttctgctcatctgtaaaatggggataatcatggtgctggtcccctggcaccattgtgaggactgagttactttgggtgaagtaattggcactgggcctggcacactggaagctggctgtctgcaggagaactgtacactatccacaggcagacctgaccgagtgtgagacctcagggcataaaaccctcctggtggtcaagtacagtggccagtcattgtcatcctggggccagggaggtatttccagttccctgcttgcagcaaaattcaaagagtacctgatggtgtcgtcagctgatagcacattaagaatgacctttgttttgggtggctgaggtgggtggattgcttgagctcatgagtttgagatctgcctgggcaacatggcaaaacctcgtctgagggttcccccccaaccacaaatacaaaaaattagttgggtgtggtggtgtatgaccgcttggggctgaggtgggaggatcacttgaacccaggaggtcgaggctgcagtgaactgagatcgtgccactgcacttcagcctgggtgacaaagtaagacactgtctcaaaaaaaaaaaaaaaaagaataatatttgataagagatgactagattactgtaattcttggcaaataattataaaggaatccaaagaatttgctgtggtaaatctctttccattctattttttaaatttgaataagtggtttctgttctcacatctgtaaaaattaaaaaatggagatgaaattgataaaccctgtcttattctagcaacaggcaatattcatctgagaattcatgaaataatttttcaaaaaattcccattcattgtatagatgtatttttaataagatttatttattaaattttacttatttaattttttttttttttgagatggagtctcgctcttgtcgcccaggctggagtgcagaggcatgatcttggcccactgcaacctccgcctcccaggttcaagcgattttcctgcctcagcctcccaagtagctgaggttacaggtgcctgccaccatgcccagctaatttttttttttttttttttttaagtagagatggggtttcaccagttgaccaggctggtcttgaactgctgacctcaggtgatctgcccacctcggcctcccaaagtgctgggattacaggcgtgaaccactgcgcctggcctaattaagtttatttttaaaggttatttcttatacaattttgcaatatatttctgtcttattgatcaattgtatacttatagtaattgttataataattcagtccaggagaaaacttctgacagagctttatgatcacaggaaatcacaggaaattaaaaaaaattaaaacattgatttttgtattttttggccctatagtatataataggataatcagtataaggctttcaagcataaaatacactgtgatagtataaacatctctgagggagatcagagtttgtggaggaaaaaaggaacactgttaaatttccaatggttaaagaagagcttgattatgtaatttaaaaatggatgatggcgaatctctaatcgccgtggtatttagataccattggatccatttaaaagagaaacattaacagttttatttttaaatgttaatatttacagtatgttggaaattacatcctctacaagtatttagacttatgatgagaaatttttcatatcaacttaaaaatgtgcaaatagatatgtagttttaaacatttattttgtgggggtttggtttgaagtccactgcttcagaacattaccctgtttacttctcagaaccaggcctgaggcaaatccttcctcggagagggacagcacgaggccttgctctcaggctgtccagaggccctgatggggctgggctggactgggctgactctggggcccagaactgtgctccgagacttgcttggcagtggacttgtctgcagacctggtctgttgggccacgtgatgatgatcatgaaagacacagcactgtctgctcagggctgctcaggcaggaaaggaagttgcaggggagccaggacccaggtagctcagaagaagaggatgtcctactttgtgtttagagcagggagttgggctgcaggacaagggaagagtgtagtaagggtcgtgggaccagatgctctctacctcctgtcttgagaggctacttgtcatgatggtgatggtggcaagtgcctgtttcctcagccccgtgctctgtagtatggtaatgggaatgctggacgcacgggccaccctgactccaccatttcagtgttgagttggtctcactgagtgctgagctgagggcccctcatagccaggccgtgcagatgggacgcagtaacatgcagcagtttccccgacacttgctatggataggccccaggtgctgggggctcacacaggcccaagccaggccccttcaactctctgtgatgtctgcagacagtggccaaggtaggcagggacaccagacaggcacagaggagggccctcacgcagcctggtaaatcaggaaggctccctggaagacgagtctggttagtggcaatgagcccatctacccaacagatcctaactgagaggcaaggcctgacagagctcaacccagttcctaggtccttgtgcttccttctaaaacacctagttgctaaaatgaccaagtgccaagcacggcactatgattacttcccccgtacacaggagccttggtcgtctgtgatctggggagtggggctggggctctcctgtgggccaggcagaaggcctgcatcagccttgctaggtgctgtcacctgggggcaccttccactccgatccaatctgtggggaaggctcaggaggagcggtttccccatccagggactcactgcctctttctggaatagtcctgaatttggtggaggaagaccctgaaagaaagacccacctgctgccgggccccctccagcctggacgtccttagggaagcatgttttgcagcctgacctctgccctggcctgttctctgggctgcctttccccagttactgtaaaagatcggggagaaggtgactgctggcatgaggggactcgaggtttgactttaaagtgcgaatgagcaagctgtaagtgtgagaagtgcagcagccagttagagattcactgtcctccatccacattccttgagaattcagacactatgaaacccagtctctggtgcggcggctgtttctcaagcaggcaaggaagtaagtaagttctcccggcttgcgaatgagtgaatggtgggcatacgtctttctgtccgtgttttctccagagctggtgctggctggcttgctggtgacctttgtatatgtgtttttaccccttcctgcaccagactttcagggaaggaggttgggtgggtgaccatcaaaccaccaagaaaaggcaagtctgagaaagagacactaagacccaagggaaggtccatgtgcctggggccgaggcagaactgggtgctgggcctctggaggcgaaggaactgtggggatgcccactggcagggaaaccgtggggatgcccaagcccaggggcagggcaggcctgtctgagctgtgggggagtggtgaggacgcaaggctgggcatgtaaggaggagtgggccatcaggggatggaggccatacctcctgacatggaataaactgggcgtaggggctggcaggaggcgaggtgttagaatggccttacagacaaggagcatggccagggccacacacagcagctggggaagggggtcctttggctgccaatggcttggaaaggctacagccccaggcttgagggggctagtgagagaccaggctggagagagtagcggtgccaggtgagttgttcatggggtgctgtgtcgggggcatggaggggcttctgcaggcgaaagctgggtgctccaacctgaggctatgggggaagagccatggggaggatacatggagggtgattagacagggctgcactggaaagcagacagcagggttttctgagaggggctgtggctgcagcctagtgaggggtgatgtgctctccaggggctcctgcagtgacagagggcagcaggagacagatggcagggtgtggtacctgggtagatgtgggaggtgagagggggaggatcagtccccagactcctcccttgtttctggccggagtgcctgggcatgggggtgcaggaggagcagccgccagggagggaaagcccatgccagcactggcgctttccgataggtgtgctgagtgcaggcagcggaggcctgtgttggtagctgctctcggaattcagagccagaggggactcacgtggttgcgtggtgtgcatctctggaaggattataggtgctaaattctccatctcagcattaaaaatgtacttgttatttaggttatatttttacatggtaccaacatttttttaaaaggtatgctgaacacagtgtcaaatgatcaatccacagcggggttccctctgccacccatactctccagcgtaccccagctggctgaccccggtgctcttgatggattttatttccaggtcactggggcataggtaggggtggacacctgtgaacatccttccttctgtcgattttctctgccgtgtgctgtggagccaagcgtaaagggctttgggaataacaatcgctgtggggttctgacgtctttggagctgggacagcccatggtagacttgcggtccacccatatcctgggcagtggctttctgaagttcacgtgagcctgactctgacctctccccagaccccatcatctccaaggaggaccgccacgggcttggggggctggctctgcacacagtgtttccatgtggtcatttgaggccagtaatggacacagattgctcttggctgtgcctcacttccctgtggggtccagagacctgggtttgagtttctgagtctgtttcctggctgtggatcttttccttcctctttaaagggatgacagcgcacaggattgaagacacctaagagatgctgaaggaatattaattgatttttactcatctgttgttatgattaatggtggcatttcagtggggaaaatacagctacagatgaaactgggctgttgagaaagatacattgtttcagtgtggagaatatagtattttttttttttttttgcctcccctctgtatcacttttgggtttctaacaattgtggattccagcttactccttccttttttaaaagatagattttatggtttttttaaaaaatttgaaatgcaggtatttttttccccctaaacattgacaattattttcattctccatcatttactatttgcttaggctatgtagataacaaataagacaaagttatgtgaaagcatgatccccatagtgttttttaataatgatgatacatgaggtgctgggaagggttatataaatgaggtctgctcatagcagttctccaatgtggccattaaaaaaaaatcacatttttcacattttggaagacagcgtggggaaatgctcgtgagttgctttgagtactgtcgtcatactctgagtggtttcatttctatccgttttattttggttcctgagctttttaggtttgctgttagaaatagaagctgtcaccgtgttgcagtcttgtgcagcttccgaagcctgtggcactcagttctagggtgattctttctccagcctttgatgcactgagtcaatttgagcaaatcctttaaaaaaaaaaaaaagttcccacatcccatgtcaagacaacagagctctgccagggcaggtggggctccctgtgctccagggtgcctgggtgccttcttgcaggcaggcttccagaaccccaggccctcctcaccacaccacgcagggttgggactggatctccctggtacctgccacccttgcttggctgtcaaatgtcaagaattccgtggcctcagtggagcgtgccaggtaagcattttacgtaaaagcaaagaaaagagatggaatgaagtacacaggggaaataggaagggatggaacgggggttttagaaagggccagaagcaagattctgctcttaaagtagctgactgtcctggcattctggggtgaaggtatccatagcattgctactcagagtgtgatcctagggaatctgggtgcagatggagaaactcggatgcaaacactggattcctcagcagtcggttcccgtttggcctggtgcagggctgagactctgaggaggaggcatcttgacctgagggccctggactgtgctccttgtccagctgggcgcagaaccatcgtagtcaaagccaggaatggagatgcattgcctcaggtcagttccaaagaccaggaagcgtccctgagtatttcagttgagtaaggacctggcatctccctcttcagccccttccctgctctcatatttttattcatgcttttagaactgctaaatgtcaggtgggtgcagtggctcacacctgtaatcccagcactttgggaggccgaggcgggtggatcatgaggtcaggagatcgagaccatcctggctaacacggtgaaaccctgtctctactaaaaatacaaaaaattagctgggcgtggtggcaggtgcctgtagtcccagctactcaggaggctgaggcaggagaatggcgcgaacgcgggaggcggagcttgcagtgagccgagatcgcgccactgaactctagcctgtgacagagcaagactccgtctcaaaaaaaaaaaaaaaaagaattgctaaatgtcaccttggcagtgacacctaccctgctttcccagcagacgcctctgccccctacacacacacacacacacacatacacacacacacatgcacgcgcacacacgcacgcacaccaagctgagctgcctgttggtgtgtcctcctgaggctgggacttgctggtctctgaggagcacgtggtctggccctgatgtgcgctgtgtctactgggtgagtgaattaaggactgaggtattgtgctacacaggatgtggccaggcctcgagggtctgtgcttgctaaaaataactctagattattcttttgctcattaagtaatatgtacttgtggaaatcttgggaagtcaagataggctcacaaatgaaaacccagagataattattgaagcaatttttacataaaatatgctcctttttctatatgatgtgcattcaggttaggcttttctgtgtccctagttttgccacttgcatttgggggaacagttgagcatttgcctgtgccatttaaacaccttggaaattgctgttagagtggctgcaccagcttcccaccatccctatgtcccagcatctagaaccatttctctgctccagagtctcaagttctaggttatttctggtttgctgttactaacagtcctgccctgggtgtctctggacctaaatctttggggacctaagtcacatctcaggctgtttcattgggttatggtctagaagtgacttcaggattttgttgctaaagaagaaggggagaatgggggacaggttgggctgcagctagtcagctgtgtccagcacacttgggccctggacttagaactggacaggttacttgccccctctaagcctcagtttattcttctgtaaaatggaaataataatggacccagtctcatagagttccaggagtgaggtcatgcagataaggaacagcacagaacctgtttacctagtttgtcctcagaaggagctgtttgtgattatttactggtgccacctccaccaccatcattgtcatcctcagtggcccagggaagcgtgagtctgaatgaggtgtgttgtgtagttaaatgatgcgatgggtagatgagccaaaatgaaaggatctcttctgtttgatttattttcatgagtaaaaaagccagaaatgtctgtagcataagttatgtctgtttggtttggctaaagcagggctgaccagggatgagtctcctgctgtgagtgagtgaggtcccagcttgtcctctggggttagagcagattttgctctggctggggtgcatttgggggcatgggctgatttatgttttccttctttctggatctccccaggtctagccatgatggggtgaaggcatcacccccagggagtgctgacccctgaccctagccccatgaccccctcccgtgctagttcattatgggcaggggaggtcccagggattccccgcacactcatcgtgacttttccaaaagctgtgtaaatccagagttgtaacttggctctgtctttctccttccccttgatccaccctcagctcaagaactcccctgggaagcacagtggctcccgtctttgcctcaagttctctgatgttctgcacaaatggtaggcagagacagccctttcagggacctgattgccctggtgtctagttctcctttcacaggcctgttttccagctcgactgtcaatctgagtctttctctttttgagctttatgcaatggccttagagtataccctataaggagatcccggcttgctggtgcccggccctgcagctgtgtcccagaaacttggcggtggtgcatggggctcactcagcacttctacagaagccgcctggggtggctcccagggttccggtgggaatggggtacagaggcctgagagggggctttgatcaggtgtcctgggggaacatttagagctcctggattctctgcaggaaggccaccagcagccaggcatgatggcctgtgtctgtaatcccaacactttgagaggccaaggcaggagaattgcttgaagcctggagttcaagaccagcctgggcgacatagtgagaccccatctctacgaaaattttaatttttattttttgagatggagtctcgctctgtcgcccaggctggagtgcagtggcgcgacctcggctcactgcaagctctgcctcccacgttcacgccattcttctgcctcagcctcccaagtagctgggactacaggtgcccgccaccacgcccggctaattttttgtatttttggtagagacagggtttcaccatgttagccaggatggtctcaatctcctgacctcgtgatccacccaccttggcctcccaaagtgctgggattacaggtgtgagccaccatgcccggccaattttttttttttaaaggtcaccagccctgttgtctgggcagtaagcacctagtaggattgcttcagagttctagaatgcgcatgtaaaaattccaaagtgcgtttggcgtctgggctgggcttctatgagcagcccaggcagcagcagtgagaactcctgtgtgtgcctcgtctactgagtgccagggttagtgccccacttgccaggtgagaggactgaggctcacacaggtgggcttgtcacagcctagcatgtgagctgtggagctgggattggattctagaggtgtgatggcatagccagtgcctcttctgctccgaagactgcctgcctggtgagagtccagtgactcctccctagttccagctccatccctccaaggctgtgcagtcctgggtagtggcacaacctctctgaggcccatctaccagatggtgatgagatggatgattgagacgaggggagggcaagtgagaaggccttctaaaactcaggccctcgtaggagaagcgtgggtagcctgaggtcagggacagggcttagtgtgctgtgtggggctgtggggagtgggaagctcactggttttctggctcctgagatgactcgaggggtcttgtgaagctcacacccctgtctcactgggcaggagtttggcctccactgtgggtctctgccatctcaggtgggtgggggaccaggggtccctgggcaggagggtgtgggtcctggcttggaggcagaccttggctcactcccttccttgcccaggcagtatttttgccgcaggccctgccaagtagaaataagttatttacagtgttttgacaggatcatcggcagccgggatgggcaaggatgcctttgggactgagctaatggccaaggagtggggcttggagaagggtctggcgtgggagagagatgggagatgggggtggggtgggggcgcacatttactgaacttgttaaatcttgacaaatgccaggcctggccctcccttaagccagggctttggggcctggtgagggcaggacttgatgagttttcctgtcgaccaaatattccgccggatcgctcaggaccctcggttatttttgctgtctgagccctcagtgccttcctttgtccatcagggacaaggacccctgcccacccagtatatcttcttggggagaagatgaaacgccttggtgtatggtaggccaggccctggccttgactgtgagcctggcagcccctgcagcccctcacactgggccaccattgacctgctttacgacttcaaatagcacagacctgccgtgggaccagggcctcctgctagtgcctgacctctgtcctgcatgatgttctgaccctccagaagcaggtttgaaagtgcctttcaggaaggtctggagagcctcctgtgtagcttgtgggaacaaaatgtgttactccctagccgaaggataaccagcacactaaaatgtgaataaagtgtgactttattcatgtcctttgagcataaaaatggcacacacactgatgcattaaaaaaacttttttttttaattaaactttttttagagatggggttttgctctgtcactcaggctggagtgtagtggtgcgatcatagcttgctgcagctttgaactcctgggctcaagcaatcctcccacctcagccttcttagtagctgggaccatggtgtgcaccaacatctttgatgcagttttttttttgagatggaatctcgctctgtcgcccaggctggagtgcaatggctcgatcttggctcgctgcaacctccgcctcccaggttcaagcgattttcctgtctcagaccccagagtaactgagattacaggcacgcgccaccatgcctggctaatttttgtatttttagtagtgatggggtttcaccgtgttggccagggtggtcttgaactcctgacctcaagtgatctgcccgcctcggcttctaaaagtgttgggattacaggcgcgagccaccagccttgacatagttgtaaacaaagttgtggttctgttgtaatctgttcccacaaacacacttagcattctcttagagcttccccctttgttaaatgtctacttaggcttgctttttaaatgactgcataatattatctgattgtaactgaagttctttgattcccttggttgatgctgaccatggttctggtctgtcacctttataaatagtattgtgataaacatccacttttgatactgtttgggcaagcctgtgatgattatttctttgggttacataagtaagttgtatatattgtttttgtagtctgtaggaggaatatgtacttcttggtgaaataaacaaacccctgcattttggggaattacagaaagggaaggtcttgtgggagtttgtgcttctagatttgaatgctgtgttatcacctgtgcaccaggcacgcatacagcaactcatttctctctcatgtgccctccctcccctcctttctcactcctgccccagacccactctctctgcccatgaggctgggggctgtagcctagccgcagctgtgcccatggacttttctccccttgcaattgttcctcaccccagggagaggaggaaggagtggtgggctctggaggaggtgggtggtccccgggtggcctctggtcttgcttcttcccagcaccgagggtgcttcagcctccttgcctggaaaaaggggttgtcgtaacaccaacctctaaggttaagaagggtaattgagatacagtgtcaaagtacttatcacacagcctggccccagatctgtgttgaggaatctgcagctagtggtggagggttaggagtcatttggggaattgcagtccggaaagttaatttctgaagagtatcaaacaccagcttgcatgttaagttgtcttttggagtgatccctccagtgattccctagtggtatggagccagtccagatttggagtggaacttttgttgtgggtgtgggtcactgttccagggaaccccagctacctgaccttgaaccaaaatccttgtcattgtggagcctgtgtccccctctgccttggacttttttacttttatcttcctagttctcataatagctctgtgagatgggatctatttattattctccctattttgcagatgaggaaactgaggctcagatctgtcacctgcttctgtgatatttctagtcacagagctccaagcaccaatcactctgggtctttgaactcagatctgctgttgcctatggcctaggctctttctactctgactcttccatcccctgccccttccccagtgctaaccagacctctctggttcctcataaaaacctcccgtggccttcctgaattttccaaggctaccacacaatcagccccctaataccttgcaagcatgggccttttgcagcagagcagggtcccctccattcctgagcttgtttcactgtccccatgctgatactcgcctgttccagactgtgtaccctcagcctggcctctctcctggtcagggtgcatgcctggcccacgtagcctggtggttctgtgctcgtctctgtggctcaaatttgctccctgtcttctgaccctgtatgtgtggtgacccagaacgtgttcctcttcatattagccagggagcttgcaggaagcagagctcaccctcagtggttcaaagagagccttgaaagcaggggctgtttgttgagctgtgggcagggttaagggagcagcgggggctggtgaggcacctagagcctggcagcagagaggagctgttctgcttcttgggccgcaggtaaggtgaagaaagtgtcgcagaagctctgtgatggtagtcatagcaagccacagccactgcccaggcatgtcactgaagcagggagagagaggggactaaataccccacccccctcctcctgccctctggtctcctgccagtgacccctcttggccaagtgcaactggaagccctggatcttgaatgctgcgttctacggcagtcagcctcccaggctcagagccaggcagtgtggatgggggtgagcagggagtgaccagcaccccccacccctgcctcatgacctgcaccccctccacccctgcctcgtgacttgcaccccctccactcctgcttcgggaccctcaccccctccacccctgcctcgggacccccaccccctccacccctgcctcacgacctgcaccccctccacccctgcctcgtgacccgcaccccctccaccctgcctcgtgaccagcacccacccccgccttgtaacccgcaccgcttccaccccgcctcgtgactcacaccccctccaccccgcctcgtgacccgcaccccctccaccctgcctcgtgacccgcaccccctccaccccgcctcgtgacccgcaccccctcaacccctgcctcgtgacccgcaccccctccacccctgtgttgcgacctacaccccctccacccctgccttatgaccctgtggacctcaaggcagagcagcaatgtgtcccgtggcctctgtgagagcggacccagttcttctgtccctacccagagtcccgcatggccactctggcttcgaccttccagactggccctcccagatgcccctgtggccatcaccccatggctcatttctgtcatcaatttatgattgatcctttaagggagctgatgggcttgcaggcccagggccctaacaggggctcagcccttcattccttctgttgctgggtgctcacccaggccccagtggcaggtcccctgctgccctctagggactctaagatgaccaagtctttgacctcttctgcgtcagtagctcagggagacagacaaccatggggccgcctgggaagatcgggccagggagctggggagggctctcgccgagctgatgggtttctcccacctgtcagtaggtagccccttgagagacagcatgtggtgatgccagaatcgtgggtcatgatcctttttctctccatcaaggtgcctagcgccaccaagcatggtgagaatgaccaggagggtgcctggtgggtgagccctgagtcgtgtggcccccatgggagagcatgaagccacggctgcctgtgctgcaggctggggccgcaggagactggggtccctgctggttctgcctctcctccctgcatggcctcggccgggctctgcttctttctctgtctgacagctgataggatctcatgggtcccgtttcactctcaccttctgtaaatccctgattcttcagaaaacggggctagaaaatctcccaggtgtactcgcacgtctgtttcctttcttagcctttcatcttgaagtcagcttggtgaggttgccctgttcatactgcagaatccagggatctgaggcctctcgccccctgggcagcaagtgagtaggagtgagcaagtgtgtgtgagtgagtgaatgtgtgagtgagtgtgcatgtgggagaatttgtcgatctgcttgaagcaggctctttgggtgctgtttcagcaggacagatttcgagagaacacagctagctctccacgttggacctcgcctgggtgcagtgtttctgtgtatagcaaatgcacacatggctgcctgtgtatgcgtggtggatttggagtctgggtgatgggtttgcacgctgcctctgaccttgaccagccttgtgaccctggggagtcactgtgctctgggcaagtcgcctgtgaggctcataatcctgacagcattactcatcctcggcctatggtctcccgggtggcatttgggagcacccagagggtgagccaggcgctttctaagctgtaaaagtgccctgtgatgtgagcagttatgtgatgtgctctcccagcagcacccagttttggaggctcaggaagcattcccagcagggcctgtttttagccttgaaacatcatgcttgaaaaatgcttgcatggggtttatttaactttaagtggggcaaattctgaaatgggttgtttattgtccaagttgaatttttaatttctcataaattccccacaaattgctatagtacatctttatttgttgaatctgtcagagttgtttatggcactgaagcctgggctccccctgtttgtggactgttgccatggcaacaccaggctctggaggaggggcactgctctgaggtggtatagaaggttctggaatgggctggtggtgtgaagtagagctgtggctgctgcactgagacccagccgtgggtggactgagctgcttaagaccctggttcctcttcaacatcactgcacccctcttggtccctcttcccttgggggtgcactgctgaggtctcctaattctgcttccctaagcccttgctgctcccagtgtggtctgggaaccagtggcagctgcactgatggggcgcccatgaaaaatgcagactcccttgcccccagacctgctgagtcagtctgcagttcaccaagctttcaggcaccttctcagcatgggtaagctgcagaagccctcacatgccacactgcccttgggtgaccccagaggccttggcctggcggttcttggtgtttgccaccgtcctccctgtgatctttctgactccttccccgacagttccctctgcttggccaggagtgggctttgcctctcaaccctgctgcacccaggccactctcctgctttgcacacaccagtctctactcacacagtcaccccagccttctctatctggggaactctggacatcttggaagaggcaactcttgagacacctcctctgtgaagccctccctcctttccccagaccgggtgatgttcagtttcactggagctctcctgtggcctaaacacctcacctgccccagcctcatcaggctgcctgattcacctccctagccgtgacctcactgggtgccccggctgctcctcccgtctgctgggtgctcagaccccagccagcgctcaggaaggtctgtggagtcattgccactccagtcagctggcttcacaaggctgagacttgagtctggacttcttccaagagcctgtactctctgcccggggagtggtagggaccgctgggcaccttcagtttctacctgaggcctgactggcagttggggctaggaccggataaggatgggtccttggactttggaaaggcgctgtgggagggaggcatgggaggggacagctgagaggagtcccgagctcatgcgcaggtgagtgcagaagttcaggtggcatttgtatgtcccttgagtatctgttctgggccaggcagcaccgaggctcgggagagtcccagtaaacaaaccccaaatccctctgccttcgtggagcacttgtgtctaggttgagagactgaaaacagaaagaagtgtgggtggcgagtgaggtgggggagggggactgggagaaaaatgaaggagagtaaggggctgagggctggtgtgggatttgggaacatggcttggttaaagctgaggagatgctgaccctttggccctgcaaatcctccatggcatgtacccaagagaaaggagggctgtgtccaccaaaagacacgtgtagaatgaatgttcccagcagcagcattcctgatggcctcaaagaggagacagcacgcatgcccattggctgtagaatgggtacgtacatgacctgtgttatcatctggccatggagttgtatcgaatacagcagtgagaatgaaccatggatgagtcccataggcatgaaacgtggccaaagatgccaggtgcagaggcgtattcagtgtctgattccatttacatgaagatcttgaccaggccaagctactctctggggacaggaggcaggctggcggtcacctttggggacaaggtgccgggtgggaatgtgaggagcctgctggtgtcttgcaactgtcctctcctcagtcttcctcttgggtgccagtttgtgaaatattcaagctgttcacttatggcatgtccttcctttcttatgttatacttcagtgaaaggcttataaaagaaagaaacagaaggggaaaaaagccatgagaggcagagagagtgctgttttctgtaatatatgcccttagattctctagaacattggttctcaagccaccgtacatatcaggacatggccaccgcccctcctgaagctctccttgccaggagtgatgcaggctccgaggatgaaccacctggtgagaagccagtagccccagcggcatctttcttgctcttcactggactggagcctctctgtaatcaagggagtacatgttctgtaccccctggcccagtgtctagttagaatagacagtgagcatttacagattgaatggttttttgtttttttcccaatggttttagcttgtctttgggaatatagggtctgtttctgggcatggagaaacagggttccctcctgtgctttaagtctaacctccaagccagagaggtggtactggcaggagataagaccacccgttgtctggatgctgttttccatgcagcagacatgggctccagtttctgtcaatcagtttattaaaacctgcgtttattacttgtttgccctgtgccaggcactgggctgtgtcttagtccagccccacagtaccctgtttacagatgacgtcaaagcagctacacgtgggtgactggctcggttcacttgctagaagtggggactctacctctaagtggggtgaatcccaggctagcacttgacccactgacagggtggaggggatgtggggaaagaagatgttcagtcagggttggatgcatgaagtgctgggtgggctgccaggaagtgcttctaagcctttgctcttcgcttccttccccgaccccatctctccctacttcagtctgacttccctccatctagaatcttcccagatgactccacaactgggtagttttacctgctgtttctgaagcctggctgtcccgtctacctcccaaacatcagcccaggctccagagactactggaatcacagtcacctgggagattgatttttaatagactctattttagagcagttttgggttcacagcaaaattgagaggaaggtgcagagacttcccgtatctgccctaccctgacacacatgcagccccccttactgtcaacatcccacgctagcctggaacatttgctacaatcagtgaacctccctgggtgcatcaggatcacctgaagtccccagtgtgcatagggctcactcttggtgttgcacattctgtgggtttggacacatgcatagtgacctgcatctaccattaccataccatacagagcagcttcactaccgtgaaagtcctctgcaccgcctgttctttttaaagcacttctaaaaagaagtgctgatggggtggcatcaattatatccagatctctggggcagctcttgagcactggctgtcatgaggcccccaggacaacaggcagccgggagaggggcgggtggggaaccactggattgaagtaatggttctcaaactggagtgtgcactggaacccccagggagcacatcttcaaacaggtggctggccccattcccagggtctctgaaccagtaggtctgagggggctgagaatccacatctgtaacaggtatccaggtgatgttgaccctgcttgtgagcccctctgtctgagaaccactggtttttttttattattattttttattttatttttattttttattatactttaagttttagggtacatgtgcacaacatgcaggtttgttacatatgtatacatgtgccatgttggtgtgctgcacccattaactcgtcatttaacattaggtatatctcctaatgctatccctcccccttcccccctccccccaccccacaataggtcctggtgtgtgatgttccccttcctgtgtccatgtggagaaccactggttttaaacagtggtgacgaaaggtgtggttgggccagatgtgcctgctcagaaagccaccagagcgctttccaagtctttggggcatctgggagattgtgcccggcccctttcccagttctgagtgagggactgaaccctgggatgggagatgtagggctgtttcctgtaccaccagccccttggggacctgggtttggagggagggtggtggtgcgggcaggtattatattgaatatagagtgagccagaaggccggtgaggcttgggggcgaacttccagcccactgagtcactctcaggccgtctctggccccactgaaggatctcccgtccccctaccccactgggggttcctttggccctcacagaaggacagataaggcccccagggtaagaacaacccagaccaggcctccctgggtcagagagtcagccagggcctggtatcgagacttagaccttggagagcttgggattatgggagaatcaggctgttcttcagacaacaggccgccctagatgcctggcgtctgttgtaataaaagacctttagtggaaactaagtctgttgcctttggcctcctaggagcccagcaataaaatcagtgtaaatagagctaacatttgggagtggtttataaagcacttgaaaaaaatccctcatataaacccaaagacagtcctacaagctgcagggacaattaattatcctaccttttggatatggaaattgaagttgagaaaggttaaataacttgcccatggtcacagatcttttaaatggcagagctgggatttggcctggggactctgccacccaaatctctgtgctttctgctgtcttattccccttccaccacgtggcccctccaggcagagatgaaggcgctcccctggtgcaagctccagctacaaaagggtgaagatggtggtgccctcagagtggaatgtgctggaatttctcacaacagagttgttcttgaaataggtacttattcttggcatttcttagccaaaaactgcagaggtgagtaccccatagccataacagtggcagggattagggagtgagttagcgttacaatggaagggcttccgcccaatctgctgtcttccattccccatgctgagacatttggaggcacagggtggtttccggtctcattgaattggctttcacgcttggctatgaggcacccctaggggttccttgaaggggtacctgcttttcaagggggatgagttgctcaccactcccttcacctgagcagctctttcttttttttttttttcttttgagacagagtttcatccatcacccaggctggagtgcagtggcatgatctggactcactgcaatctccgcctcccaggctcaagcgattcccctgcctcagccacctgaatagctgggattacaggcatgcgccaccaagcctgcctggtttttgtatttttaggagagacagggtttcactatgttgcccaggctggtctcaaactcctgagttcaagcgatccgcccgccttggccttccaaagtgcagggattacaggtgtgagccacctttcccagccactctctcttgatctgtgtttgatctggggtctgcatgttagatttcatttcaggaaagacatttgaggtcagagagagtttgaaaaccatggtgtctggggcagaatcctgggatattcagctcccccatgcctgggaaattgaggcatgtgtatgtgcagagagctgtgggcctgccaggtgcgtgatgactgttggctgtcaggtcctgggggtggagtgtggccatcaccgtttgattggttccttgtccgtcaggtgtccttctgagtgcccaggcaggccgggccctgtgctgagcactgggcacatagctgagagcaaaactgccacatcccggtccttaaggagcttccagtttagtgggaagacagaatctgtcttggatggactttgagtctcttccagcaccgcaaggcgtgtttattaaagagctgggcattggactcgcctgcacaggtacctctgccagctctgcttgctgatgggccagtgacactcacttcctcccccacacgtgtgggcctacccgatgctggcgactggaggtctcggtaggtcagccatggggtcactgaggtcccgtgacttggctccctgggtctctaaccattcctcacctgaccccatctctccagaattactcttgtggacccccctcacatccagggcttggatttgtcacctttctgggtggagagaataaagggaggaaacacgaactgaggtggggtgcaggagccaaggcaggccctcaaagtgtgcatcgatgccttcaaaagccagctgcagtattcggccacctgcgatccctgggtgcccgccatcagcccttgctcctctctcttgccttggataggacagaagttgacacttgggggctcttggagaaccatttggagcacgtggaactcaagagtgaatcacttattttttgctgtgtggcagcagggcctccctagacaggacatattcgggggcttgcagccaggtaggggagtggaagtacctcctctcaccccacacacgggaattggagatgaggcagccgatcctgcctgcttgagtctcagctgtcattttccaggctggcagcaccagcaggagaacccgtgtgtccgccgggctttctttaaaatgcaccgagtgcaacccagtcctccttgtgtaaactttctccaactggccagatggtttgcttctatttaaggcagtgagagtatttcctacggcctgctgccccctggcctttgttttgccccgggaaggccattcctcgaaagggaagctgagcaggagttgcacttcccagcagcagggattgtcggcgcccacccccatggcaggcctagaacctttgccaagtgcctctgcctggagggaccgtgtttgtaacttgactccctctgtcccttccaaatctgcttgtgctgtgttttcttagatggtcatgaaggtctccccccatctcccaccccagctgccagcccggtgcctctgtccctccacatccacatcttttctgtttccaggttctgttgatttttccctctggatatttccttacccaccccccacccccgtccttctgttctgtgaccccggtcagtctcccagtcccccttacccattattgccaagcctctggctggcatccccagctctgggctctcccaccctcagtccagcccccacctggcagaatgatctttcatcgagaatatctgagtcactccactgatctaacctttcctggcctttcattgtctttaggttaaagtctaagccctggagaatggtttatgaggcccttcccagtttggtcctgccagccaggcagcctcaccccctgccattcccaactcagacaccagcaacacctgcgcactctctccctgcctctgcacttgctggtccgacctactccagccagatgtcacttgctggcagaagcattcctggcttcccctctgtcccctcacctcctctgagccgactgtgtttacctgtgggctcctcgcaggcactcaccttggtacttagcacagagccctgcatgcaggaggccttccacacaggattcttgtgtattgctgactttccccccaggtctacctagaagccacagaaggggttttgtagggcttttaaagggcaaatggaatctgttattctttagtatcattaatatctgcaaagtttccttctcagcagatcttcacttctcattgtctacactgtcccttttcctctgggtggcagtgatgattggcctgagcctgttatgagatgcttcattcccagcctcccttgcagtgggggtgcccatgttatgtgcacttctaaccagtaagacatgactggagagagtgtttcttttttttgagacagagtcttgccctgtcgtccaggctggagtgcagtggtgtgacctcggctcactgcaacctctggctcctgggttcaagcagttcttgtgcctcagtctcctgagtagctgggattacaggtgtgtgccaccatatctgggtaacttttgtatttttagtagagatggggtttcatggtgttggccaggctggtctcgaactcctgagcttaagcaatccacccaccttggcctcccaaagtgctgggattacaggcgtgagccaccgcgcccagctgggaaagagtgtttcttctctttcaaagggttggctatttcgccctggccccttcttccccgcttccagatattttgtgggagtatcaggagctttggcagctgtcttgtgagcgtgaggcgacaggcacgcggacaaaggtctaccatggcgagcatggcagaatagaaacttgaaaggagtatgggttcttgctgatgtcaacctgttgaaacaccctggagactccactccctcctaacgttccgtccttatgattaaagccatttttagtcaccacttaaaaccagacacatcttcactcatgattctgagcttgttggaattgttttttgttatacgaaaaccaaatgcacccttgacgtaaagactggccatcattgaaacaaagctttgaaggccgaaggcgcttgccaaagagaaggatgccagtgctttgagtgttactaccatcgatgtcagaaatgtaggtgcccaaaaggatgaccgttgggcaccctgttcatttggacatgttatgtcagaaaacaaatcataccatgttcaccatgttatgagaaaatgtaaagcctcttcaggttgtaagtagcagctgtcaatatgaaagaaaaatcttaaggaaatgtcaataaatagaatttattggcctgaatgtctcagaaggtccagagataggtctggcaggtttcaggccattaagaactcacatgtattgtcatcagaaatatttcttcacttttcatgctccttgtgaaagtcattttgggtgggcttgtgccaagtcatgtgaaactggttgcctgcagcttcatccccttggcttaacagccctgcaggaagcagatgtcgggctggctggtgctggctggctctggttggcctggcttgggtcacatacatatcatatttgcctgctaggaatgccataacaggtcactgcaaactgcgtggcttaggagaacagaaattcactctcagttctggaggctaggagttggactcaggatgtcagcagggcactgctccgtctgaagccccgaagggaggagccttccttgcctctgccagcttctcatagtcccaggcacgccttggcttgtgggagcatcgctgtagtctctgcctccatccccacttggccgtcctgcctgggtgtctgtgtcttcacctggctttctccttttcctataaggacactagtcatattgaatcagggccaaccctgatgacctcatcttaatttgattatatctgcaaagaccctgttttcaagtaagatcatgttcataggtaccagaggttaggacttcagcttatcttgttgggggacaaagttcaacccatgacacctgtccttgggctggatgacatgatactctagctggccaggactgtatcacttgcccaccccaaagtgagtgtgggtcaaccccctggagttacgtggcttaaacgtcggggaggaaggttcttcaagggaactaagttgagggcagtccacagatggaaacttggcaaaggcagtggtggtaatggttcaccagcagcccggcttggcctgagggccccagctttccagtccggagtggtccattggtctgattcttctctcccagttcggtcccctctttcctgacttccattctttaactctgcaggagggggcgcttagtttagttggaggtgaatggagagggaagggagacccaaagcagggaggcccttgtgatttccctaccagccgcctgctctgggctggagcatgggcctcagatagcctaggtgctgggctgcatgtgcggccttgtgggagttccaccgagcagagcttctgatgggggttcgcagcctgggtgggctagctagtgaccgagctttgatggtaatgaaccatcgtttgctgcttttattcattcactagtttttcatctgctgtgggagaaggctgtgggagtgtgcagtccgaaagaaatggaaaaacaccagtctcctgtttctgccctgtgctttccagttgaccactcatttggagatgtttctgtttgcttgtgttccccccgccgcccccccccgcccccggctgctgggccatccctgcttacctagcctttttctgaaggtcttgaagcccagagcacttaggaaagtctgagcactaaattgcgtcctgcccaatcaccatatcctgtgtgtatgtcttatctcctttatgacaggaacatggttcatagttgcctttatctggagcacatggggccatgtgggaaaggaagcttgagccaggccaaccctgtgcagaccctgctgtccccaccgtggggccccgggctagcgctgtttctctgagcctcagtttctacctcctcagaatagaaaatgggagtagcactaatggttgagatttctctcagccaagtgtctgtgagtgggtttgtgcatgcctgggacctgagcaatggccacaagaaagtcctgtttggagcttgtggtcagcctgggcgatgaggtcaagatgccctgagagtcaggagggaggggtgcggcttgactgccccagaccacactgggaggtttgcagaagaaaagagcgtggggtggggatggggtcaaaaaggactctgtgtgtgcctggtgagggcttgaggcccggctcacagaccactggtggacccgtcccgccagagcagtgaccgcttgggaggcagtgagctgtgagtgtggaaaggaagtcggaggcaacgtgggtcctcatttgggggcactggggagcgattgaaggtttttaggtagttgcagaggacagtttcagggaaggtattctggcagttctggcccagggtggattgggttgtgtccaggctagaaactggatcctgaaattagttctgaaagaataaaaaaaaaagtctgaattagagagtatagcttaattttaattactggtccttgttaattagttctctgattgcatgtaagccaaggtctctaattggattttcttagatagggtttcgctgtgttgcccaggctggagtacagtggctatttcacagatgcaatcatagcgcacttcagccttgaactcctgggctccagtgatcctcctctcacctcctcctcctgagtagctgggactacaggcacgtgccatctaattggtttttaagtgctgtcagtacgtttcagggagactctccacccactttgcgctaatcttcccccatcctggtgatttgctgtagagtctttgttatggggcaggggcagcatagcctacttccagcctctcagtctgcggcagtgctcttcagggtcaccaggggagttgaattaaaaggccactctgacctggcctctgtggtttcctggccggctgcatggaccagccctcaagcgctgcgggaggcagagctgctgactggcagggacaggggcctgaggtcttgcccagaggggtaactggcctctgcttatttgtgagaggtgaggcttggaggtttggtttgatcttgatgccctgtgcctgcaagggcaaggaaccagtgcctggtgacttggaactaaggcacagacttccatttcaggctcaaaagcagcatggcactgggctgcaaagtcagggatctggttctttaaggtagatcttacaggagggagaccttaaatgcccctttcttcctgatctgacagatcctagagccctggggcctgccctggccaggagtcctggtgctaaaccctgtcaggttggtggggaaagggcatttaaggcccttaccctgttaagatatatcctaaagaaccacaaccctgacttgcggcccacgctagtccgtcacggtgtcgggtttttcttgcttcttcctcttcctcctttgctagccttggtgcttgcggtggcccttctggccaggccatagacagaggccacacccttcttccctctctgccgtgttgctgtccgctgggccactgtcccacctcctctgagatctacagccccacagggttgggtgatggttgtcgccacattggtcagttctgcatctgggtcagtcccaggggcttgcatggctggctgtcagtcctttacctggggggccctgtggctcatccgtggccctcgagttccagagtttccatctgctgccaggccgagtgcagcatcctcaccagcttcacagccaagcagagggatgccagtgttcggcctaggcttcggtttaatttttatgctagactttctcagtaatcgccagcacaaacttattcatggtcccttccttgtgtctggatttcagctttcctatctctgcggagggggttggaccagattacacgtgggtgactcagatatacctgggcctgcatgcaatctgtttggcccacacaggaattttacattctttcctttgaatttgttgccagtgtttaagctggttgccccttaggccccaccattctctgttgtcccacaccaccagcctcatggtttacatttgccccatgggcgcttcagtttgtgaccctccatttgctcctaggaccccctcctcacctcccccccaacccctcccacctgaattcctcagtaccctctggctctgtcttcccagggtgatgggacagaagaggagggaggctagagcctagccatccacaagccgggttccagaatggttggatttgagaaatctggtgaaggggaaaagatttttcatttgcccagaactcagggtagtggacttggggcagtaaaggtctcaggaacagagttgaagccagaactgtaggaagatgtgtattggggccttcaggtgggcggcaggagaggaagggtggggctgtggtctgggaagggcctcctgcaggatgccagcctgccaccaatgaggggaaggagaacggtggcctgggcatgacgtgcgcttggaacagattcctggtgacaccacccccagccttggggcttaaagattgtggtgtaatccaagcttgttttaatcaagccacagataagaatgagccaggctgaggctggctacggcctgagtgcacattcctgcctggtgcactttgttcttcatgtaggtggggctgggcggggcagggaggctgccctgctgccttggacccaggatggcatttcccctgcttgacagggacacttggaatttcctgttggaagtagccccaaaggaaagagtgcctgatgggttgagccttggatgtgttcggtgctttctgcagtgactccacagagcactgggcttttgcagtctctactgtgctgtcttcggctttcccactggtatttcctgccctcagaaatccacctgccccacatctcttttctccccttctgtctgtgcacataaactggggtggatttcaatccgatctccttagctgtgtgatcttgggcaagttattttgcttctctgagccccagcttctggttctgtgtgtgctgtgaaaccacctgtggcccacgtggccaatcctgggtcaatatttttttaaccaatgacaagaagtttctaagggttttccccaaagtgtgggcctcggtggggagctggcagtagctggatgagaaagagtttggacttcaagtcaatttgtagagttaagattgaaacttttttttttgagacagtctcgctctgtcaccaggctggggtgcagtggtgcgatcttggctcactacaacctccgcctcctgggttcaagctattctcttgcctcagcctcccgagtagctgcgattgcaggtgcacgccaccatgcctgggtaattcttgagtttttagtagagatggggtttcaccatgttgctcaggttggtcttgaactcctgacctcaagtgatctgcccaccttggcctcccaaagtgctgggattacaggtgtgagccaccgcagccagccatgattgaaactttaatttccttctccttgtccgaggcccttctccctttctttgcccaccagtttctccctctgagcgctgcagccaccccacaagccccagtgccctgtcaggcccatcaggacatgcaggtggggcactggcctgagttttggatctttgcttcaaagccgtgttaagtccagctctgccttgtcccagttcccagccctgtcgctgttaggggtatccgatcagcaccctcaaaactagagagatcgcagcctcaaacaaatccttttggcaaatggctgcatgttaggagggttttggtgacccaaacatgtgccaggcatgttccaaaacccccagcatcaaggcccactcagggattagggtcgaagctgcttggctggggagagagggactgtttttgttcttagccactttctgttcacatatggctatcattcactgaatgaacgtttactagaacagcagggtggcggagtagagaaaacgtgtttccagtttgctgtacctgtgtcagaatcttggatttgttactgtgagattcagggcacttgagtcatttgttctctagaaggttaatttcctcaacttataaaataacttgatttgtacctcctgcagtgggtgttgtgaggactgggtgagaggaagtctgtgaggacccagcatgacacctgcacatggcagctgtgtggtaggcggtcactgctgttgtcatttagtaggtggcccttaggattagacaccgcgggggacacaggctgggtgagatagggtccttgctaccaggaacatatggttaacagggggctgcaggatagatttgctgtgttttgggagttcctagcatctgaaccccctctgagtttacatctgaggattctcttccatatgtatcttggaggccagacaggaaaggccaggaactcttgtcacctgtagtgctgggtgcgagcacaggactggggcctgccagccagacccaccccctggtgctgggattcaggaagcaggacagggagcattcgtcatggtggctcagtggcagaggcaggtgccagatgggatgctgagccctgtgtgcccgggtgtgggctgggcaggggccttgcctgcctgcctgcctgccacagggcctactttcactgtgcttctctgggtgaacagcctccctggcagaggcccggtttctgagcgtggctctcccagcttcctgtgttttctgacctgcacagtggccttttagtgaggtcccttgctgctcaggtcagccccaggaaggttctggtgctcacatcccagaacctgctggtctctgggcctcagagtaactcatactgagaggagggaaggatgcccaggcaatactgtgcagagacagggttgccacttctggccgcagggaggagtcagagaagacttcttggaggagggggcatttgaaaggtactttgtaggacagagggcctggagggaggttcagatcctggccgggcagtggaagcctggcccttgccttatagcctctttgaaatgtaaatgatgctagtgcctgtgggatagggcctttgtgaggagtaaatggttgaggacagcgcctggctaatcactgatcaaaatagccccctcctgacaggggattaggttcatggctgtcgtatatacgagaccaaccatctccccccacactctgtattgatggggagtggtagagttacacttctgctctgagctcagtgcatagacatcctatcttgttgaatgtgcacgacacctcgagatgtaggcaggatccttccttttttacaggggagaagacggggccttggtgaggtgaagtagttcccagggccttccatccaggtgatggagccaggaccttgcttctagttctcctgcctcccaagcttggctgtttcctacagctgcatacggccccacccagagggaggcagtcaccagagaaagagaatggcagtgacccagagggggcacagagctacttcctgctcagggagtgctgggcagcctcctgcgggggggagaggggggcattgaatgggcccttcagagaaggctgggagctcaccaggtcctgaggaagaggagggactgcgtgcaggaagcctcaaggcacgagccagcttagcatttgggggaactccaagtatttggtgtatacagtgtctgcagggtgcctgggcaggggtgttgggccaagcggtgtggcaggggaccatgtgtgctctggccaggggccttgacctcattctgttggtggtgagggcctctgcaggtggggagtggcaaagtggaccaagaccgcctctcctccactatctcccctccctacccctgctctgtccttataccccaggccacagtgaaggacattgggccgaggccctgctttcataggaggaagcaaagctctgcttcatgtagctgaagcccaggctccccattgtccaccctgacacagaccctctgagtcctcagttttctggtctgtaagtggctatgaagtctgtcttgcttctcctcccagagaaatcatgagcataaagagcctgccagacgtgtggatatgcggttttaaagattaaggcagtttaaccaaaaagaacaaaacattggctgaattaatagaagtggcactgggcgttcttcccgtcagcctgagttggaggtggggtgcctcccagcaggggctggcaggagcacccgtgtgcgctctgaccccatccagagggtttctgggtgccctgcacagcgggacaccctctggaggaggccctgtggggaggacagagggccagtaagaacactcagtggccttggagaagcaaaggtgtcatttgtcccctcccaaccaccctgtacttcctgtactgaaactgacagcaagggagactttggcagggagaactcccagtttagctcctcaagtgtttttgaggctgaataccagcctgacagcttgctggcctgctgcagggtgtggggctgagacggcctcagcgacttatcacagcgaccctgtgaggtgtaggtgcgtcctggtcccccattcagtggtcacagaagcacagtggggtttaagtgaccagtcagatctgcgagcagcggattcaagattccagagtctggggatctgacaccaagcaccttgggctggtaaagatacaaagtctccagcaggcacagggtggaagaggaggtttctgtttttaatttttttttgtagacaaggggtcttgctgtgttgcccaggctgatcttgaactcctaggctcaagtgattctcctgccttggcctcccaaagtgctgagattacaggtgtgagtcaccatgcctagcaaaaaaagaggaggcgtcttgttgacatggattgagagaaggttgagtagctgagaaggagagagaacagcctctgtagaacaaggaggtggggggtgtttctgggtatggtgagcatggagcaaataggagagggagcccaaagcatgctggggccagagcctgcccaaaaggcctgtgcccagaactctgggcatcgtttagtaggaaaggggaagtcagtggtgggctcttgagtttggcagcacccccgtgagagctgggcgtatgcaggcggacgctgtagccatggcagcaaggtcggcggtggtagcaaagggaacttaactcccaacttgggacatcttttggggctcagttcagagaaaaactgagcaagaaataggtcacaggttttaggaacggtattagagtatcttattttctggcatgtccaggaaatgccattttccactggatgcattttttagatagttgcttggcacttatgtctttgtcttcagaagaatggttttccggttttaaacacatatctggctgggtgcggtggctcacgcctgtaatcccagcactttgggaggccgaaacgggtggatcacttgaggtcaggagttccagaccagcctggccaacatggtgaaacccatctctactaaaaatacaaaaattagccgggtgtggtggcacatgcctgtaatcccagctacatgggaggctgaggcaggagaatcgcttgaacccaggaggtggaggttgcagtgagccgagattgcaccattgcactccagcctgggcgacaaagtgagactctgtctcaaaaaacaaacaaacaaacaaaaacccacatatatcccacttttctttcccttccaaaagagagtatatggatataatttaatcatttttcctgtgttatgtataattgtacaattagaaacaaccaaacattaaaaggtagggaattgattaaataaattatgcttgatttaccttttaatgataatgctttagaagaatatgcaatgttggctggacgtggtggctcacacctataatcccagtactttgggaggctgaggtgggcagatcacgtgaggtcaggagtttgagaccagcctggctgacacggcaaaaccacgtctctacaaaaaatacaaaagttagctgggtgtgattgctcacacctgtagtcccagctacttgggaggctgaacctgggaggcagaggttgcagtgagctgagactgtgccattgcactctagcctgggcaacagagcaaggctccatctcaaaaaaaaaaaaagaatatgtcatgtcacaggaatatattccttatagtttgttaattaaaaagtaggatccagatgtttgtgtagtataatttcagttttagcaaagataaatattaaaaacttggaggagtacgttatgtaatacaaatgttacaggctatctctgagattaagttaaaatttttcgatccctgagtaaataactggagatataaacatctcttacaatggacattaatttgatcagagaaaaaagacagtttttttgaaaagctgtattactttatagacacagctggtatctttattctgcctgagtctcaccatctccactgcaggaggcagctgggtcatgttaagggttcctagagccccaggtggcactcttctgtcttccttgtctttaacatccggaccacaccttgtcaggaagctgagtttgaatctcagccccgggctcgccagtaggagttcttgagtcctgggcctggccttggactcccgttgtgaagtgggagccagccttgcaggtggctgctcaggtgagcatgtaaggtgcatctaggtggctggggcctggggctacatcctgaagcttacctgcgccttcagccagtggctgctgtttattccagcagtgaaacccaaccgtcacattccttgaaatacctttaataactcttaccaaattttgaattttcagtgagtttgaccttgaccatctgtttgaaagaaaggcagacacacacccacacacacccatggtgaaatgcaggcaggatctgacgtcctaggctgagaaatgctggtctcctcttttcctatcaacactgccctgttgaccatgcaaggggcatggagatgccattgtcccggggtcagagggttggcagggagaattgctgtggctccggggcttcctgtgtaggccccagggattgggactggcctggctcagagcaggagccacccagggagcaggggaacagccttccagggcctccctggtccagctgcctgggcctgcaggctcttctgaggacagagccctgataagtgagggtcagtgcccaagaaaaaaggagcattgttagggggtgggggccgggggaacagccagggcattgtcgccgagccgggaggctctgtgtgttccgtggctttcccagctctctgacagtcacaagcactgaggtttggggcttccaccccttgacagcaggtaggtccctttttggcagctgtcagcatctctcagcccttctctgctctgctctggggggatttttcttggcatttccaagttctgggggctgcatcctcccctgcggtattgagatgagtgggagagaatgcggtgcgggttgttggtaacgatcccagagcccagagaataggggcagtgttcctgggggagagccctcacccggcccctggggtgctgagcctggtgagtcatgaggggtgtgggccacagaacgccggggagagtggctgggggttagggggtgtggagaggctgccaccagcaaacagcaagagccgtgggggtcaaatggggcacgtgctcccaccagcctctcggaggaggtcacgtgtttgtcattgttggctgtgtctgacgtgcgggaaagcagccgtgaatactgaggagcctgtcacatttgttctctcagcatctttggtttatcttaaacctcagtgagatgtttgcagttcttctcacgctgtcacagagcatgaccttgtggcctcaaccggatgccctttagacattgcagtccactgcaccatgtggacctcctggggcagggctggttgctataggagcggcccttcccagtaggacggggacagtgtccctccggttgtggcctctgctccccgcagctcttgaagttaccgaccttgggctcctgggaccttgggctcctggggaggggcaggtctcactgacgccaccattgctttcgtagccctttcttggaaagggtggccttgggcttggcgagtgctcctcccacctgtttccaaactctgaggatgctcctcaggaattagaacaattcaaattagtcatcacgtgccggagtcaggctgggaagaggcagccacttggcaccacatacatccacctgggcctgccacccttagcccaggccttggacctctctggtctcctggctaggccctgggcccagctggtttctggtgggaggtgacaggcccagtaactgaagcaggaggctctggtccagaccgacctgggtgggttgaaacctgcctctgccacctcctggtacccaggagggtgaggcagctgttcacggtgctgtcgggcaccaggccctggacagccatggttgttcccattctgggcctcatgcagtgcctggtagaccactgcctcccactcaccagtgtcacagcagccagacaggtttctgcggcctgagccccctccctccctccctcccgtcctgtttcctaggcagcatggcctctttggccatttgttgacctcccattccccttggcttctcagtgcagaatttccatagcacatcagtctgcactggtgatttggggctctctggtgtacatgtgcagatatacacacccatgggagatgagggaggcattccactgtccttcaaggctcagcttacctgccatctcctttgagtcggcttttgactgcccagcgtgaatacctgtgcctgcctttgtgtgctcactgcactcttttgggtcattctggaagagcctccattttattttgcctcactggcccaactgccaaccatgtctgcccttgaggccatccctgctgccctggtgcagcatgaagtccacagcgagtgcctggtctctatttgttgaatgaatgtctgcaacgtaatgtgaccaaggtcccacagatcagcatcctagtgagctgagagctcaggtgagctcatctgtgtgtttcagagggggtggtgggcagaggacagcaggctgttgtcctgaagcccctagaacctagcggagaagaggcaggacccaaaagaaggaggtgtgttcaccctgtaggacttgctttgtaggtgcaggtgcccagaggccaggcccgtcagtgctacctggggtggggctggagaagggaaggcctgccaggccccataggtgatgggagggccaggacctcaggttggagggaaccactgaatcctcggccctgtggtgcaggcccacacagggcatagcccctgggcactggcactgcccactgcccactgcccgtgtgtgctggggccatgccagccttctccgctgctaaactggcttcttcaccctccctcagtgggcacagctgccgcttccatctcagtgtctgcttctcccttgcttggtgggtcattatgtgcccacttagccataggctttcactgagtccccaccttcatgcaggatgtgggaggtcccaggggcccccaggcagctcaggctggcctgccctctagtggggagcagagcagacagatctcccagcccagtgggggccagctgtggtggagcccgcctccccattctattcttggagaggaaaagcacagaaatacaggagtgaaggcacagactgggcagaggggccggagtcgccctctgaggaggcctgtagggcccccagaagagttttctgggtcagaatcaagagactcaggagcctttttgcattttgtgagcccagtcactttgcctctggtcagggtaggttttccagagcatcttcctgctccgacagggggtgggggagtgttgggggtgggtggtttgccatgggaacccccggctgctgcaggtgctgtgtggctgaagccacctcccagttcagtgtgctgggggcaggatgtgggggagggcacctgggaggaaggtgtcggggcagggcttaccagggacccatggggaagtattagacggcttttggggctacactttggatagggagctgggggctcccagcatcagagcccactctttctcccccattcctgagtttggaaaaaggctgccagctggtgcctcacccctgcccctcaccagaagaggtcctgtgcttgccccctgccccatcctcagtccccagtcccacagctgctgtgcagtcctgcttctctttctgtctcctcccctgcatcattcctgccctagctctagacctctccacctagctacccctgtgctgcccgagagccctcctgtgccccaccacacacccacatgcacaggcacgcacattcacacactccgttctcttccaggagaaaccctccctggttcctgaggccctggggaccagtgggtgtgtgtctgtctctctctagcgcctctttctcctctctgcctttccttagacacgtacctcttacctcctgtctggcctggcttcctccatgaagtgctgtttggttttctcagcaggagcctcccagccccaaggctcccactgttcctctaccagtcctgtcctggggccctcactcctgggtggtcactgttgactgattactcatcagtggtccctctctagaccctggttctgatgtctgtgctcagcagggctggcccagaggaggtggtggggaatgttggggggcattggctgttgtggggctttgaggaagcctccttccttctctggttaggaagttattgcagcagatccagcttttcttattctccttttcacaaggctcacaggtcacatggctgctgcctcagagtccctgaggcactgctgtgccaatgcacagttggtttatcttaacatcacccaccccaggaaacctcccttgaccctgtccctaggcctggctgagatgaccttcggtcctactctcacctgtaggattgcaggaataacaaatgacacttaatcacaggcctctgagcaaaaactgggacccaacaaatttgagtgtgctgatttcatttgtagaccctgggaaaaccgatgcttatacctttcccaagccctggcagggcattggcacagatctgctttcaccctgagtctctctaggtgtctctgtgtccatgccttctcagcagctcacaactgctgcccagggagatgaagcccaccagctcctttgctaaagggctcaccccctagagaaaagggctggctttgcagggtgcacgatccgatccgtgctggcctttgtcacccgattccctgagcagctgctcagagctgtggagtacgctgcagtctgcagagtgcgatggccccttcgtgagtcccagcaactcaccagggtcacagccagagctgggtggacatgtgccttctagatgaggctaatcggaagatattcaagggcatcaagctgccccgcccagcatggtgtgtatgtggtccctgggggacttcctcccattgagggtggggcaggtcagatgtgggtcagtaaatttctgtgacctggcagcattctctggaattctcccaagtgagtatgcaagggtttcagtgtcagcttcttcctctctgcaaatctctgtgcaagtgaacatattaaagtatctgagaagtcctgcaggaaagcttctgctgctgcttagcttgacgcaaccgagtctttgcaaatgattttgagtactgaacttccccttttcatgtgatgtttaaaaggttgttaatgctttattattattattattattatttgagatggagtctcgctctgtcgcccagcctggagtgcagtggcgtaatctcggctcactgcaacctccgcctcctgggttcaagtgattctcctgcctcagccttccgagtagctgggattgcaggcatgcaccaccatgcccagctaatttttgcacttttagtagagatggggtttcactgtgttgcccaggctggttgcaaactcctgaccccaagtgatccgcccgccccagcctcctaaagtgctgggatgacaggcgtgagccactgcacccggctgctttgttactattatatcaaataccagtttggaaaactgcctcaaggaatgctctcttcggattggaaagcaatgaatatagaaagagtacagcttcagggcttaaataataatctatgcaggctttgtaggagtttgagtcagagtttccctccttattgttaaaaaggatgcatagaaaatttttttgacttggagaattctttgccacttgtggccggggctgccagttgccattctagggggaacatggagataaagcaaacattgaaatatgttttttattgtcagcaaaaataaacatcccaggccggaagccagggtgtggaagggaggagtctggggacatgaagtcggaatcccacttggggatgggcacttattctcttaccaccacctcttggagccagaccaggaggccttaggggggtctatggccctcattaaagcccaggcccccagcttccagacaagggaaatgatggctcgaggtcccacagcaagtcagtgccaggctcctgacccctggcccgctgctgtcttcgaagcatcatggtttctgaaaatcttacctaagtcccttgttccatgaggccataaaaatggcaactgccatgtatgaagcgcttacagcctgtaccaggcaaggtgctgacacctcacctgtgttaacttccacagcggtctctccaaagggactgaggcatctaactccctcactcatggccttttgccagcttcccccactctgaggacactgactccaatcgtgcccccacctctttgtcccccgtcccctgcacccacgctggcctcctctgctcgggacccctgcacttgccttcttcttagttcagaacattcttccccaggtctctcctgggccttcttcttgcccaggccttccttagagaggccttggattcatttgccagtgctgctgtcacaaagggccacaaactgggcagcttaaatagcagaaatgcacccctcccagttccggaggtgagaagtctgagatcccaagtggggctccttccgaggcagcggggcctgttccagccatctctccctgctgggggtggattgccagccatctttggcgttcccgggaatgtagaagtaccgccctcatctctgccttcatctcctcacgatgttcctcctttgtgcgggtctgtgtctaaatttcccctttttataggagcaccagtcatcgtggactagggacctacctgctctggaatgacctcatcttaacaaaggtcatctgcaaagaccccatttcctaaccaggtcacgttctgaggtactaggggttaggacttcaacataccgttttttggggacacagtttagcctgtaccaggccttctctgacgagtgcccccctttcctatcatgccctctgcacttcattgatgttgcagccctcggtggtgcctccagtcgcttcctttgcttgtttgttgtctgtctcccacactaggctgtgagtatgagcactgaggacagggacctggcggtcatcttcacgttgcatcttcagagcttgagcaatgctaggcacaaacttactctgttcacttaattactcaatgaatgagtgcatgaatgaatgaatgaatgaatgaaagaaagaaaagaaaacaagtcctgttgtctttcccatgcatcactcacacaaactgaggctttgagaaaaccagaggagagtaaagaacaggcttttgtgtgtgattcatgaagcagtaacggtttctcttttatttacattttggataaagggcagaagcaagaagggtggctgtgactgcattcttgatgttttcagcatttgtcaagtgggacgtgtcacctcattttatttttgcacattccccagtcagctctactgagtgtaaatgcggggtgccgctctcacaccctcagttcccatgttggcagttggaagggagtgcagcctgcattgcgcgctaacttcgtgcttgccatctgggagggaagttgggatccaggtggtgcagtcctggatctgaaatcctctgtgggaagtgcagagagacagggtagctgggtttctggaagggggtagcagcctttgaattcatctggctgagagctcagatagaaatccatccctcgccacagctttgggacagtcagatgtggtgcaccgaagacaatctgctggggactgtcagtggcttcctttgttacccttgccttgtccactctcttgggcctgggagggtcagtgtctgtgactgtttgatccttactatgcttggctgtagaggaaggggcctgcaagatgctcatggcctgcttgggaggacaagagtcatgcccaggaagccgtgccagtgaccaagggtggtggctcatctcctgccttgtgtgcttgttgtcagagctgtggcatcttcagccctcaaagattgtggcctgccggcttggctaaaagcacagctgcctggagcctctgtgccttttgggcttcctggggcccatgtctcctctctgcaaggtgcaccctggggctgaagctcgggtggctcgggtgtccttgcctgctctgttgcccagagacggctttatttttcttaccctgctaggcccagggcatgtgtggcttattcctggggctgcttgggacatcgtggaattctttaacctgaagattctcacctctcccaccataccctccagagtccaacacagacacaactaagctcagggtccccaagggtccagaccccaggtggaggtgaggggcgggcagtgtgaggtgttggctctagggaagggagtggtaagaaaacatgggcctgccgcttactctcagtgaccttccacgagttccctcatctcatcatgtccttttttcggagcaaagcagggataacatgtccttggagggtggttatggaaatgcccaatgcccaatatatactgtatggataggtgaatggcatgaatccctccagctttggggaatcaattcagtccatgttggctggtttctagaacaactgggcatgatgccaggccacacaggggccacggggaggaataggacatagtccctgtcctcagggagggggcacaggctaaggagaactctctgcaactcatcagccacgtaagctcagtcagcttgagcgtctctgttctccctgagtaggcaccactgcgaggaggcagtgaagtgttctcaatgggagggaggagccacagccccatcatcgtgcctgggacgctgaggcttagaaatgccgaagctgaacctgaaggcggttactgtttggcgttagaggtgggagatccaatgggaactgtgattgctgaggttccggagggtctgagagctgacatccgcttggggaggtgcctgcagggggcctgctctgggccaggcttggtgctaaggcttcaccaacactgtctcgtggaatgctgatggcagctgtcatcggctgtattgtaccagtgaggaaacagtgtctcaagggggttgaagatcactgactgaaggcccaggtctgcccacagctgcctccacccctccattgcttccagtatctgggacttgagttccaaagccatccttggcgtgggcacacagtgagcagtgcctggggagagattgtcctggctggagagctcgtcaacaggctgagcgaaggtgttagaacaggctgccctgtacctctgggggttggtttccggctcatgtcacagtccagtggagaccagcggcctctccaagcagtgactcaagaatctgtgttcactccatcaggttattctgtcatccaagtctttttcgtcagccacatgaatggggtctagggaaggcacgctgttcatcatacacttgaactagcttggcctggaagcacccactacgtctgctcccattctgttggccaggacgcgtcctgtggctcctgtgcgtgtgcaagggaaccagggcatgttgggcgtgtggctgtgggagagcagcctccgggtttctggcgggagccagcaggtgcatggacccacagtgccggtttcccacagaggtcctctcagtgcagaaagccaaggaccagcccctttttttcccactgctctctgggtgacttggaaagtactgaagcctcagggcagaggttggagagaggagagccaggattccttgggcactgagagcagggaagggttttcagtgagccccttgtgctcagccaaagcagctgggtcaggtggccctgggtgagactgaggttgtcacgtgtgccatttggtgggaatgggggcaccagttggacagcagcagaaatcatttctgttttctgttgatgactgtcttgcttactcagtgactagtgcacgggctctgagatctgcagaggagtcctgaggcacgtgtacacagttgtccacgtgcgtgcacatgttgtagacgtgtccctgtgttggaacatctggagtgtggttctccagttgtctagcccagagtctgcctccctggccccctcccagctccttcatcattagctgtgtggatgaaggcgagttgccttggtgtccccatctgtacaatgggaataataattggctctgcctcatggggtcattgagatgattaagtgagatagttcatgtgaagtgcgtagagttgggctgggtgcacagaggtgctcgatggatgttagttattggctggatttgaatctaagcctgtctgactctcagactccaaacgtgtgctcttcctagagactgctcagttggtaatttacaaactttcagtaagtaaataagacatttcactggttttaaatttctgggagcacatgatgagcagtctccctttcaccctgatcccacaagccccctggtcctctcccctgtggtggctgccactctgaccagtttctagtgcacatcccaagatactctgtgcatatccagtaagatctcacttaacgtcttcgataggttcttgaggactgtgcctttaaatgaaatatataatgaaaccaatttttttctcactgttataaaaaagtgacgttgaaggaattgatgttatttaaggacctgctgtacaattcagttgatactgcactttccaagaacctatccccaatgttcagtgaagacttactgtacaagcacatgttgattttgtgtaacccttttttcccctccccatacatattctagcatggtatactcagtgatcggccccttcttggagatctttccacgtcaccacagaaagcactccccgttctcttctgtggcagcatggtcttccaccatatggatcttcataagtgattcagtcccttcttgttggacttttatttagttactaatttttggcgattacaaacagtgcagcaatgtgtgtgagtgcatatgtgggtgagttcaccctgtgagatcagctcctggaagtgagactcctggacgagaaaggttatgcatttatattgtgatggatattaccaacttgctgccgtcgagacggttgaatctgcatccccccagccctggccgatacagtctgttatccgtctctctgactttcaccaatctggtacataaaacatggttatcataatgtagttgtaatttgcatttgttgtatgaatgaggttgagtattttctaatttttatatgttggaagccttttgtagttaattttctgtacttaacattcaaacatatcttttgttcatgttttctgttgtgttaggttttctttttaaaaaaatcagtttgtaggatcttaatatatttgagagagattagtcatttgtgatataagctgcaaatataatacgtggtgttcctggctaagaggattcatgatcaaaccatgggttttccttaaattgatacataaatataagtaattctccatccaagtcctattctttttttctttttttttagacagggcctcactctgtcacccaggctggagtgcagtggcgcaatccgtgcttaagccaccctcctgcctcaacctcctgagtagctgggatgacaggcgtgggcgtggtgtgcaccaccagcccggctaattttttatatttttagagatggggtctcactctgtcatccagcctggtctcaaactcctggactcaggcgatccacctgcctcaaccttccaacaatcccatgctgggattacaggcatgagccaccacacccagctccaagtcctgttcttaaggatgtgtaggaaaaataaatgagcatgactggtcaggaaaattgtgaaaaagggaggacctagatcttattggtattaagcttatcatgaagcaattgtaattaaaacaatgtgggaaaaagaaaaccaaacgaaatcattgtgatattggtgaaagacaagttaatgaagagtccaaaaaatgtgagaattatgaaaatattggcatttgcaaacagtgggtaaaagatgggtaagtaaatgttgttgagacactggagtgctcatccggaggaaaacatacacagatgcacacctcagtctttcactgaaacaactcccggtggatttaagatttaatgataaaaacttaaaatgtaaaaatagttgagaaaaccgtgggctgatttaaaaaacagtctagggagcaaagatcaaaagatgaaaatatttatacatttgaattacagaaaagtcaagattttctgcctggcaaaaccaccacaactaaagtagaaagacagcaacgtgggcggcgctaggcaggccttaccactgtctgcttgcccccacagcctccattcctgctcttgatttccgggttggggtgccagtgccaggcccttcatcttggagaactctgcaaagctgacagtggtgtgctgtgtcggtggccggcaggatggaaagaccctgattccagccctggacaggttctcgcttcctgacccaggtggctctcaggagatggcgttgtggttgaaaacttgaggcctgccagctaggatttcagaattgtcctgttctcctggaactggggcaagtctgggttgttgacgctgtgcttgtgggtgcttccctgcctctggccccctcagattgtatctcggaccacatgatagctccccccagcctcaatccctgcacatcaggaaaggacgtctagccagctgtgttgtcggcccactccccttcctgatgaaggcagaaggctcaggagcctgtgtcccggagccacagggacctgggggtgttgggggagatttgctggttatacagcctcagttcggttgttttgcctcttgacttccttgcttcatgtgtaaaatggtgacagtggcctctgcctcctaaggacatggagattatgtgctaaggagattaggtctgtcatttgctcactgcagcacctggaatataagggtcccggtagttctggtggaggtgattatcagaatcatgctggtggaaagccaaagaaggccagaaaggcctccgctgaggccagagaacatccagcctcatgtgaggaagaaagtcctatttgctgacacctgtacagcatggtcagctctagtcacagagggaggtaatcgatggctggccctggctgtgtgctcatcgcgactataggaaggatatttctttaccctcactccacaggcgaggaagcaggcttggggaggggagggatgtgcccttccccaggctgcacagctggaggctcagcccctgccctctaacccctgggcatccttctgcctggggagggagcacctctgtgcttgaggtggcttgggaagaagagcactggccagccatggaggagtgctgtgggcaagaggattccgcgagttccttcctccaggcctggcaacaggaggttcatgtgtgggatcctctccgctctccccgcaacacacacagggcggtcaggctttgttacgtggcttctgactccccaccttgtggatccagacctgccagcccttttatgctccctttttttctttttctgctagcctgtgattcgtactttccccccaggacaggactagattggtgcctggcaacagaggggaggggttagctcctatcagctctgactctggcctctcaggtgccactgtgaacaataacacagatgaagcagccccttggccaagatgcacgggatcgagggactcatctggcaggttgaggggactgctaggggtgagctttcctaggatgctggggaatagccacgtcgtgatgtggctctatcaaggctcctgccttttgctcctaagggctctgacaagttatcttccccttacaggataaatccccattcctctctcatccaaatactaataaactacaatgtgaaaaaaatcatagctaaatcctgttctcaaccttgcagttacctgtcggggcctgtttgccttaatctgcttttctccccttccctttcccttcccttccatccttcctttgtttcaacaaatgaaaaagaaaagcttggggtagggggaccagctattttatgaggacagatttggttgtgctgtattaaccaacagcctcagaatcttagctgaaaaccgtgggttattccgcactcatgccacatgtccacagggccagctgggggctctgtccatcttattcactcagagatctaaaactgagcagccccatctggaaggttgctggtcctgcaccagaggggagagagggctctggagaccttactcctgcagttacatgctctgcccaggaaacggcatgttctgttttcactcacagctcattggccagaacgagtcacatgatcacccatttaccagggaatcaggaagtgcagtcctgccttgtgtccagaaaaggggctgataggccgtgtgcggtggctcacacctgtaatcccagcattttgggaggccaaggcgggcagatcacatgagatcaggagttcaagaccagcctggccaaacatggtgaaacccagcacatctctacaaaacaaacaaacaaacaagcaaaaacagaaaaggggctgctatacccacagtccttttattttcatattctgggttttcttatcagccttttccacagtaaatgttggttcatgtggttgtaattcaagcacctactcttatctctatcaagacctcttcattgtcatctcagttactgtttttttctttgtttttgtttttttgtttttgttgttttttaagagatatggccaggcacagtggctcacgcctgtaatcccagcactttgggaggctgaggcaggtgaatcacttgagtttaggagttcaagaccagcctgcccaacatctggtagagatgagtagtgaaacccatctctactaaaaatacaaaaattagctgggtgtggtggtgcacgcttgtaatcccagctacttgggaagctaggcaggagaatcacttggacccgggaggcagaggttgcactgagtggagatcatgccactgtactccagcctcgacggtagaccgagactgtctcaaaaaaaaaaaaaaaaagatgtggtcttgccatgttggccagggtggattcaaactcctgggctcaaatgatcctcccacctcagccccatgagtagctgggattacaagtgtgccccactgtgcccagccacaccatctcagtggctcttgactagccctttgtggtggcatgcccagcattagccagcaccccgttttcacacatgctctctgtgtcttttctcttgtcaatatgttgtcagtgactctccctaggccagaagtggccttcacttgttgatcatttccttaggccagcatcctgggagtgggtgtgcttatcctttgcctgctcttggacctggccttccagcacccagtgttgggaacgcagaacaggactggcccatcctgagaactcagggtcagtcctattcttaaggagctgtgcttgctgaatgggtgtagcttttctgggtctaatgtcagctcgtaaattcccagaactttggctctgcaaggtagcaccatcctcaggccatttagttgtcttgaccctttatcttctagggagaaaagttacccactcttatgccttcacgagtttgccgtttcttcccattatccgagtaattggaaaccagttactcagaaatcagggaattgggtcagagagcattttcaacagcttccctccccagcctggggcagaggctgctagggtgaccagtaccatccttgtcccagcctgctggtcttggtggcagccccaaatgacctttagctcttgacctctctggagcacctttgagaatgagagttgttcttgccagggaaaagactccatctcctcttctccagtcttcctttggaatcaaacccactgaaaacacaccactggcatggagtcctctgaggccaagctcgtttctttttctttttcttttctttttttttttgagacagggtctcattctgtcgcccaagctggagtgcagtggcatcatctcggctcactgcaacctccgcctcccgggttcaagcaattctcccacctcagcctcccaagtagctgggactacaggtgcacaccaccacacctggctaatttttgtattgtttggtagagacagggtttcaccatgttggccaggctggtcttaaactcctgacctcaagtgatcggcccacctggcctcccaaagtgctgggattacaggcacgagccactatgtccggccccaacatccttctggaagtctgtccatgaggttcccagatctgactttcccttctggagagacctgcttctgcttggcaaggcctttgaactttggcaatggcagttctgtcccagattctcagatccatggagagggcagaggaataagtcagacttcagccctctcaccctttattggggccattttgtctcaagcttggttgggacaaaacttttcggaagtttccactggtcagtaataataagaatagtaagtatagggaaatacaatagctgacatttattgagtgtcactggctaggtactgctaagagtgagtgtgaagttgtgagactgtgacatgttatttaaccaccctgtgcctctcatgagtccccgtctcagactattgtgagaattgagcaactcagtgcatgtgaagtgcttagagtagagcctggcaccgagcaagtgtgcaagagctgggtgctagtgctgggatcgcgaggcttcttgctttaaagacaaggaaactgaggttcctagagggcggtggccacacagccctccccattatctgagtaattggaaaccagttactgagaaattgaggaattgggtcagaaagattatatgataccgtgggggaagagcagcccccagcgcaggagcaggagacagtggattaaagaatcagcatcataactggggttacggtgcaatcctggagcgacgtgcaaagggttctggggctgtgggcaacacaagggagccactaattcttcctgtttgggctgaggtgagttgagaaatgtgaaagaggattgaacttttgctctgggactcataacaatcctgtgaggtgcagggaagggtgagtagcatcctcattttatgactggggaaactgaggtaccacacagctcagtgacctgctcttgttcagaagcagtggattggagatgggtttctaggcctgtctgcctggcccacccctccccagttccagatcctgggagagacagggatagtgtcagggcctagctcagcttggttaccaggctgggtacgattgggttaatcattttggaagtcaaagaggactctggggccactggggtttgcaggcctttgtgccgtctcccagccctgcccccacctctagtaagtctctgccttcgtccctgagggaaacagtggccccttgttttctctgagttctgaactccaagcgccacacagagcaggatccagcatgggccctgcgagatggcatgacttggaaacggagtgcccacagacctcaggccccggcgggcagcctttcattgagacacccttgctcctgctgggagggacaaaccagaccccgtcctctgaggagaacaagaagtccctgggaatgttcttttttctgggggcagagtgtggtcagaaaagcagaatgacaaccttgaaatgagttcctgtccccatcgcatctgggagacctgcctctgtggtgtccttccccccgggcatccccctgcacagtgtccttttctccgtggcctccccagtctcaggagctgggccctttctcctgtgggggccgcacccaagggcccatctcttttctagctagtggagggagaccgcagcctgtttgcagtgtgttcaggggacagaccccttcagggcagttgtggcatgtcaggcacctgaggaagagccactagagctgccagcagccctgctggtacccagcacagacgccacagcgagaggcggccgcacccgagagcagcccaggcctgatgtgtgtcccaagctgctgttctcacagaagggttttactggcatgaaaatgcttggaaaatacacaaaggagggtggcccgtttccagagctcagctgtttaccttcagtggagcgccggggatgcggagagcttattttccaaacagctgcggttgtcaggtctacgggcctcaggctgatgccaggggaggacaccaagggcgtcccctctgctcacctccttccccagcgccaagggaaccccacagtttctcccaggcagggaaacctggagggctgtctggagatgtgggtgctggtgggcatgggggttctgtgggcccggatgcgtcgctcctgtggcccggctccccctgcgctcgtagctgtcttggcctctcgtttgtggtgcctgacccaccgaagccacaggctgtagtggaaatgggttggtgtttggctctgtctgagagcccagtgttctctgcccatggcctctctaccttccttcagagtctgctttttctgggaagaggtattgggtggagtgtaatttggaatctgtgaagagagccatcaaagctcttgcagtttcttgtttctatcaaaggggaaactgaggccccaggggatggtgagcccaggtcagcgggctgctcatggagactgacacatgggcattgctgcacagcctccatcctggccgcttcacctgcatggccttgcttggtcattttccttcctgggccgttggtgtcctggtctttgcagcagggagcgtcttccccggcccctgggcttgccgtgaggatgagccggcgccaagtctcaggagatattgggaagtgtctttcccttccccttcctcacccaagagccccagagatgggcagcttctcagctagcctggttttggttttattttatgttgttttgtacacaggcctgtcaccatggggagggaacagcattccttagtagtttcttattgtgaggtctaaaggatattttttttttctatataggggaaatcccttaacatctttcctggcaaacagtaagaaagaggagttaaagacaccagcagacaagagctgctgcgttccgggggtgcaacggagaggagtttagtaagggaccatcacagggtgtgggcaggcccgagagccagcacaggacaaagttccccggtgctaacaagccctgagagctgtcaccacccctaggcctgaggggactaggggaccaaaaatgtacctggagccataggggaggcggtagtgttgagagaggggctgccctgctccatgggggctgtgactgctgccagaaatatggcagggggtgggggcgtgaggatgctgcaaatacattccctccctctctccttcttgcccatcttctgctgtgcctccagttggcccgacttggccagaggacaaggcagccaggtgattgtggcctgagaggacagctgcctagggcacagagcaggcgtggggagcggggttgcaggggcaggcagcggggaatggagtgagaagcgcagccttagatctgagtttgtgtccccacttcaccgccttcctgctgtgagaccctaggcaggttttaaaagtctccgtcctccacttttctcattcgtaaaatcacttctcatagtggttgttaaatacaatgaaagaaatgcacgcaagctttgagcgtggtgcccactgccagtgaccatttgtagttgtcattatgatgtctttcgtaacatttttaaaacagtcagccttgaatcctggagggaaacccacttgggggtggggatgagagcaggggtggggcttgtggccttctctggcctctgctaaggccagattgggggtcagccaggtgccgggctggcgccgctgcctccgaggcactggccttgcaggtggtggtggccgcgtgccgggagggagacatgtggcgggtcaggaagcgggggtcaggctgccctggcttttggcaggtgctcctgtcttggggtcaggtgacgctgactgttggccagaggctctggctctcttggggcctgatcttcccaacctcaggcacttgcaaaaataaacaccttccctggcatagcaggagagcagtatggaacagattgcaggcagccctacgcgccttcgcttctcccgatgagcccagatttcagtgtgaagtgcaagtggctggtcgctcaaagcggcaatttctagattcctgaggaccacagctttgctaaggctttttatagattagcagaagcagtatccacttagatctaagttctgatctggctgtgcgatgttagtcatttacataaccccttggaaccctagttttcctagggcagatggggtgtgttgagaaaagcctttctctgtaaagccatttctcagcatcacttgcctggcctgttgacactattgccctgattcctcttatgtgtcttctgcatcctgggtagcatggggcttggggaacagaagttacaaacgtggggtgtgcccttgaggagttagcaggagagaagagttgtggggtcttggagggtttgtcctgcttgtcctgtctgtattttccatgtcagccctcctcctgccccatctccagagtgctacagggaggctcgagggtcctctggtgatatgccccagggtggacaagaggatgggggcagtggactcaggtgctgaagttgttgcttttgtctgtgttccctgcctcacagctgaaccttagccggccgatcgaggagcagggccccctggacgtcatcatccacaagctgactgacgtcatccttgaagccgaccagaatgatagccagtccctggagctggtgcacaggttccaggtgagtgaggaccatgcagcccttggctgtggcattttcaggaggaggaggggaggccctggaatggccgtgtgtgtatttagggcggtagcagctctctggaggtatagtctggagaaatggctctgccactggcaagacatgggctcgtgggcaggtacttctgtgcggcgtcagtgtcctcgggtgtagcgtggggactgaaccagggcatggttgggccgtctccaccccctggctgtgtagacacggtttactgatgaggcatcgctgagttccagtgtggcctccacgtcctcagcacaggcatgtgcaaccctttcccctggctcaggtaggcacaagggatggaacccttctgctgcacttggtaaaggggacccccgagggcctttgaactgagtcctgccttggtggagaaccctgcctctgcccattactttgacctgggtactcacctttgagcatggcctgaggtatcttgctgagtcccttggctgcttccctctccccacaccacttccccagcggcctcccaggtcctgatcgcacagtgacctgcccactgccctggggttctcatgctggctactgacttgtcctgtgttctctctgttgtggacaagaacgtgattctgtcctctagaaagcggctcagaggtcatgaaaaacaaagttgtattgtcagtgaaagtgcagtcaagatggtagctgttttcaggtgtgcctagtgggatggggatgcctgagatggggtttctagcgtgtgacaggcgcagatttggtgccctgcttttcttcaccaggacaaagggaatcttacccgcctcctagtcacccggtgctgccgtcctgccgacactgttctctccccgtgtgttcggggtcagccgccttggccccccttgcttccttggggctctcaccccgttccttggccaactccctgctgcacattcctgcttcccaccaggaagtggccccggacacagaggcagcctgctcctggcatcccctgcttgggggcagggcatgtcccacgttgtgccctccagggcgtctgccctgccagtggccccaagtccattccacttgctgaacactgtctccttgatcggactggagactgtgggaaaaacatggtcgggctcctctgtgacctcgtggagcctcagtttccttatttgtaaaatgggtgctaggaataagaaaagctcagaccatgttgggaggagtgtgctggggttcgaggggaacaagacagaggagatgtgtgccctggtgatgtgctgcttcctgagtccctgccctgtgccagggctgggctgatcagcactcacccatgtgctacatttgatccccacagccctcagtgcagactcaccagccttgttgataagcaggaagtggaggcgtggaagcatgtgcagcttgtccacagggacccagcagagccgggggtcagtcttgactttctcaggtgagccgctgctcatcctgagggcttgctcttctgttcctctctgcctccaacctacacaactgtcctggggtgtggtcccagctgatcccaagtcatacagcgactttcctctcccctgagccatttgctcctgcctcacccccgtctccttcggaaggcccctgagtgcccagttcatgtgcctgtggtgcccttggggcttattctctggaggagcacagccatgcctgggctgccacgcagacctttggggcagggatggtgcatctcttgctgagtccatctgggggacgatggccttccagatgcctgattaccgttacctcagaaagcactgcagagcagttaccgcttaccaagccctgctcgaaagcgcttcatggcggttgacccacttgctcccatgagctgtaaggttcaatgattcccgtcctgtggaggaagaagcagctgcaggacaactagaaagtggtccaggtgggatttgagcctgcgctagcttgctctcctcacctgtcgtgtggcctctccagagatggatgaggcggaggacttgggagtcaaactgtcttcaaggcagatccttgttccaaaacttaggaaccgcgtgcctccccacagcctcagttccttcctccttgggtgggcaggttgctgggaggagtaaatgcctgtgggtgtaaagtgcccattgtagctgagtgccacttcatcacacccacacggttgctcttcctagagaccacatctcccagctagcctgggcccggagttctggaacatctgctcccaagctcttatccctcttgcccacttcccagacacacacacagcccacagcccaggcaagtgatgtccaaacagtgaatgagagtgcccgctgtgttccttttctgggcagaaaacaatattaacagggagcgtgtgtggagggcagcatggggccttgtggcttaaggctgtcaggcagccacaggtgcatttctcaggcagtgtcttgtctgggtcttgggggatggttgccgtgacctcaccataacctcccagcactgatatttctgggataaattttcatcaccgtctgtgcttcagtaagaggccggatatctgataaggtgggaagtttcctcctttgtgaggagaacaatcctttggagaaaagggtgcggggctgcactttccagaggccccaggagagaggaggcaggcagggttggcacagagaatgactgagaggcactgggatgggggctggggaagaggcttccttctaccaccggtcactgggctgtcagcattgatcgtccccttccctctgccataagatgcaagttcagagccagaccacatagacccagggaggcggacacttgacctcagtcgtgccctttgttttcagatttttgttttaaattttattctctagacattaacaaggaggcatgagtgtggtttgaggactgggagggatagggatgctataggcagaggcaggggaagcagcacccagagctggggtcctcccattttgttgtgagcagggaaaccgaggcaagatgctttgccccagcagggactcagcttgaagggccttctccacagtccatactcaggtcctgggagggaggaggaagtggtttggggctgtgtgggtggagaaaaatgaatttctgagatgttcctcagggccccagagcactgcactgggctgcctctgtgaaagttccggtccccagggagggaagaaattcccagagccaggaggccgtgcctgcttctggctgccctggtgggcaggtggaggctgtgggccagaggcttactgcagaacattaaagctgcttgtcacagaaccttcatcactgccccagagttttggattttttttgtttttgtttgtttgttttttgtgtgtttttgattggcttctaaatggcttggcttggagactcaattgggatgattcagttgtttttctgctccaaggttcatgtggagccagcagcctgttgcccctgaggctctgcctgaggtttggttctcagtgtgcagaaccaggcaggggcccccagggcctgcccacgtgggcaagtggggccggcatgccgagagggtccctgcctcaggctcggggacactaggggcctcctggcctggtgagtggctttcccaggggggcaacacgagccttctcctcgctgtggcgcccagagccacctgacaggtgtgggtgcagggtgggaagggaggggcccaccgtcctcttctgctgccccttctagccctggaattgcccctgaaggggtgctgtgattgtgatccatgggccatgtggggctgcctcgggggaccttcctggggttctccctgaataagcttaggactaagaaggaagtttcagtctcaactgctgcctttgccctgtctttatcagctggaaggacggtaattgtccctcagatgtcccctgaattcccggtctgcacacagactgctaggagagtgtcctctgcggcagcactgctgggtgccctgcccgcgagctcctggccaggaggagaggccagcaggcagacccagaactgacctcacggcccctaaagtgatgagttaggaaaaacacaggtctgatcacagcacagcttggcttaaaacatcccatgctttcttattgctgtgacactgaaggccatgattgccagcttgacccatggggcctcggtgatctgccccacccgctccttccctggccccctcagcagctgcccaggctctgatgtgtgtccacctcagcgcctttgcacaagctgttccgtcagctcagtgccccttcccaagaaatgtcctccctcgtgagctgattaatgacacatctctcgtcccaggccctgccaactttgcacttttccttcatgcccttcggaagttcgtaattctttatcagtggctattgtctgtcccttcactgcggcagggattgtgtctgctcccagcagctggtgttcccattgccgcctgcagtgcctaagtgtttgggtggcggcgcatgcccagtgctggtcatgcgctggggcggcctttcatggggtgccctgatggccttgcggagggaggacgtggctctgctgggctgcttggagcggggagggaggaggccaggagcgttaatgaggcagatggcgctgcctgatgggcatgtgcggcgatgtctccaggtgtcagcgaggttggagagggagcagcaaggccggagcttgagggctttttcatgccaggctgtgcagcttggactctatcctgcagggagggtggggcggggatggcggtgatatgatcagatataattggcaagagagaggccctgcttggaaggggagattgccagtgcaagatgaactctgagcagctgaggacactgtttactctttggagcccaggtgcgtccaagttgaagaaggagctcatggccccaggctcagtgttgtgcccatcctcagccccaggtgcccctgcatgtggtcctgagcatcccctccctccgctgccatgaaggctggcctctgagcagcttgagccttgcccagcctacacaggacaaagttgcactcacctcctggctcctctcagtgtgtaatcatctaaagtggatctgggaaggaagctcctgccccgaaggatgccggaagagaatgcacacttggccacactggttcttctcatgttgtccctggaaggaaaccatgtgtagccttcagtagtgcctccccgaccccaccatcctcctgaggggacaggaagtgagtagggctgggagctggtgggagggggtgatgtttggggccctccctgctagtccgccaagcgaggccaggcttcgccacagggatagacagctcccctcacccagcacaggcttagctgggcttgcaccacgtggtcacggagggttaactacagctttgcagcctgaaatgacagccgtcatggcagagggatgagaaggcagtgaggcttatgctggctctcagtgtctgccctgtggtgacacggactcatccatctcactggacctccctacaggcaagggaacccaatactgcatagttcctttttcttcttaaaaacaattaaaataccttgtagggttattgttagcattaaactaattaaaatttgcgattcccctagtgcctggcatggtgtgaatggtgcacgtgtgtgtaagggtcagtcagccacgcttactgtgaatgcctggcatggtgtgagtggtgcacgtgtgtgtaagggtcagtcagccacgcttactgtgaatgcctggcatggtgtgagtggtgcacgtgtgtgtaagggtcagtcagccacgcttactgtgagtgcctggggtgtgatgatgcgtacgagccactcagtacaggcccggcgcctagtgaaccatcagtcaccgtggcttatgtcaatattattattacagtgacagtaggactactctgtcagccttatctgtggccccagctgacttgagagctctcagtcctaattggagtcagtgaggcagtgattatgaaagtgtccccaaacgggagatgcattctgtgctagggcagtggaaatgcctaaaaggcagggccaggtgggggtcagagggactcaagtgctgttcctagccccacccttcacctgctggcccacctgggcctcggtccccttgcctaccgcatagggaaggtgcaggatggcacagaacaccttcagagctgttgcgtctgcctccaaaggactacccaaggccgcggttcacgtttgccacaaatgtgatttcacagctgcattgaatcaaaccctgttggcccctgatgtttattgagcagtcgccagcacagggatggagaggaagtagaagaaacaaaggtttttgttgttctaggtgttcgagtccgacttggaagataacatctaaacctatcagaggataaataacaccgtagaatctaagtgggcttgtgtcggctttgcctttgtgcctgctgaccagtggggtcagagtaagaaccatgggccccgggaaggggtttgtgttgtcaccagggagccatgggagggctccctattttctaagaatgtaccacgtgacccattctgccacgggcgttctcatctcttatgtctttggtccccatctcagtccctgagataatggaattatttccccatttttcaggaggagacaactgcggcccggggaagttaagtcacttgcccagggtcaggtagaaagtggcaaggtcaggatcatagctcggaggggctttggtgacagctgatggcactgtgggtggtgtgagggttggtgatttcagggccaccttggcaggaggtcatcgtctgggattgcctctgacacagctggtgccgtgtgacgatgagactgctggccagcagatgctacgggaggcagagttggacgcatctggcagccctggtcccagagaaacagatcatgtcctgttctggggttgctgtgaggtcagcctctcgatgactgctgccctgggtcataggcgactcctcctgtggtggagacagccacacaatctgtccattgtgcaccaatgccaggccaggaatcgccctttctgcttcggggagggtgggaccattctgtgccgttagcccgttgcagttgcttccccttgtggaaagcaagcctggtccccaggaagacatgtggccctcttaccaaccaggaacagagctagactttgtgcagcccagttgggacaggggcaggagagggcaccccaaagcctgcgctctgagccagcatgtgggctgcagcccctctgcttgtgtgtggacggtcagggtttttcagctcaaggtctgggggcatgttgagttttagaaatatcaatgtttatcaataatacattttccccaaagttttagaaataacttttatgcacattatttctgggtttcttaacctcaacatgattgacatcttgggctggataattctgcactgctaggggctatcccaggcaatacagggtgcttagttgccttcccggctgctcattaccagatgccaacagcactccccaccctgcccctcatgacaaccaaaaatgtctccagatgttccctggtggagggagcccatgccacccctggtcgagcgtcactgcattttgtaagagatgggtccagcagctctgagagctcaggtgggccagtcaagttgtttctgatttttgtgtggacactgaggccccactgggtgcagtttctgggttttagtgtttggaatcacacaccaagaggactaacatcttgtcacttcttttcttcagtaatattagtacctgcggcagaaaggacaccctgttttctgtttcctcctggtttgtgtgagtggcatgacttcccaacgtgtttctgtgctgcctgtgcaggctgtgtgcccgtgataaagcccactgtgtctgcctttgtcttcatgtaataaatcccattgccacctcaccagccaagagcacagccggccgggtaaaccacgcgctgggcctctgctgacctcggccctctgggatggacagagtgaggcatgaggatatcctctgagcccctccctataggtccctgccccaggcctcccacgcctcctggcagccagccctggatctggccctggcccctacccgtttgtctctccactgatctgtgagatcattcatcagtaactattatgttcattcagcaagtcttagtgagaacttactgtctgccagagttctcctaaaagacattacagatgcaacaatgaataagacctggtggacgcagcccctgccctgctggagctgtatctgagtgtgagtgcatcggatgatgggaacaaaacataggtaaatagaggacaaggtaacacagccccagtgatggcgagtactaggaagaaacacaccgaggcctgggagaacagggaggtccttgttactgatcctctgaagagctgacattgagttgaggcctaaagggcaggacactcaggaggggagcaggcaagggagcagcacctgaccaggcccttcagtgaaacaggatggaggcataaggacccgcagtagctgggtgcagctggagcacggtggatagggctgtctgcagtgggctggcaggagccaggctgagcctgggcctggtggcctcctgggagcgctgggtagctctttgaggacacaaaatatcgtgccagctcccctctttgatggccccaagttgagccacagacaacgtgccattttctagtccccaagctctctgaggaggaaggggccctgcccattgcagcagtcagaggtcagggaggagctcctggggcggcaggacgactcccacttctgagcatgcccgcagccactgaagaggatggctgacatgtggaacagaggccagtgtcatccacggggtagatgtcgtagccaggtcacccctggcagcaggatctgtctctcttattgtgcacctagagcctgtaccagaaactagaagactcgggtggctggatgcagaggtgaggagcccaggggtcctctggcctcagtgacccagttggcctaggtcagcagcaccaccgcaaactgtgccctgattctggatgactgttctctccctgcagacactagtttgtaagccctgctggctgtgagtcacatttgcaaacccagcaatgcatcacacggacaaggcaggggagcccatgggctgccaggaggcattggcttattctgggaactgaaagtcagactcggccgggcgactgtgggccagggtggggtgggtggggctccagcaggcatgtcacctttggccttgatgtagggaagctgctcttctgtgtattattgtatacaggggaggggcagctgcataggcccacctgagcaggtgcgtgggaatgcatgtaggggttcagacaggtgcttagggggcgtggggctgctgctgaggtgggtggaacccagctccgtgtgaccttgggcaggcagcccctttcttgccctcctgttgttcagctggtagctgtgacagtgggccagatgaccgaccccttccagctccatctgcgtggaaatcccagctgtcccttcatcctgcgggatccttccctggtcgcctagaggacctgactagtgtgatggtgctgtgacacagcatgtggcatttgtcaggggaatagctctggctgggcaccttgcctgcctcccgctgacagaaggtggagaaagctcataaaagtttggtgtgaaatctggggacagaggggaggtattgttttcagtggcaggcctggaaaaagggggagtttgctgtctccaaataatagtgttctctttccttccagccctctcctctgtagcagtcagggttattttttggcctgaacaccattgttttgcatgggtcttcctgctggctcttgaacaacagtttcccccccagagagcctgtggtttctcccagccgtggctcacaccacatgccaggcggctaagtgaggagcatgacactgtaatgcctcagtagcccccatgggaggatgacccgaagtgaccattgtgggtagcacccaccttcaggatgggtgtgcctgtgacctgcaggccacaggagacacagtggggtctgcatgcagaatcacattcagggtgccccatttgcgtgctcgggcccctgccctgctccgccccacacagccccttttaatgccttcccccaatctgaaatggagaatcatgtacagttcattcaccctggaggctggagcctggttgctttgaatcccttattctatattcattctgttcaccagggaggggatgggttgttgttggcgtctgctccagggaagcttccccagcccttcccagggctccagcgtttcccctaccccttgttgggcctgggacaccgagtttgaccagcttgcacatggactgtgagtctgatggatcctaagtgtggcttgccctgcgcaccactgctcggctctcagcagtcctgaacgagctggcacatgcatttggaacaagtttgtgaacagagtccctctgctgctcagccagccgcttcccatcttggggggcagccatcagttccagtggcctggagcctttccagggggttctgtgggactgaacagagacagtcttcctcgctgcacagcccctgtacaatggggctgtacggtatgccctggaagtgatctcatcttagtcttttgcaggcagcctcattctaactgctgcatgttaaacggcctccctgtcctttttaccaagccagctctctactggtgtatacctagggcatttctgatcatgttttagaaacatgctgtagtgaatagcctagtacatgtatttttgggtgcacaggtgaggaattctgtaggataaacacctaggaatcgggatgctgagtttgcgcattctgcattttggctgttgtccggtttctctctgcagaagcagtaccagttacactgccaccaaccaaggactggtccctttccaccaccttaggaagcgtctctaatcagtttaccttggcatggagtcacagagtgttggagggtgccaggatcctggcagtctcctcctcttgcctgttggttttgctgctgggagctccaggccctgggaagggtggtgtcatgctgcctcacttggcttgcccggaccctgaatctgggccatcttgcccctgtctggtgctgtgttctcaaacttcacttttctcttccgcactccatgtctgaccaccccagcctgagctcatgggtttaaatattggctcacaggagctgatagacctagaggcagattgcatcagagttttctttttgccagctctaccaaatcacagagatcactgtataaaagatgaaggcagcccatcagttcttcctgaacagtgaggtccagcacacatacccctaaggccagcaccacatctgacacaccaccaagaccgcatccatccccagctccatcctgtggccttgcaggctgctggactggtcactccataacccatagctgtccttgtcacttcccagctcaggaccctgttgctttagggtcaagtccaaactcctcagctggtccgtctcctgctctctaccttgtcctcacttttcatgttgagactgccgtccgccccagccctgccaggcccccagcaggcccgtgaatgtgctggactccctcaccccagacctctgcttttgctgtcccctctgcttggagtaccctttctcccctggcccatgcctgtggccctttgtggttgacatcaccaacctcagcaggctcctccccagcccccaaccctgtgccccccgcacccacactcctctgctcctttattgctggtcagccccacgcctctcctttgctcagccacatggccgccacttaggagcctctgggagggtggggagaatgtggctgctctatagctgaataggtgacatccatcaccacacacgcacgcacacacacacactcatatgctctcacactcattctcacacacacacacatatgctctcacactcatacacacacacgcactcactcacaagctcccacatacacgtgcttctcagaggctgtcactctttctgctctcgtactgtctgggaggcctcaggctgagtgctcagacgtgggagatttctctggaatacaaatgagggttgcttaagacccaagtgtctgctgatgggggagctcaactctcccaaggagccgttttagaaaagttaggaaagaaggagtgaggaaatggcctcaacacactaggactgaatccaggcaaaacagagaccgcagggaaccgcagcctcagaggacagctttgcttgggctggtggtcggtgcctgtcgccaatgcacagctgtccactgcccaccagggtgtgcctcctgctggcctccctccctcacctgtggtgggcatggatctcgctggcttgcaggcgactgggatgcgtgcagtgaccatgccgtgggtgtgctctgaggacagcaggccctggctcctgcgtttgaatgtctctgggcctgggaggcatctggctccgttcaggggcctaacagctctgtttttggtttgttcgtcacatcacagaatcaaataatctagaacttaagaggcagaaaggatgttataaatgaattattctagcccacacatcttacagatgggaaactgagatacagataacttaagtgactttcagaaacacacataaagtgaatggcagttctaggacttgtaacccaagtttcttgactctgcatttgtttcaacttgcacagtgccccaggacccacgcgctcgggttaagttagccaggtgtagctgggctgcaaaagattatctgacagtgatgggcaggcagaagccttggctgactgtcaggactgttacataggttgcacgctgcccagcccagtggtaggctttgtgaatggcaccctgggtagctaggcttggtggtcctgtcccagcgtacagtggatgctgctgcaacctccttttggctcttgagagcccacctccaaggtttacctgcatgcatctccaactccaaccctatgccagcctggccacctggcacattctgttgcacctaggcctagtgtggatttcccaggactatctgtggcatgtggttttctgtaagctgtaatcaacaggcaggtgttctgggaggtgccaggaagacttcttctgggggatgttcggctggccttggttgatgacaagttaatcaacaggggttggtttcacggttgcagtggtctgccaagagggttcattacttgtccttcccagaaagcattgcttggcctggccccaccccctccccatgtgacctgacctcccagggagaggctttgctttctgcagaaccacactttctgccttcgaaagtacaactgctcttgacactgttatgtctgttagtcctccccctgcaggggccactccattcagcagctgccttgggagccctcctgtgcataagtgcagtgctggccctgacacgctcttccccctgcgccacgcggaccctcctcacagaggccctgtggactgtggccttcagttatgtcatgtatttactgtcctaaggggtgtgtgtcttcatttgctttcatctgtcttgctccagggctgggaagagatgcagagcctctggtccagctgtggctttgagagaacaaacaaccagtgaggaccatgggttgggaggaacagtggaaagggagctgcagtctcagctctgccactctcccttgcgaccttggcctcgctaccactgcctttcccctttccaaaaagatgggggctggatgaagggtccatctgggttttgctagttctgaccatctttgcctttccctctgggaaaggaaatcgcaaactggatctactattttttttcttggatgctctacctcatgcagaccccaaatggaacacacccggcctccctggactgtcaggctggtggcctcgccttggggtagtgaacatgagaaaggcttccctttttcctgaaatgccccagagcaaccctggccctagttagagttgagatgcttttcatttcgccaggccttccatgccttgggtctttgactggagggctctggagccagaggccctgggttcagactccatcttggccactgctcgcagggagagccctggccacctactaggtgctttgagccctactttgttttcttttttcttcttattttattttgagacagggtctcactgtaatgccccggctgagtgcaatgtcgtgattactgctcactggagccccgaccttcctggctcaagtgattctcccacctcagcctcctgagtaggtgcgcaccaccatgcctggctaatttttaattttttgtagagacagggtcttgctatgttgcccaggctggtcttgaactctcagactcaagcagtccacttgccttggcctcacagaatgctggaattacagacgtgagccaccacacctggccaggcctagtttctttgattgtcaaatgaggctgctaacgggatctacatagggttgttttgagggggaaacatgtccattcctgcaaggtgtataggtctgtgacccgtgcgtggtgagcatgtttataactcaccctggaatcttggcaggacccccgtcaagatgccaaggcttcaggaaccagagacttccagggtttcacccggcgctgggtacggaggagctggtggaaaggccaggccttgtggccctcagctgggcctggctgtgctctcaggaggagccaggggagtgaaattgtgctgagtgagcccagggtcgcttcctttcccatgaaagcccctgtgagtacttttaacagccataaggaagtaatttcagttcttctgtcaagggtagaatcactggtgttagtggggtagctgagtgttaactgaacacacaggccctgatgcagtggatcctagagtcggctgggaagtttcctctgggtgtggcacgctgggttcgccttggtgctgacacctatctccttctggagccaggtggtgatcaggattctagaatcctgttgggttcagtacaggaggctgttgtcatccccagctgatgctgctgtggccatgggggaggtgacggaattgtgccccctctgatgcttgatctattccacgtggaaagctggagtcccgagaagcaaactccaggcaggcccacgctgactttcaggcctgtgcttgccgttttttgtttgtttgtttgtttgtttgtttttcctgagacagattcttgctctgtcacccaggctggagtgcagtggcacaatctcagctcatgcaacctctgcctcccaggtacaagcgattctcctgcctcagcctcctgagtagctgggattacaggcgcccaccaccatgcccggctaatttttgtgtttttaatagagacggggtttcaccatgttggccaggctggtctctaactggctggttttgaactcctgaccttgtgatactcccgcgtcagcctcccaaagtggtgggattacaggcgtgagccaccgtgcccagcctttttttttttttttttttttttagttggagtctcactttatctctcaggctggagtgaagtggagtggtgcaatctcagctcattgcaacctctgcctcccaagttcaagtgattctcctgcctcagcctcctgagtagctgggattacaggtgtgcaccaccatgcacggcaatttttgtatttttgcggggggttttgctatgttggccagtctggtttcaaactcctgacctcaggtgatccacctgcctcagcctcccaaagtgctgggattacaggcgcaagccaccgcgagccacagtgatatgtcgagttcactaacgtttagctttcaggtgctccctagcctttctggagatgcacaacagttcagtcacagagcctgtttctgtaggtgaccaggtgcactgcagtggcctggcgtttgacactggaatggctgattttgaatcctggcaaagccccccagctggttgtgtttgaccttgagccagtcacattgcctctcagaaacttggtttctttatttataaaatgggaataaaaacagagacgttttgctctgtaaaccatggggctgctctgagaatcaaatgcaatattttgtgtcactgcccttgttgaaccagaaaagtgctacacttgtatactgtggtggatcattatgactatgatttaaaacatccatgcctgaggagccaaatcctggggtcttttgtattttcatttcaatttatacacccaagagaagtgaaaacgtatgttgacacaaaaatttatacacgtatgttcacagcggcattgctcctaacagccaaaaagtggaaacaacccaaattccttccaatgatgaatggataaacaaaatacactacaccatgccgtgaagtactatttcatcttaaagaagaacaaagcactgccgcacgctgcaacatggatgcattttaaaacacgatgtgagcaaaaggagcctgtcatgaaggaccacacatcacatggcttcgcttgaaggaaatgcccagaataggcagatctacccagacagaaagtagatgtgtggttgccagaggctgggacttggggctgagagtgaaagggaatgggatttccttcggatgggatgaaaacgttctaaaattgagctgatcgttgcacaaccctgttaatattccaaaagcccttgctttggggtaaattgcatcgtatgtgaatgatatctcaatcaggctgtttttaataaaaatcctatgaggtaggaacaagtacaatctccatttacaggtgaggcccgggcttacaatgaggaaggcccagttaactgggcctggcggcctccagctccctggcatgcagtcccttcatgccatcagccctcactctacagagaagggagctgaggcccagcaaggaggaggggtttccaggctctgtgtggggtcttttcctcccttccagcctccccacccactggaggagagatttcctaagcagcgtgtggagcaggaccttcccagccctgccatggtacccgctcggcgctcaggccatgcagcccagtgggcagaatttcagcccctgggtcctgagtgaaggaaggagcaagctgttaggacgggcagggccggagcccgggactttgtctctgaccaaaacctctcagagtctcagggtcctgagaaaaatggggagaaaccctgccaccctctctgtgctgtgggggacccgcaaatacgggaaggtgctgcgagacctgccaggacttgccttgtgcgcagccgtccctgctggcttaggggtcagtccgggcccctgggcctctgccaggcaggtcacgcacaggctctcctcagagcacaggcctagggcagatgggggctggaactcacagaggtttccagtttccatgatgtccactttatctgtttctttttctgtcttgtgcttttggggtcacatttaagaaactgttgtttaatccaaggtcacgaagatttatgaccgtgttttcttctaaaagttttatagtttgggcttttacccaatagcgtttttatattgaaagaagcagtgtgcatatagcaagtcccaggtaagtggccactgcctttatttttaaatgattactgatgatgatcatttttatttattattattatccttactataattaatctctcgttgtctttcccatctgggtagctggctcttatttcttcttgaaagatagtattggtgtttgaatccatttctggcacacttaggggtgcagggtagaaggggaagatctgattacctgcctcccatttccccccaaactttgtgttatgggaaattaaaaatatttgagaagagagaatgccgcaacgtgctcccaggtgccacctcccagcctcatgcgtcagcagctgcagccactctcatttcatccgtccctcacctacttctgtccctgcccccaacccggattgttttgaaacacatcccagattcctatttaatctgtgagtcctttttgagttgcatctctgaaaaacgaatcccttggaaggtcgctgcctggagcctgggctgccggtggggttgggaggttgtgttgcaccccaggcatcagcaggagggtgggcatgggccagaaccacagcccccttccatgggcacagctggctcctctggggtcggctgcacagggcaaggcagggtgagcccagaaaccttgcgtcaggtttagccctaggagcccaggtgttgcagggtaatgagaatcctttcatttttgtgtctacaaactccttttgcatccatgatctccatgatgcccacagcagctgcctccggtaggctttattcagaatggaccttacccaggatgagtctcagagggttaactccagacacagaatcaatgtcagaggcagaatctggactcaggactctgacagcattttccattagaaggagcaaatccctgtgtctcactccctgctcatttcctgcctgtgaggatcgaggaggaaagagtatctctgacgttcatctcattctgctcagattctcagtggcagcttagcaaagggccagttgtctctgttggcatcattccatgggcttggggcctctgaaaaccctgagagagcttgcgctgtaggtgggcaccgtgacgctctgccccaggtgtgttccagccctcatcctggcaggggctgaatgtttctgcctagagccaggctgcccttgttagctccaggatcccactcttggtgtcctttagctggcaggccctgcgagggaacatgtgcttacaatttgccatggagacggcgctgcccttcttcctctgagtggtgataaaatggtacggaagctcacccacccagcagattggtaattctaagagacttgtgaaaaatacacgaggccctcagtataataggtaagctggaaagcttggcacaaagtccgcttgtggatagtgaggtgactggaaaaattctttgccctctctgttcccatcccagaagagatcgtgtttaggaagaattcttctgttaatgctgatgctttcatccccagtcaaaagctagttgacgcctgcttgtcagatgttttcccctttggtttcatgtagccgctttccctcatgagtttggcttaacttcatgtcttaatgaatctgagttctctctttaaaggtcactgtcctaacgcataaacatggaatcagaatcgccctcatttattcagagctgagcggagacttttcttgggacttcgaggggaggaaggagcacatctgtgttctaagtggcctcggttgctgagggagaattgggtcatcccatccacgtgctcggctgttggcccccttttggaaggaaggcagcgaatgcgtgggtggccctcccgttacctggaatgcctctagctggtggtccatcccgttctagaatggctcccctgtgcagccttcaagtttacctttacaaatacactctccattttctcagtctgtttacacccttggaaccagaggccatctttacagagaccctaagggcatctggagtattcttcatgtcacagatgaggagactgagactctgagaagccaagtgacttgcccaaaggtgactctgagaggtgacgacatcgggcgcctgggtttcttgactctaggtcacatagccttcccactacaccaggctgcttcctggtgtgtttaggggaagggagtgaggacagccaagtgcctttagctcataaccgaggacatgaacttgctagccaggactatagatctggcggggtgaagcggagaaggcttttgatcatctgagtatctgctgcaccccacataatgccctgagcactgtcagtgatgtgaagtctcttgagtggatgacctttttttttttttaaatttaagttctagggtacatgtgcacaacgtgcaggtttgttacctatgtatacatgtgccatgttggtgtgctgcatccgttaactcgtcatttacattaggtatatctcccagtgctatccctccccctccccccaccccgcgacaggccccggtgtgtgatattccccaccctgtgtccaagtgttctcattgttcaattcccacctatgagtgagaacatgcagtgtttggttttctgtcctcgcaatagtttgctcagagtgatggtttctagctgagtggatgaccttttaatgttgacatttatttttctttattttttttggagacagggtcttactctattgccaaggctggagtgcagtggcaccattgtgcattgctgcagcctcaatctcctgggcctgagtgatcctcccacctcagcctcccaaggagctgggactaggggcttgtgccactgcacccagctattaatgttgggctgtgaatatgatttcatacatatgtgtgagtctcggcggggagggcctcatgcatgacctgctctcttggaagcatggactgcatttaaaagaacaagctctgatgacggaatggtgccaagaggggtagttgcccatggagagctcccaaatgagacgagggatcaggtgtaggtgcttgggtgaggctgagactgtcaggagagaggcactgggtgtggctgcttggccccagggcagctctagataaaaccttccttaaggagactcctcggttagtccccaggctccatgtgggcggcagacttgggctctcccgcatcagtgcctggttcactgtctacaggcagtgggttggtggccaaatggcttgctgacggctggagggttctgccccgcatctaggtcctcgcacttatgtgcagggagaggatggctaaggggtgaggagagtcacaggcgtgaggactggaatgcgaggcctcccctaggttacgccggccaccactgaggccagaggaagtctttaaacattcagacagaaaggagcccagggccagatactctgccgcgaaatccaaggagaggctgatttcagagcagaagtgggaatatgagtctctggtttttgtgttaaaagtggcttttggcttaacaagtggtcactaggaccaaaataagttcacttaagaaaaataattccaaatggctctttctctctgtccataaggctcactaggaaggcagcactggggtgtgtttccccagcctgtgcaggcctcactgacgggctgtggagtgggtgagcagagggcaggggggctggctgggcggaggaatcacgctggcatgtctgctgcccccggctctcacaaccaagtatcacaaacagggaggcttttaacgctgcaggaatctcccagcccagggggccaacagctccagtcagggcgtcagcagtggctccctccggaggccctgagggcgaagcttccctgcccctctcccggctcccagtggtggtggtggtgggcaccttccaccctccttggcttgtaggtgtgtcactgcagttgtctgtctccacacggcctcctccctgcgtctgtgttcagatttctctcctaagaaatccagccaggggattcaggcccacccatatggtgtggtccacccatatggagtcctaactctgttccatccacaaagaccctgtttccttataaataaggccacgttcacaaatgctgaagggttaagacttgagaggacacaattcaacccgcagcagctggttgaggccttcttcaggccagctttttccctgagacccccacatcacaccagcattccagttttgtccttagaatcatggaggttgggagcaagggtgggctccttcgctatgtcagctcgggttggtctggcccacctgggtggcgtggggttctgcccattattttattgagttctgttctggacagcagtgtcttccccccatgtaagttagggttattcccctaagaagatagtaagttccttagagactggtttttgtcacggtttctcttgcatttccttcgtgcctaccccaaagctagtaggtacagaagtggagtacttgaggagtgttgggtggctggtgcccaccctgtggcgtgtttctctccaccacaccttcccgcagaccctctgatgactcctggcctcatcccactctcccgcccctgcctcagagtccttatcagtgcggggcatggggccgccactcccagaggagccagtgcctggagtggatctgcttccgggtgaggttttatctggagtcaggcggcctgccctgagcctggttgcagtttcctctctgtcttctgtgtggtgctctatttctgagtttggcctagtcaagcctctctctcagatctccaggtgactgctcgaaatgtcccagtgctggaatgcaccaccctccaccaaagctagggctggaggataggacaggaacggatggacgtgcagagggcgcgaggggtgagttgctacctggccctacccctgctctaaccagagcagcatgcttccctttcaggagtacatcgatgcccaccctgagaccatcgtcctggacccgctccctgccatcagaaccctgcttgaccgctccaagtcctatgagctcatccggaagattgaggcctacatggaaggtagggacacgtgtggcaccacatccgtggcaggcagccacctttgtggtcacaaagtggccacggcctgaggtgtggagacagaggggtcttgtctttttaagcactttggggcaggaagcatttgaattccatggtgcagtcattctggggaggtcctttcattctcctgtgaccagcagtgaggaaacaaaagcctcagggtgctcttgcggaagggggctctgagggttttgttttgctgtgttgaacccatgggtgacattgaagtgtcccggtaacacagtggctggagagcaggagtgtgtgtagacagctcagtggcaggcaagcaagtggagttacgtaactgcgcggaggacacaaacagaaactgaaggcctttaatcaaacacgtggagatgtaatgtggctgctggacctcatgggtccactctgttctggagggcaggggcctccctcttcactgcggcgcctcccctgccagctgcaggctcctgtccctgagggctcaccctgacgcctccccaccccttgggcaggcagagccagagaactcaaggccacattctcaaggtgtttatgtgagaaagactttgtggagagattcatgttaacagtaacctcctagttcactgcttagtccaagtgtgccctgctgagagctcttgtttaattttaaggaaaagtgcttggcctgggccctccggctttgtgaggatttatcctggggtcaaggaggcagcccctgctccctgccctacagaccatgattgaggcctaacctggctgccttgaaccctgacctggatggtgacttggccttgggcataatttcctgtgatggtgaccggtgggaccagtgggtaccatttggctcacagctccagaggcagaccatctgcatgggagtctgagaccaccatttattggctatgtgttgtgttcctgcctttgggttaggccttctccttgtattctcccttttggtactcttagaagtgggcatgataagccttcccattttacagatgaatcccagaggctctgagaggttagcagacatgccacgtcacgcagcattcaggtggctgggccagcatccagccaggtctgtctgactcaggctccccggcccctattcctgagcttgactttcatgtccatggccagagggccctggatctagaagaacctgaaatgggtaccactgaggaccctggcctggagagtaggtgagtcctcggttccctctctgaggaatgtgccctgcagaagagctggctgctggatttggctgtcctggaagggctcccgaggcctctttccctgaatgcctgacacaccgctgggtgcagagaatgggggtgtcatgctggtgccccatgtaggcaggctttcttagcacatgccagcagcctttatttgctaggcctggagtgattggcctctgctgtgcacttcatctccctttgcactgtcttcctggatccatccagaatcccagatgggaagaaagagctgtatgttccctcctggggtcaccttcatctcagtctgccatgggtgaaggtttggtaaaatttgggaaagggaatcagcctctttccagaaggtgtgcttgttggacactgcctgtgtgaagagcaggaggctgtattagaacatgagaaggcccagctagcagaagaaggtggcagaccagcagccacatctcatgtcccggacaagtccattcgaagagtgatgggtttgggtgggattcgaggaggtgccgctgaagggccttttggagccaaaagcacaggctctggcatgtgggttcctgtctgggctcttgttagccacgtggtctcggacaaatcagtcatttgagttctgctggtgttctggaagatatgggtgatacctggttcagccacggggtcaggggtcaggatacctgggatgatgtctgcagagcacttagcatgggaccggcccactgggtcacccgggaacagcagctgctccagctgttcccaccacgatggcaggaccccagcatcctaattgagtcttcacatccatcttagatttttaggagtagaagcccagggctggggatcaagggtgagcctgggctcagggtgggtgtgtgcacggtgtgttcaaggagcaggaacccggtgatgaggtggaccgtaggaagtcacatggtgagaggaaggcccaggaggtacctctgttgcccgctcgcctggcttggaattgggcctctcctggaggcagttaggaatcaggtcaggaattttaagcagggtgtgtcctagttcactgggagattagaaagtttaggagctacccataaggggagagctgtgggtgttccaggagagggccccgtcctcaacaggtccagggagagctgttgaccaaaccctaacgcatgcttggttctagatcagcaggaagtgtagggtgggtgggccataaatgttgcacgctgggttttccttatcgtgcacgccgagcctgggcttgtattcttccaggagggcggtcagaggctgggacttcctggagccctttcctgacccccagtggctgtccattcaccagcatcgctgggtgggtccctgctgcatgcccccaccagctgcagaggcagagagccttcctgggaagcacaccctgggcccccctcctcaactgcctgctgttcctggaggcactcagccctttcaggcgtactgtaaatggccataattacccttgaagttccctcagataatcacagcaatccagtgacacgcttttgtgctgggagaaggagcttggtgagacttcctccggttgtcaccccccctgccccggttgtcaccccccctgccccggcagtaagactgctctgttttcagagactctggacagctgcagggaaaacagagctggtgggggacgggtgggtgcttcgggactgctaggatcctcattgatgagcagtgggagggagacgaccagagcccctgctttgcggtgggggtgggcagttgggacatggcacaaggggaggctctcccaggaatagcaggcagagcccttggataagggtctgtgctcaggtgggccgtctgtctccctgcagagcatcagccgtggagggcctctcccaccccagctctgcatccaggagacagatgaggcctgctgctgggagctcccagcatcgctgtctccgggcagcctgtgtgaggtcactgccttctcagttccacattcccagagctcattcttgtctcattcagagcctggaggggaagcagggtcatttctctgcctcggctctggcagcttcaaacccacccacttcgtatcaattagcattcaagttgctttaacagcagacctaaaatcatggtggcttaaatgcgacagaacttcctttctctctgatgtaaaagcccagaggaaggccatccagcacgggcacaggggctgggaccctggctccttctagctccttattcttctgtggtctgcccatctggtcctgggtgatggctgtatttccagccctcacatccaagatctagacattaggatggagaggaagatcaagaaaaaggaagcaaatgagaagaaggcctagttctcttttaaggaggggttctgaaagcaatccagtgacatgtttttgtgctgggagaagggactttggccagaattagtcacatcctaagctgcaagggagtcaggaaattgagtccttgttctgagcagccacatgcccagctacaattcgggttttatcaccatggaagaagggctagaacgagttttaggggagcattagcagtcttccaagacatgggtccctgcctgaggacccaactttcccatggcagaacaaccttggaatttctcctctggctgggggtttggcctcggcctgtgacctcagcagcagtcccctctttgtagcaaccagcatcctggaggcttgcagaatgacccaccccagcatgccagggccctacctttccctcatagatgactgcttctgggaggcagccatgcctatacccatacccatgtccctccccacacccgcaccccctaggcagaggcacaggcagcgttgagcctggattcaattcaaaccaagcacttaattcttcctagaaattaagcattccctggtgcaggcctcggggagggagggaggaggccgcagtaacaaacattgaatttgcaggctctttctcccatcagcagcccactctgccacccagggccagggtccagagatggaagccccaaagccaaggcatggctgtgctaccctagggtgagcgattctgggcacggctctagctggctcccaaactggctgagaaggcaccatgtatgagaaggcacctgggccgtaattgcatggcgtgggtttgtgtccctgtcttcagggacagcaggtctcagaccattgggcaacaggctggagagatccttgaaagccctgactgctttggggtgatgggtggctctcctgttcttcttctcttagaagttcccatgtgtctgctctgggggtgacagatggcctgtttgggatcccaggcctccctggggatggggggtgcataccgcagattgaatgcttctgcctgtggttttacgggaatttaattagggctcatcttagaggccatttgaaacctgggttgaaattgagtagtctggatacaaagcaaagagaaagtaacattccttagagcctggagaaataattccccaaaaagcttttgccttgggggtgggtgtttgtgattggtggggagctgctcccagaggcaggaactggctctcaaccctcggggagctgcagaggggtggggacttggagtcaaggcctcagaccctgcccattgccaccgccacccctccaaccctccgccaattgtgtggcctctctgagctgtgcgtctgtcagcgcttaggcaggtgcttagtgtgccaggcactgggttaaatactttacagacagtacctaatttaatccacttaatgaccctatgaggaaggttctgatttcatctccgatttagaggtgaggatactgaggggctttgatcttaagttacttgaggtcacagagctagtggggcagatttgggatcagaatccacacagtgtgggtctgctcttagccagtggttcccaagccctgtccctcacccctgtgtgtaccccttccacacccccagttcccctgtggctgatggagagggaccgaggcaaagataggtagggatggggctctgcgcctgcaggtgagtcctgcctaggctcacctggtgctggtggcatggccatcatccctgggggtgccctctggggtccaggaaatgatacttgagggcagccacacatcatggcaggaaagaaggaccttgtcgctgataaggcttccaatcttagcccctcggggggctgggccagtcactctcccctgagttgttcactcatctgggaagtgggtcgccagtgcctcggacgtgctgagtgggcgtctcagctggtggccccaccccagatcgggcagagcgaccccttggtgtgcacctgcccatgcctcccccagtgtcagcctgcccagaccacagggctgaggtgaggggacagcgtgccccatcgaagggtctggaatgagggaggacagggtgccagggaggtagggtctctcaggggaggtgcttggtttgtggttccctttcttggacttcagggatgtgtgggagcaccactgtttttgttttcacatcggctgttgtctgccacccaggctgagacccgccctttcagtgcaggggaggctccgcagagcaggattgtgcttgtggctcccctgccctggggcggctaagcgccagctgcagaccaggccgggtaggtgcgttgccggcatgaggcggcagctgggaccaaggctagccctggtctgagtctgcgtgagctgccgtcctggcgtctgccgtgtggaagccagtgccctcccccagtccgggagtcatggggtgaggaagaaatggtgccccagagcatgtggaaccaggtctggcctgcaagggtggctcctcctgtccttgaagctgctccttccctcagctgtagcgttccccctttacagatggggggtgtggaaccttagagaggttatggtaacttagttgaggtttcagagctggtgcatcttcaagctgagctccatgttgatgccaaagctcaccctgttcccttacaacaaacatctattttacagctgattctcagaatccctcccatctccctgcccttggctgacccttctgtgggttctgctcctgtcctctggagccaggggccacctgtgcagccatccagacattcacattctaagacaagaccctgtcagcccccaggacctgggaatctcggaagcatcagtcctgctggccgggctctcagttgaggcagcagaggccagggatgttcagggcaggacagggcctcagggagcacgcccccacattcacactgccccgtcccctttcctgcacccccacagccaaagccagctccacatcaggcccacaggcctactcgcagccctttctgtgccatctcctcttccctggcctagctgcagcaggggtccctggagagtagtgagagcttccccactctccctccagcagcctcacccctttgtcccaccaggactggggtatgtgcctggaggacagtggcccgggagcctggatcagcttttcctggagaggttgtcaggtccaggcctcctaagggcactggcagagatgaaacagatgctggattctctgccaagctcctcatttccacagctgtgggcactgtggacagggcagcagcccctggcatcctgatggtaggcttgcagtgacccccatgagaacagaccctgccaggcatttgctgccctctgtccctcctgcccagggcactggtctggaggctcccaggagagactcaaaggagtggactgagctctcatggcgactggctggcaccctgcaggagagatgcaccttcatctagggaagaatgttcctgtctgttcactcagagcttaaccttgctgagcctttaagaccatggcagggacccgctccccagcaaaacaagaaggcccctccacccacagcccaccaacccctccagcgccctccagctcagtggcttctggacgagataccccacttggtccaggtgggcctgccccaggccttcctgcagagctttctgaaaacctctgtcccctctcaacccacaggcacccctcctctaggaggtactctcccaatgacatcagctggctccgatcacttttctagggcactgctgctgatcctaggccagttggtgaacagactgtttgtctttgggactctggctctcacccaaaattcctttcccctggctgtgttgactaactccctccagactccactcccaggctttcttccccctactcacactgagtctcctggctcccctgggatataagcagggtacatgggtactcaaaacctccttgttggtcagattggtcagaaggtatccaacagcagccatttacactttagtgtgaatttatagctcacttagtgtttttccagctgaaagagatcttgagttctggaagccctacaaaaactgctcttctccacatcctcaacaatgagaatagaggcccagagtggttgcatggctgacccaggaccactcagcacctttccgactctcagtccagtgctgtctccatgggacccacatctctgcaggggtcttttcagaagcagcgccatagtgaatctaaagtcagactgcctgggttcagatcctctcctaaacacccagctgtgtgcatttaggcaggttatttaactgcattgagccccagctttcctatctgtaaaatggggagggaggtaatgttggtggcaccttcctcataggttgttgtaaggattcctcaatagatgggagctctcctggcagacagtgcattgtgagtttcagaccacaccctgtgtgctgtgaccctgtgagtcctgtgtttctcaacttgcatttagtgctaaaggcagcagcccctggcgccctgatggtaggcttgcagtgacccccatgagaccagaccctgccaggcatttgctcccctctgtccattctgcccaaacgcccagccccgtgtttgcaaatgtgtacctgggtttatttccccaaacaagagtgtcttcagggtgaccaatcatgtaacacaagcgggcttttaaaaatctctttattggctactagatgatgtattgtagatttattataataaagttcacattgcacaggtttgtttagtgtaatttttatttttaagaaattttgacagagttgcaaagatagtacacagagttcccatataccctttgcacagcttcctccagtgttaacatcctatctgaccataattatctaaaccaggaagttcacattgataactattcaataattgaaagacctaaatgaattcgaatttccccagttgtcccactaatacccattttttagtccaggatccaatctggttgtcgctctctgtggtctcctgccatctgggatggagcctcaggttttgaccttgacactttggaaccttgactgtttattttgtggagtgtctctcaattcaggtttatctggtgttttcgtgactgggtcaaggtcatacattttcagcaggaacaccacccagcagtgccagtccctccctagtgcgtcatatcaggaggtgcatgaggacaacgatgtcttctgtctgctcagcagcagttatttggttaaagtccaccaggcttttccactctaaatttctattttttcctttgtagttggcaagaaccttctaagaggattctttgcagactgtctctcatatgtttgcccttctcttgtagcatccgtggatgggtgttgccattgttactgtggtatttaccgaacagtcatcatacagaattataagaactgtgtcccaaccaccccagttgccctagaagtgacaggatccccttgcagctttgcagacatccacagggcaccaggtggcaccttgtggagtgtcagcataatctcacgtgtgaacaaagggaaaggcaaaataaggaaaagagaaaagtgtcagatatgttggagaatcaggattacatgtttctttgctgcaggacttctcagagccttagtaatgtgttaatatgaatctttagtctgggggcagtgttgaatttcattaccgattgtaagatgcactgatacttcatattctataaaaaagaaaaaaatcctaagtaagttgtgaaatatcaattatgagacacatctcaatttcagagatggaaaatatgaaaaacatgccatagaatcagtgaagttctgcagaatttagccttttccatccagttaactatagagtcccctcctctctttgaggcttctcttgagagactgttgcactcaacacactcaggaattccctgactgggtgccttctggccgccctcacttccggccctgcacaggtctgttcttgagttccctgtattagtgtgtggggccctcattgctggtgcttctcgaatctgtttaactccagcctcacttccctgaggcagccactgttcatagtttggaacttatctttctagacccttcctattcatacatgtagagatacatgtgcacttttagtattattttttcattacagtaggctctagtgcaatgtgtacatttagaaacagggtcattttacacgtgtcctgatacagctctttgtccccactgaacatgtgtcttgcttcgcttctttccatgttagcccatgaagatgagggggatcaggtctgccccttttgctggcagcataatatttccatacatgaatgaatgaatcctaatttatgttgggcccataaggtcattccagtcttgtttggattttttttttttaaacaaactgggctgcagtaaacagctccctgcatatttctgcataattaatccctagaagtgggatttctcagccaaagattataaacattcctcactttggcagatctcactggattgcccttcaaaaagtttgagcaaatttcactcctgatggtgccagtctgcctggggaagccgtacccacctcgattgatgtgtgtttgtcgttattggcacaattgagtatcccatcatggattcactggctccatttgcttgtcttctatgaatgaatctttgcctgttgtttgcctattttttagttgagttgttgggcttgttgattaattagatccctttttgtatgaagaaaattgtcccattgttaaaaattgtggacgggttcatgaatgtaagcgtcatctttgctctgggtccaagctaagatgttttgcttttagaataggtactaccagaaagagccctccaaacattttaaaaatgtcttgaaagtaaaaaaggctgccatgttttgggagcgggagctggagctgagcagggacagtgagcgtctgcctgggtccagaaggggctgtaaatcagtgggagcagctgccacagagtctacccacgtttccagctactgccgccagactcagacatcgggcgcagaaatgcctgtctctgtctgagccagtgtctggctcctcttctcctgggctttggacattgtggttgcaaacagctctctggtcacataagatgaaatgagtcactagctaagtcaggtgggaggaaacctgctcttcccctgcccgtggcttgctgtattggactgtaactttgcacctgtggcatttgttgtcttctcttctcgtcctccagtgttttctctccacagcttgcctgtcaccaggtagctaagtgaggatctagctgctagcagggaggttgcacctgtggtaaggccatagggtctcttagatgccttcaaggagcagggtagggggctgtggccactggcgaaatgccccctgctttcccccagtgactccaaatatcacaattgcgtttcccccttgaaagctcatagtagctggatgtgttaatttcctattgctgcatgacagatgacagcagattgagtggcttctgacagtacccatttattatctcatgggtgggtgggtcagaagcccgcatggtgtggttgggctcttggcccagggtgtcacgggctgaaatcaaggtgtccgcaggggcaggtgatcttctggaggccctgaggaaacatccacctccaagctaactctcattgacagaatccagttcctggtggctgtaggactgaggtccccacccttgctggccagcagctcctacaggtcctgtgtttcttctcacggtgcccctctacttgcaaggcggccacagctggccagtctccttgtgctttgaatctccagcttcctcttcagagaagaagctctgtgtgtgatgccctaagagttacccagaccatctccctgttttgagggcagcaatgcaacagaaccgagtcacagaggagaacccatccatcatgcatgcagttctggcgatcatgcagggtgttgcccggccacagggatcttggggttgacttagattctgcctgccacactgagtaatacaatggttttcccttgcatacttataagttcaatggaatttaattgctatcattgcatctctccaggccctgtcacctgtgctgggtgtcttggggcatgtcgcccctgcccattccctctcctgggtggcgtctcctgtcatactgcccctgcactccacactgcagccaagccgaaccccaggggcacccctcttgacccttggcctttgtccatggtgttctgcctatctggaatactcttggtccccaggactaactccaactttggggtttggctcaggccacttcctcccagaagccctctgtgctgcacactcccttccctgcgtgggcctcagtgccttcctccctactcacagaccctttgctgccctcatcgcacattcattccactgtttcgtcattgtctgctggccgctgtcttccccacctgaccgtgacagccttgaggacaggggcgagtgtgtctttggggaccatgacaggtcagggcctggaacatagtacctgctcaataagtatgcaaaggagggaagaatgttttcaagaatcagatacataagaaggagatgcactgggggaggctctgagcagaaatcccactcccatgggagataggcctggggcaggtggggtcatgggctcggggccacaggaaggggtggtcctggttgtctgtggggctctcgcggaggtggtatttggagcggctctgaaatactgggctcaattagaggaaggtgggagccattccagggagagggagcaggatgttcaggagaaatgggggctattggtgctgcgggagagagccccatgccgaggcccagagggcctccagggccagtttctgcttagcctatgcggggagagagggaggccattgggaggctgctgtggcttctggaaaagatgctgagggtgtgatgagggtggtgactctggtcaggaagaaataggatggaggccagaaattgagggggaacattggcaggcatcagggcaggcattattatctgggatgagttaaggagaaggaaacacaggacaagccataaccacaatctgtgtgccagctccacagggcaggacagtgctggggggctccaagggtgggccaggtgtctccacggcggccaagaaaaactacaagagaggccgggtgcggtggctcatgcctgtaatcccagcattttgggaggccaaggtgggtggatcacctgaggtcaagagctcaagaccagcctgaccaatatagtgaaaccttgtttctactaaaaatacaaaaattagctgggcatggtggcacgtgcctgtagtcccagctacttcggaggctgaggcaggagaattgcttgaacttgggaggctgaagcaggagaattgcttgaacctgggaggcggaggttatagtgaaccaagatcgcaccactgcactctagcctgggcaacagagtgagactccatctcaaaacaaacaaataaacaaacaaactatgagagagggaccctttgtaggcccccaatagtaataagtccccagcctgggccaaatcccagggcttcagtgataaagattccatttcaacaggcagagatgagaagggagggcattccagtggcagatacagcacagacaaaggccaggcaggtaagaaaggccaagttatcaccaggaatagagatggtccctcttggtgagagcctttcttgttttggggcatggggtggtacaggccccctccacctggcttggagtggacttgttggccttgtcatgggccagagccctccacctttctcccctcctctcaagccttcagagaagtttctgtcatggagttcactcggctgcctcaggggctctggctcagccaagaacattgtcagggctgggtggtgttctctttgtgttttctctggacttgttctggcaactgacagccccagatccagccttgtattttaaacacgaggatcctgcatcgaagctgtgtgttctgcccaaagatgatccaggcctcagtgctcctctggggctggtgtatagtctgttatcacactgctataaataactacttgaggcctgtcatggtggctcacacctgtaaacccagcactttgagaggctgaggcgggtggatcgtttgacgtcaggagttccagaccagcctggccaacatgggaaaaccccgtctctactaaaaatacaaaaattagccaggcgtggtgatgtgcgcctgtaatcacagctacttaggaggctgaggctgcagtgagctgagatcacacactgcataccagcctgagtgacagagtgagactctgtctccaaaaaaaaaaaagggattaaaaaaaacctacctgagagtgggtaatttatgaagaaattatgaagaggtttaattgactcacggttttgcaggctgtacaaaaaatatggccagggaggcctcaggaaacttacaatcatggcggaaggcaaaggggaagtaggcatgtctttacgtggcagcaggagagagaaacagagcaaaaggggaagtgcgacatgctagatttcatgagaacttactatcacatgaacagctagagggaaatctgcttccatgatccaatcacctcccaccaggtccctcccccaaattgggaattacaatttgacatgagatttgggtggggacacagagccaaaccatatcattccaccctggcccctcccaaacctcatgtccttctcacatttcaaaacacaatcatgccttcccaacagccccccaaagtcttaactcattccagcattaactcaaaagtcccagtccaaagtctcatctgagacaaggcaagtcccttctgcctataagcctgtaaaatcaaaaacaagttagttacttccaagatacaatgagggtacagtcattggttaaacagacccaattccaagagggagaaattagcccaaacaagaactacagggactgcagtccccatgcaagtccaaaacccagcagggcagtcattaaatcttaaagctccaaaataatgtcctttgactccatgtctcacatccaggccacactgatgcaaaggatgggctcacaagacttgggcagctccacccctgtggctctgcagggtacagccctcacagctgctttcgtgggctgacactgagtacctacagcttttccagggacacagtataagctctcggtggatctgtcattctgggatctggaggatggtggctctcttctcacagctcccctaggcagtgctcctgtggggtctctaacatcacatttactctctgcactgccctagcagaggttttccatgagggctccacccttgcagcagacttctgtctggacatccaggtgtttccatacatcctctgaaatctaggcagaggctaaaatcttgccttcagcacacctgcaggcccaacaccatgtggaagccaccaaggcttggggattgcaccctctgaagctgtaccttggccccttttagccactgctggagctggagcagctgggatgcaggatgccatgtcctgaggctgcatggagcagcagggccctgagcccagcccacaaaacaatttttcccttctagacctcctggcctgtgatgggagggactgctgtgaaggtctctgaaatgccctggaggcattttcccctattgtcttggctattagccttcagggcttcttatgcaaatttctgcagctttgagttcctcctcagaaaatgggtttttcttttctaccacgtggtcagcctgcaaatttttcacttttatgctctgcttcccttttaaatataagttctagtttctggtcatttctttgtttttgcagatgagcataggcttttagaagcagccagtccacgtcttgaatgctttgttacttagaaatttcttccaccagataccctaaaccatctctctcaagttcaaagttccacagatctctagagcagggacacaatatgccagtctctttgctaaagcataagaagaatgtcatttactccagtttccagtaagttcctcatctccatctgagacctactcagcctggacttcactgttcatagcactatcagcattttggtcacaaccattccacaagtctctgggaagttccaaactttccctcaccttcctatcttcttctgagccctccaaactgttccaaactctgcccgttatctagttccaaagttgcttccacattttcagatatccttatagcagtgccccacttctctggtaccatttttctgtattagtttgttcttaacattgctataaagaactacctgtgactgggtaatttatgaagaaaagagttttagttgactcccggttccacaggctatacagaaggcatggctggtgaggcctcaggaaacttacaatgatggtggaaggtgaaagggaagcaggcacaccttcacatggtgacaagacagagagaaagaaggatgaagtgctacacccttttaagcaaccagatctcgagagaactcactcatgtcatgagaacagcgagggggaaatccacccccatgatctagtcacctttcaccaggtcctcccccgatgctgggaattacaattcaacatgagatttgggtgcagacagagagccaaaccacgtcggctggcttagaagtttgctgctgatctgagttcgagttctgtcatggtaggtagatggacgagaaggctgcaccttccttaatgcctaagggtcaagagttccatctttgggcaggaggaagcaaacatgtcactcctccagtattctctactcttctttctcccctgcctcccccagggccatgtcagactgcagagcagtgataggctctgtaaggtgatcttggatggttttaaatggcagaccttcaaatagtaataccagtgatgatgatgacgataatgatggacaggatgttgggatctgacacttggtgtcttctgcatgctggtttctgttttaagtgctttgtgtgttaacctgtttgatccttacagcaatcctatgagcaggactgctcttattgccattttacagatcaggaaatgaaggcaccaaaaggtgaagtaaccgtctcaagttcacacagtatggagcattcagccaggcagcttctgggactggctacagtgtttgggaagcacagctggcccagtgcctctgtttcctggtccctgaagtgggaaaggagccttccttaactctttccagactcagtgttcttaagtgggaatgatgagactggagaccagtgacaaaggctattatgcagtggtttgcccagcagtcaagggtattctttcccgccacatgctggctttgatcttgaacgtgcaaccaactcagggcctctgcttctcacatgcaaaatggagtggtgatagtgatccgtgctatggcattgctataaagatgacacaagttgatgcctgcaagtgcttgttgatggcgcagagcacactgcattgcttgtctggttattgttgacattaagccctgcatatgctgtgttaagtgcccaacacatgtcatctctatgagccttcattttggttgtctgttagatggaaatccaaaatgataatggtgtttcttgtgctcatgaatctgcagcttggctgggctcagctgggtggttctcccatgcagtcttgcatggcagtttagcatgatggtgacagagtagccagactactgacttggcagctcagggacccaggggtgtgtcccgagaaagacagcctctctggccttgcttccagagtccatattctatttatctgtgaggctctagggccagttcacattcaagggaacagcatttagggtctacttcataatggaaagaagcatgtaagaaatagagactgagaagtcccacaatctgctatctgctaactggagacttgagacctaggagagctggtggtgtaagttatagtctgtattaggtcattctcacactgctataaggacatacccaagactgtgtcatttataaaggaaagaggtttaattgactcacagtttgcagggccagggaggccttaggaaacttacaatcatggtggaaggggaagcaaacatgcccttcttcacatggcagcagcaaggagaagtgcagaatgaagcaggggagcatggggggagccccttataaagccatcagatcttgtgggaactgactatcatgagacagcatggaagtaaccgcctccatgattcaattacctcccaccggctccctcccatgacatggggatgatgagatttgggtggggacacagccaaaccatatcatagtccaagtccaaaggcctgaggaccaggagagctgatgctataatttatggttctactgcaggagactgatgtcccagcttgaacagggaggccaagtgagtgaattctttcttacccttccttttgttctattcaggcctttgactgattggacaggctccacccacattggggaaagtagtctgcttgactcagtttaccaattcaaatgctaatctcattcaggtacacggagaacaatgttaaccaaatatgtgggaaccctgtggcccagtcaagctgacaagaattaagcgtcccaccatggcaggcctgctgtgttctaggctctagggcaggtcccaggcacacagagatgagcaaggcaggcatagtccctgctcccaccgagcctcctgcctcatctgcctccatcagggaggaaggaactgcgtactggggcaggggcacccaagaagccttaatgtcggaggaactgggtactgggtcaggggcactgcctggggcactgagcctgcaccctgtggcggagcttgattgagaaaccgagcaaggctcattttgcccagagcttgggaggagggaggcataggcaggcccttggccatggaggacttcaaggctggcaaggagtctggacctgattccgaaggccatgggagccgttggggagcatggagcagcggctcagccttaggctgggctttacaggtcacacctcccgagttctcccttgccccctcgcaacagcatgaggcatgccaacactcaggagatgccacttccctaccctctcctcatggtgggtccaagggaggagacacagtcctgccctagcccctgtgccctgaagctgtgaagtcactgcttagtccatgtggcaagggcctggccttctctcacacccccgctcctcctgtgaccacagtcctcatgtgacccttcctttcctcagtgaaccggacggctgggcagcacccagtcctgctggggaagactcactccaggctgcctttcagtgacccaggccccatgggccttttgccattggccttgagtgccttcagctctgagttcctcagtgcctaagcagcacgggaagtgccttctctcctcccttgtcccacgagggcacctgagagggccactgtgtccttacgcccgatgcccatgagagatgctagctcctggggagctcctgagactgtgcaccttggattggaacctgggctcgtagctctgtgtcctacatgtatgcatcgctgcacatgcctggcctgcccaaggcccttgaggttgctgcattagctacaaggggctgcgaggctgagggtccactgctcctaggagccaggcagggctgtcatagattttcaggtggcttccaggagccaggctgtttgtcctgcatccccagggcatgccagcttcaggatctggaacttttaatgtcttcacaaacaaaacacaacatgtcattccagttttatctcatccaggactgttcatagacctttaacacacgatgatgtcactgccatccaattgtttccatcctttcggaagcgcccaaatcccctacaaatccagccctgctcagtgccagcccctgcaggggccccaccctccaggggcccccaacttcagggagagatgagtcactcatcctaagcgagagggacagttcggaggtgttagggatgtaccctggaggcacagggcaagggcagctcctcagcatagccagagggatctggtgctctgccaatctgcaggagggcagggtgggggcctaggcagtcaggcaccccagaggggcatggaggggccctgcctgcgggcaaggcacatggctttctaggatggaatgcctggagccctccagccaggccacgtggacaggaccttgtgctgtggtggtgagggtgcatccagcccctctcttctggctctaagtcccttcagattgggaccacctctgtctctctgtcgcttgcatcccggggcctctcacccgggcccttcctggcatccccctcctggctcaggcctgtgcggccctcccacccacgtgcctgtgagttgactgtgggtgttactgggtggctgccatcgtcatcgctggccaaaaagccatttgggttgtttccagagctgctgtcaggctggaacttggttcacccggatgcacagaacatcttccctgtctagaattcaagagcatgtgactcccgccccctaactgcataaccacagagggaaggtgactttggatgagtccagggcctgaatgagtccagagcacttgaacttacagatgggccggccaggctctttccagtcctgccacagccatcttcaaggctgttccagacccacagcgccacagggtggccaggcgggagattgcaggcccctcctccttcctttgcaggctgtgccaacactgggcttccctcctccttttgtttccagtgcttacggctcacttatcccatccatcaacttatcttcacacgtgcacatgtgccagagagatggttcttactgaggcctgccttctcctgtccccaaggaacatactgcctagttactgaatcagaacccatatatgaaaatttaatagcgtacaagaggtaaacaacaaaactcggtagcagtgccagaaaaagtactagaaagacgtgactgtgggtaggagttgcagggtgaatgccactcgaggcagcagcatgggacagcgtgttcttgggggctctgcagaacagctgggattctgtgatgcttggaagagcaggtgttgccaagtgaggcatggaacggggaccatcccagagatatagtggggacagtatatccacctggcacaagggtttggctgggaacgatcttgggttgtgcggtcagagaagagttgggcgcggtggctcatgcctgtaatcccaacacttttggaggccgaggcgggcagatcacttgaggtccggagttcaagaccagcctggccaacatggcaaaaccccgtctctactaaagacaaaaaaattagccaggcatggtggcgtgttcctgtaatcccagctacttgggaggctgaggcaggagaattgcttgaaccgggagggggaggttgcagtgagctgagatcacgatgcctctgcactccaacctgggtgacagagtgagactctgtctcagaaaaacaaataaacaaacaaacaaaagagttgggaagtatattcatttgcgtgggctgcatgacagtgctgcatttaaacaacagcaatgcactgcctcccagttctggaggcagaagtctcagatcttagtgttggcagagttagcttcttctgaggcctccctccttggcctgcggatggccctcatctccccacgtctgcacatggtcttcccctgtgtgtgtctgcgtcctaatctccttataaggacaccagtcctattggattaggacccactctactgacttcattttacctctttaaagaccctatctcccagtgcagtcccgttctcaggcatggggattggggcttcaatatcaacttggaaacagcgctcagcccatcacaggaaggtacagagtcaggctgcggaggcctggaaaggctgtgggcttcactcgcggggcatggacgccttgctgggagctgtctcagtacaggtgagagctgtaggacggtggtttgtgggcagaggatcttgtgtgtggagatgatgattatggagtgaggggaccaacaaggggcttcctggattaacagacttcaggaacatcgattccaggagctgggaagaggtcgcggtgctgggccacagcccttgttccatcagtgtcccaggagggcaggccagagcaggctgggggtgctgtgctggtgggtaccaggcaccccgaggagggtgggcatccatggaaacagggctggacaatacgattctcagtcattccgaatgcccctcatgggcgtggcctcaccgcgtccctgcaaccaccccgggaggtgggcggcatcactggcctagtttacagatatcagatcagagcattggcggtcccagtcatggcaactgggctggccctccttttgcttcctgggctttccctgccatgacagcttcctccctgcagtgtccctggcttccctggccctgggcattgtggcatcagtgctgggtgcccctgttccttggcgtgttactgacatttgacctacttcttggaccctccccagcagaccttgcgtatgacggtccaggtgatgacgacaatagtacggcgagtttttcatgcacacctgctagtgccagggtttaaacatgaggcccatcctcagcatctgctggatgctggccacctctgagtgagggcagtgggaccacgacgatgagtgggggaggggtagtagccctctgaaccagatgctgttctagtcctcattttacagcaaggaaactgaggcatagtgaggtaactgagacaaaacaaagcaaaatttcttggccagggtcatacggctgatataagatggagccaggattaaaacccagacagcccaggtcctctgtggatcctgcagagtgcccagtcgggtgggggaggtggatgcttcattagttggccaagatgagcagcgtggggcccttgggtggcacagcaagggggctgctcccaggtgagcaggaagagggtgcctgacccatgttggaggataagcaggagtcttccaggccatgggttggtgctgggaggggaaagaaagggcgtgtggggctgagatagctgccctggggcctgagaagtccgggggtgggtttcactccaacccccactttcaaaagatgctgtaaggctggcccggtggctcatgcctgtaatcccagcactttgggaggccgaggcgggcggatcacggggtcaggagatcgagaccatcctggctaacacggtgaaaccccatctctactaaaaaaatatgaaaaaattagccagacatggtggtgggtacctgtagtcccagctacttgggaggctgaggcagaatgttgtgaacctggaaggcagagcttgcagtgagcagagatcgcgccactgcactccagcctgggcgacagagcgagactccgtctcaaaaaaaaaaaaaaatgatgctgcgagaacttagatcctgctgatcctgtccccagtgccctgctctatcagcaacacaatggggcccctcttgccccagtttcctgccatataatatgggcccctaggaaccgggagtggcccaggaagcaggactgagcgcagctctaagagccggtgtcggaggcacacatagctggggtctcccacgtgcaggggcgccctgggatgtggaccagtaaccactgtttgacacctgcctcctcccctgagggcatcccccgctgggtgcctgtcgtgtgccaggcctcccagcagctctctagggaagcaacactcccattttatagagaggaaagcaaggctcagcagagttaagtcgtgtgcccaaggtttcagctagtggaagtttgccccaggtccagcgtcgggctggctggcttcaaaactgccccttcaggtgctcatttcctcctccctccacccctgttgtcctctcgggtccacctgtttgtcactgaacttttgttttcttgtaagttctgtagctgctaccggtcggatgagggaaaggtcacctggtggagtggatgggtaatgaggtgtgacgcgggaggccagcctttttctggctctgctggtaactcgtgtggccttgaactagttccttcccctttctggacttgtggaagcctgtggctgggacttgcccatctccacgtgccctcccgcttcatggtgtctgatttggaaaggcagagagggaagacgggagcatttccgtttcccaggggctgatattcgctctcaaaagaacacaacccaccatccaaccaaagaaagcctcattccacctcccatccaaaaataaggatggcagagaaataagcaacagtcgcctttttcagggaaccagaaatagcctcccgggctccccgctctgacttcccaagtcttcattctgtctctattctgggagaagagctgctggcgccaccactgcgagcttctcgtgatcgagagggaggaacccctgctgtcgctgtccctcaggcaggcagaaggggcttgtctgctggtactgagatggtgggggtgcacctgggcgccacctgccagtgaagacagctgggcctggttccttcccagcctcccactcagctggagcgttctcaggttgggtccagttcatacatcctaagagcagcaggttgggcctttgcaccggctgttccctgtgcctcgttggcgcctccccacccccccagtctttggaaggtgcccctcaccatgttgttcaaatcgcataccccacctctgccggcacccccattttgtggttaatgtttccctgccagctccggccagctatacatttcatttatctctctggattattgtctgggtcccttccactagaatgtaagctcctcgaggacagggatgcctctgttttatttattactatattgttagctcctggcatctagtagaggctcaacatgtttttctgttggtgaatggttattggaacagtagtactctacgtttcttatttactctcacttcatgggtgtgtcgggatgcttttggctaccagaaactgactcaagcggtgcagacatagcagcctgtcatgcccagcaacccgagcgggggcagctcgggatgcaaaacagtctgtgtccactgagagatggggtccttcccagcatgtgctctgtgggctcaagactgccttcagcaaaggctggtgcccaagcttggaatacgagctcatcctagcagtgtggctgggcgagtctcagttgagtccccaccccacgccagagcaggagtggtccaggcagccggtgtgtctgccgctcagagtgtggtcagcaagctccagcctgggacgaatgaacaagaatgaccgtgcagacctttcctggccacccaattcctgctcccacctaggctgctgtcttaacagagcctgggatttcagaagggtgggggtgtctggcctgatgctggatgtggcccattctttgaaaatgtcttgttcttgcatttcgtctggactccagacatctctggaggaagatgggctccccttgttccttctctgacttcacctcagacccagtggggatgaggaacaagactcaatgcgtgtgtagggaggactggaggagaccgtggttgtgaagcatttacttagcccagtgtcctgcagagggcaagcactctggatgacagctactgctactaggttttttttccccttaatgtattgatacaatttatgtatcatacatttacctttctattttttttttgagacagagtctcgctctgttaccaggctggagtgcagtgacgcgatcttggctcactgcaacctccgcctcccgggttcaaaggattctccttcctcagcctccccgagtcgctgggattacagacatgtgccaccacacccagctaattcttgtatttttagtagagacagggtttcaccatgttggccaggctggtctcaaactcctgacttcaggtgatcggcccacctcggcctcccaaagtgctgggattacagttgtgagccaccatgcccagccaaatttaccttttttaagtgtacatctagttctgtagttttgattatattcacaaaattgtgcggtcatcactactaattctagaacattttcatcacccccaaaggaatgtacccatttgcagtccctcccagttccttccttccccagctcctgtcaaccattaatctctttttttgtctccatggatgtgcgtgttctggacatttcagataaatggaatcttacagtatgtggtcttctgtgtctggcttcttccacttagcccagtgtttttatggttcttccatgttgtagcatgtctcaatactttgttccttttcatggctgaataatattccattgtatgggtaggtcacattttgtttattccttctgcagttgatggacttctggattgttgccccatttggactatgatgagtaatgctgctgtgaaccatttttaggattttatgcggacatatgtttccattctcttgggtataagaagtggaattgctggatcatatggtcactctgtttaactgtttgaaaaactgccagactgtttcccaagcttctgtaccatttctctattcccaccagcaatgtatgagggttggaattttttccataccctcagcaacacttgttatttttggtctcttttattatagtcatcctggtaggtgtaaagtggtgtctcattgtggttttgatttgcatttccccgatggctaataaggtgcttattggccatttatatgtcttgttttgagaactttctattcaaatcctttgcccatttttaaatagagatatctttttaattgttcagttgttgatagtgttttatatatttcggatactagacgcttctcatgatttgcaaatatttcccccattctgtgggttgtctttatgttttctttatagtgctctttgaagcaaaacattttaaattttgatgatgcccaattctatttttccttgggttgcttttgcttttagtgtcctgtctaagaagccattgcctaatgcacggtcatgaaggttcacatctatgttttcttttaaagttttgtagttctagctgttataatgagatcatgatcagttttgaattaattttgtatacgatgtgaagtagggttccatcttcattcttttgcatgtgaatatccagttgtccaagcaccatttgttgaaacgaatattctttccgccccttgaattgtcttggcacccttgtagaaaatcagttgagcatagatgcacaagtttatttccagattctctgttctattccattgatctgtatgtctgtccttaggctggtaccacattgcctcaattactgtagctttgtagtaagtttcgtattgaggaagtgtgagtcctccaactttgtttttctttttccagatattttagtggtcctgagtctcttgcattttcataggaattttaggaccagcttgtcatttcctgcaaagaaaaagctgtagttttgatggctatcatattgagtctatagatcaatttgggagtattgcccacttaacaatattaaatctcctattaatgagccttgtgtgtctttccatttattgaagtcttctttaatttctttcaatggtattttgcagttttcagtgtttaagtcttacacttattttttaaatttatttctttttgatgcttttataaatggaattgttttcttaatttcatgtttggattgttcattgctggggtatagaaatacagttgaggccaggcatggtagctcacacctgtaatcccagcactttgggaggctgaggcgggacaatcacttgagccaaggagtttgagacaagtctgggcaacatagtgagacccccatctctaccaattagttgggtatggtggtgcagttactcagaaggctgagcggggaagatcccttgagcctgggagtttgaggctacagtgagctgtgatcgtgccactgcactctagcttaggcaactgagtgagaccctgtctaaaatacacatacataattttctctttttttgatatggagtttcgctcttgttgcccaggctggaatgcaatggcgcgatcttggctcacgtcaacctccacctcctgcattcaagcgattctcctgcctcggcctcctgagtagctgggattacaggcgtgcaccaccacgcctggctaattttgtatttttagtagagacgggttttctccatgttgatcaggctggtcttgaactcccaacctcaggtgatccgcctgctttggcctcccaaagtgctgggattacaggcgtgagccaccatgccagacccataaatataatttttaaaaattaaaaaagtacagttgcttatcatatattgatcttgtatcctgcaaccttgctaaactcatttattagctctaatagttttggaggttttttaaatatgtgcattccttgggattttctatgtataagatcctattatctgcaagtagagatggtttcacttcttcccttccactctgtatgctgtttcatttttcttgcctaatggccgtggctagaacctccagtacagtgttaaatagaagtggcaagagcagacctccttatcttgttcctggtcttaggggaagtgtctagtctttcactggggagtctgggtttttctagaaggttgaagaagctcccttattttcctagtttgtggagtgttcttgccatgaaagggttttagattttttcaaatgctttttctgcatccattgagatgatcatgtggtttttgtcctctattgatatggtgtattgccttggttgattctgtgtgttgacactgctattgttatgaggtttgccacagagcagagtagcatgctgtcaggaaccccctgagccagggagctccatgggcactttttctgcgagggaggctgtagtcaacagcaggggcctgggagtcagatggtctgggtatgacctcctggctgtaccactggctcaccatggaactctatgcagggaaatgccacctctgtgccctagtttcctcatctgtaaaattctcaggggacaggagtgcttccttgtggggttcttatgagggtaaatgagttactgtgtaactacgttgaacagtttctggcatggaacacatgcagtgttttgagacattggctactggccactagtgacattatgtaaaagcttggatgggccagggtggggagggacagttgaggagggcattgaaatctgaaagccaagctgattcacctgctctaaaaactccggggggccacagggagtctggaagctcttccaggaggtggcctgtttgaccccagcagcctccaaatcttcctgtgggaggaggggccaagggtggagcccaggctggtgagcgcccgtccgaagcctgcctatggcagaaccctccagtttaaattcaggcctgagcaccatatcctttgggactgggttgcaggggcggtgtgtttgcagcgaggaggcttttgctcagactgcttcctcccttgacagccatggagggcctgccagccctcacagcattcccgccctgcctggggccttgtttggaaaatggctttcagctgagcaccagctcccctccctccccaccctgactttcctgacttcccctctcctgtgctgccaggtgagcctggctccttgtcctggctctgccgttgaccactgtatgaccttggggcctgtttctggacactgtcagggaccgcttgggattgaacaggcctctgtgcagagggcctgcaacactgtctgccaggggctcaggaaacactggctccagaccaccctcccagtgccccagagaaactgcaaccccccaaatctttctgtttggagtttagactgtgagggtaggagtcggggaacgggggaatgaggatgaggagggagataaaagcaattttatatgccctgtgtaattcttggcatttgtttttatgacataaatgaggctggatctaccttgatttaatgtcctgacctcctagccagccaagtagctagcagctcgagacagtctgctttgctctgtttacttttggtttggtttccaagcctgtgggtggcagaccgcccccgccccgctcacactcagcctttcctggcccctgtgccctgaagtacagggtggtcccacctttgtggtcttatcagggaagggggacaatgacaagaaacaataataacaaaccagtaatttcatcatcagcagagagattccaaatacattttgttatcccacaaaaaatcagtttacccctgctcggtgccaggcacgagtcaggatgaacagaacaggtcagcttttgagggttttaggaagttggactcactcttagaatccactgggtgggcctggagaggggcccaggaatgccaagctgtgaagggcgaggaggaattggcagggggaccaggcgcggcctgggctggagcatgcagcagagatgcagtgagcgtggtggggaggccacctctggagctccacacaatgccctcaattatgttaagtagtctgcaggtgaggggtcaggcagtgtccatgtggaaacagttgtgtcaccaccagctagttctttaatctctctgaccccagtttcctcctcatgggattattttgcaaactgtggaggtgatgccggcaaagccctcggtacagcgccagacgcatgctaagagctatattgtcactgcgattattattaagccagtgtatcacatggtgggaaagtctttattgaaccagaaaaaatggtcatggcttatgaagttaggattcaggttacaaaatttgtacagctctctgcgtgtaaatgtacgcgtgggtaaaagtccacagtggtggggtagtagttgtaatgtcttgtcaatatgtacattttttacttttctgtactcttcggattttacacagtgatcatacacgagttttgtaattacagaaatgttattagacaatgtaacggcagggctgtggttattgttcacacacacgagcacatgggactgcagaggttggggacggtcagatccaggagcgtgggggcactgaaggcccctggggtggggcgggctgtcacaggacgtgcacctggggcggctgcccaggagctgtgctgaccaggcctcccttctgccctagacgacaggatctgctcgccacccttcatggagctcacgagcctgtgcggggatgacaccatgcggctgctggagaagaacggcttgactttcccattcagtgcgtaccatcccagctccacctgagggcaggcgctgtagaccgcaggccagcataggggaggggctgggtttatagtgccctctggatttaagctcacccgaggatggatgagcacatggccctgggtcccacctccacccacaccatagaaacgggtcctggtaggggacacaggtcaacgtgctctcctgcctggcctgggggtgtctacccacacgtcaccctcagtgcagataccaggtgtccagagtctgtgtctcagctagagttcctttctagacgtgccaagtacctgccttgtgggtgaacggcctcactaatttctctctgcttttctctccccaacccatagtttgcaaaaccagagtggctcatggcaccaactctcacgaggtgagtggaagaagatctgactgttgtccctgacccccatcctttcagctcatcgtgtctcactgctaccctgccggattcctcactgccactgctcctgccctgctgttagtcctggctccttggtagatagcctccttcccttccctggactccagaggaatcgagcgggagtgctgtggcttcatgcactgtctgcaacctcacctcaatgcctgtcctgtccctaaggcaggaggatgtgctggggacccacctgtcctctgtggagcctgtcgtagctgtggcagccataacaaaccccaggcactgggtggcttcgccacatttattttctcacagccccggaggctaaaagtcccaggtcaaggtgccagcagggtcagtttctggtgagggctctcttcctaccttgcaaatggccaccttctcactgtgtcctcacacggcctcttgtgtgtgtgaatggggaggggcagaaagcaagagcaagctctctgatttcttctgataggggcactaatcccatcttgagggccctgccctcaagacctcccaaaggccccacctccagataccaccacagtggggcatgggcttcagcgtaggaattctggggcacacgttcagtccataggggagcttgtgcgagtcatgcctcagtccggcccgccctgcagggctggctatcctttgggccatcagtgtcatctcttcgagggcctgttttgtggcaggcaccgggctgggcccacatgagggctgttagctctgacaaggctctgtcactgccacaggggtctgccatgctgctgaattgagacgggccagggaggaaaagagggctgcttagaatcaaccctgtggaatgctttgaatcatgagtcacccacccgcccattcattcttttattcactctatgatgttcccggccaccttgaggaccatggagaccaggagacagatgcataggatgtgagtcctgtccctagagagagccaaggagcctgtgaggactccaggggctagaggagtggatggtcatgcaggggcttcgctggggccagggcccgtaccaccctcaggagccacacctggggccttgtctttgccctggacacagcactgcctggggtctccccagtgggcacatgttggggtatgctgggcaacaggcatctgaccggagtgggctctctggggaaggcttgtccttggaaagccccaccaacagaaatgctccccagagctcacgactaaaaggggaagatgcagcagcatgggcctttcctgggttatgtactgctctttatccctggcctgcacttccggggaagtatcagcagacagtgtcagcgtagcgcagcacatgctgtgatgggaaggagtgtggagacagcccgccgtcccgttgtcagttgtctgaaatcaggagccctcacgtagtcttcctgtgggtgttggccctcctgccgcagcctacctgggctctgtgcctggtgctggcagcaccctccaggatgtaccaggccagggagggagcaggaaggctcgagagcagcagcgttggtccccaggcccccctcagccccagtatctgcctgcccgccttccaccagcccctttaaccacccagtggttcctctgtgtgtgagttgcttgggtgttcccagatggaagcacgagcgtagttattaacgtgagtagatccgcctaactcagaacctggcagcccgggaggagggagccacttctgcgagtcactcaaggcctgagggccggggctgtggaatcccagagacctgggactgattctggtgccgtgtgttgccatttgtgcgactttggcaaattacccagccacccagagtatcacatttgtgactggagacgttagcggcttctgtgaaggatgaggggtcactgccagggttgcctgggtggactgttggatgagctgccggaaccagctgccctggtacttgcccggtacttgctgaaggggatgggggttctggatccaggtgcacccctctcaggatgcccctgatgggcctcgggactctcagccctcaagtatggggtcagcacgctcaggggaagctataaatcactcctcattctagccgcctggctccaggatgtttgtacaggtgcccctccctctactccccagccggctgtctgggtccactgccggcaaggtgtgccaccacgtcccatgtactcagagaccccagcggactctctgtgcagacggggcatgttagcattgcagggacgtgccctctggggtggacactgtccaccagatcggcagaggttgggggacaagcttctcacagattccaggggtacccggggaagccaagtacagcaggggcagaaaatagcactgtgcatggctggctttagatagggcagcaggtgcttctgatcgggagtcctcgtctgcatcccagcccgcgcactcccggcctctgaatctcccagcccgagactcaaccaaaaccaggaccatttctgctaaaccactctgtcttcattttatgttctcagaactcttttatttgggtttttgttttgtttttgagccagtgtgagggtactcatttgctccacagtggaatctttttttttttttaagctataacttagccaaaagctcaaagcatccctgaagccacccatgattttgcagaggaagacagtggcgcttaagcagggtgggggcccagcctcggctcacacagcaagtgctcagcaggcattccagcccctgcctgactccagagctgctcgtgtttttcctgtcctttattcttgtcagaaggctgaggagatgttcactgccccccaacgcccccagcacagacacacactttttgtttttcccatgtggcctggatttccacgtctgtcctgcccagctgagctccaggcacgtagggccggcgctccgtgacagctgacacaaggggtggcagctggggaggcagccagctctccggggcccattatccctgctcagcagccccagccgtctggtggctccttcctggggccctgcgggctgagggattagccatgaccctggcaccagcagctggatcggctaggcctagggcccacccctctgtccttagagcagaccctgtgcagagcccgtgctggccggggctgagagggttttggcagctgcccccctgcactccctaccccagcccctaccagatcctcctgtcagggacctttttccccagaggagtcggggaccaggagcacaaaggcctgttgtttgcggagtatcacatggctccgtgtgtaggggcgcggctgggtgctgtgcagacccagttccatcccgggctcactcactgtccagcagtcactgaacctctcagcgcctcatcgtcctcatctgtgaaaggttgtatgctcacctcagatgtgcattgtgagggagacactaggtaactggtgtacgtgctcagaacagggcccggcttgtcacaactgcttgacaagaggcagccgttgtcatcagacaggctttgacccaaggcctcctgactcctgcgcccgagtcatctgcttccttcctcctcccgggtctttgtggaggatcctttaggatgtcagagggttgagcagcacacaacctcagcggcccccttccctggaccacagtgcgacaagtggtgtcacgctctcagaagttgtgcagtgcacagccagctcgatctcacatggcaggcccggtgaagggaggatctccaaccccgtggcagaagggatgcatccccaggtgttcttcacaagtcccactccactcaccctggctcaaggctcctctaggggagtcctcatgccacaggaccagggatgggccttggtggaggtgctctggacaggtgacacacctgtgtgttggaggctgagaaggtggtggattctgacagagcttttgaccccttgtcttcccagatggctatcgtgttcaaccaggagggcctgaacgccatccagccaccctgcgtggtccagaatttcatcaaccacaacgccgtcctgtacaaggtgttcgtggttggcgagtcctacaccgtggtccagaggccctcactcaagaacttctccgcaggcacatcaggtaactgctcttctcaccatcttgggctgagcaagactcaggggcccagctgggatgtggcagcagctgtctgtccttcggcactgccccaaccaccctgtgttcttggtgggatggagaggtgctctaaaggtggaaacagttgtgtacggtggataaagaggtcttggggaactagtaaaatgtccctattccctgggtcattgtagggggccccactcacctgaaccaccgtagactccaggatgcatccagaagtgttctgtccccagcatgcttctgggggacccacacaataatgatattcatggaggaatacgctgggacaggtgtggccagcatggcgtggattggccttccagggaagccagggcaggtgctgcctgctgtctcccgctgagccatctttaccttgggtctcattttcccctggggagcctgagacagagttgcctgctgctacctgcatagctgccagggtaaatcagactgtgagaagcagcagctgccgggttacaggtcttcttaggtgcaggactcctaccgtgccagtgagcgtgttttgagtcagtggacggtggtctaggagtcccgtgggtgtcacatagggcgttctctgcatgatgctgttgtcgctgggcctgagaagcagcctcccagggagcagcctgtggaccccactgcgctgaggggccttccttccgccagctgctcaccgccctctccagcctcagccattttaaaaacggacactgagttaaagatttgctggcagtggagctgctcgaaaggatgttctagtggcttctgaaggcatctctaaggcacgttctggaaacctttggaacagtggcagtgtcttgggataagtagctttccaggaggaccctttggagaacactcactgccccgctgtggcttgttcaaatcagctgcacatttctttcagcaaggggaacccacatcatcagaagcgttcagacgccggctgttttacctccagctgagcaaacagatgtgtcctcttggcatccctcctccggggactgcctgtggccatccacatctcctggctggtgtgccgcccggcatggaggggctgcagtgctgcggttgccctctcagcccttcttcccctagatgcctcttctctttccatggacacatgcagagcgtggatactttggaaacgtgcaggtgttcattttcctccgagggcaggtggccttcctagctgggcgtgtggctcccagactcaaggctgtattttcagggtttgggacatcatggtcccagcccctgcccactgggtgggagccaaatgctggaagcatatttttatatgtggctatataccaccaagagatattcctccaagttatgggctggaagaggctgacattttttaaaatgctgtttattccctgatttaagaaaataataatgctttaagtctatggaaaatatattaaattaagaggagttatattttatatcaactcctttctgtttttacccaggtcactccatctctaaaagaaatttactgtcagatctcctttcttatccactgtggttgggtttttctgttttctcctttttccttctggttgcaaaatgctgggccagtttccgtctcgacgctgggaaccattaacagcagagtgtgggctcctatcctgtatctgtgaggacgaggactccttgcctgtgtgtcttcttgtgtggctatttctaggttgccagtttgccataaaatgcataccaggagaccagacgtggtggctcatgcctgtagtcccagttctttgaagagaccaaggtgggaagattgcttgaggccaggaatttgagaccagcctgggcaacatagtgaaactccatccctaccaaaaaaaaaaaaaaattaaaaaattacctgggcatggtggtgtgcacctgcagtcccagctactaaggaggctgaggcaggaggatcgcttgggcccaggagtttaaggttgcagtgagctgtggtcatgccactgcattccagcctgggtgacagtaagaccttgcctcttaaaaaaaaaaaaaaaagcagactaagcccaaatagtagagaaacacacagagctaaaaaggagaaatgtttattctgttcacgtgaactaagtaactgttagtgtgtctctccatccccaaagctgattctgtgtccccatctctagggcactgtgccagggagctaacgtgggtcctctggtttctacgtgtatgttctctttctggataagaagtgtaatgcaacagcagccttttaagctggaccagttggaaagggggtttgggactctggcctctttccggccctcaccccagctttccaatttcctttgcccaatgacatgtcccccaacttcccgtggccacgcagggatgggggttccttgagtgggatttttctggacctgggatagagacagggacatgagtcttcactcgacaactgccagtctcctttgcctgtcagctgcacttttgttttttacgtgttgacatctcaaatcaagtgtgccttatagccagtggcatccatgcagaggctttggctggagctgaagtcaggttgtggcttgtgccatccaccaggaacattttgtgttctctgcctgtggttcgcattcacagagagactgtttccctccctccaccctgtgccagggtagagattagcgggttcctttgctctccctttctatagagtgggtttatttcttgctcgtctttaccctgaggacgcagcgcaggctcccagctttatgcaggttccctccattattctctccagcttgagccttgtttctcttaggcatgcatgagtggtacctctcaccatgtagagcgggaggcagcaaacttttttttgcaaaaggccaaattataaacatttccagctccatcccaattatttaatgctgccgttgtagtgcaaaagcagctgtagatatgtaaatgagtggcacggctgtgttcaaatgaaactttatttacaagtgcaggtggccgggcttacagcctatagtctgctgagctcctctccagagcctcttaatagtcagtgatacagcatttatcaaacctaccatgtgcccagccctgcgtgagctgctggggatccagtcagggactaggcaggcacccagcttcctgccctcatgagcttgtattctggtgggagaaactgcacacaaggagagaaataagaaaagggtcaactgtggcctgagataaggggttctgaggggaagagaatatgtcctgggataccactgggtgaggggagccacttggaaagggcagctcaggatttccctctgcagagatgatactcatggcaactggaagatgacttgggtcaccatctgtagcattaggacacattctccccatccccttcgcctcccaagagagagagaggagatgaaggaaataaggctaaaagcagtgtggcccagctcgtggctgtacggctgagttgctgggatgtttgggggctaatcttatcatttattcttcttttaaacctattttttaaatccataagttgagaagaaaacacacacattcttcctttcattgccctccctccctgtagaacgttggtggtagttctccactggtgctattgggctagtccaggaacagactgcatggggcacccaaaatccagggtgctgtcgtgagtgagggcttgctgatacatgctgggagcaacgccctggtctggtgtgttagaggaaccgactctcttggagctggccaccaggtttctttccctgatgccttctcacttgcctcagctttccatcatctcttgggtgactggcagccacaggaggctgctcctactccctccgacccctgttcagaccgcacatagagaggaactgagcccagaccatctctcactgccctgccaaaagggtcttctggccagagctcccaggtcagaattagccagaagggccaggtgcggtggctcatgcctatatccccagcactttgggaggctgaggcgggcagatcacctgaggtcaggagttcaagaccagcctgaccaacatggcaaaaccccgtctctactgaaaatacaaaaaattagccaggcgtggtggcaggtgcctgtaatcccacctactcaggaggctgaggcaggagaatcacttgaacataggaggcggaggttgcagtgagccgagatcgggccacagcactccagcctgggcaacagagtgagactccatctcaaaaaaataaaaagaaaaacagaattagccaggaggagaaaagagccccttttgaaatgtcctggactccagctcttcctgccaggagaaactgttgtgttgcatgatctgtccaggtgagcagacactggccggcccctctgagtacccagctctggcccttcctggcacccactcagcacccacgtgttctccttgcggctcctgcagacttcccaacctccctgatctttgctgtgtctacctgcgcttggtggcccttcctccccctgggccttctccgccattcggcaactgctattcaggatctacagggaaataggtgggaaggtgccctgagctcagggggctgagccaggctgggctacaggatgagaaggtgggcagcgttcccctcccagctgctcgagctgttccagccgcaagcccacagggcttatgccatccccacagactccctcttcttggctgtcggtgccttgggagtagagatcctgggggccacatgacacatgtcctgcggggtgtttattttccccaggctcctccccaggaccatatttcatggcccccgtctggactggctctggtcagagcagcaggaggactgtcgggcacaccagggcagccaggggcctctgtgccccgctagcgggagggacgccgggtacatctcagcgcctgcctgcttggcttccgcccgaatcactccctcatgcataattgttgcggcgctgtgaagtcctggagctgatgggtcgttggcagccagatcaggtgccccattggcatggcccccagcacgcagcggccctcagccagtgccctcctgtcctcgcacataggcgcctgggtgccaggggtgtgcattgcatcctgggggtgggagccacaatgcctcaccctgcaaggactcaaggaggggctgctggggctggcggcccaggacggtcccgtgccagccttgggggaagtcgtgggatggtgacagacagccttttccagaactcggcctgaggctcatggttctgcaattcttgcatttgcgtgccaatgcttcccagtgcctacaagcgtgtttctgaccaaccgacctgacattttccccaagtgactttggcttactccccaaagacatttctcctgtgggatctacttgcactttcagtattctttggactggtctgcctctgcgggtccccagtgggcctgtacgggccgggtgttgtgggaggcaggcgggagccagacgtgtggggtgagggtatttcagactctctgtgccagcttccgttgccaaagagaaattgtgctgtgtgctttcttggacggatcctgtggaagcctacattctctgatttcctatttttttccctaagtcgctaagaaccaccagaaccctttgtattttaagtgctcacgtgccggtgccagcctgtccctatgtctctagcatgttccccaaaagagagtcccgtgggctgggagcactggcctaaataacaccaagaggctgctttgatgtgggccctctctggccgtgatattcaggtgtttagctgtcccaccgagcccttttcccctacttccctgtatagtgacagcacactttgggaacagggcctcagggaaaaccagatgtgatgctgtgagatggtagcagaggtcagctcattacatcggttacttttatgtgggaggagaaggtgaaccggagccctgatggggcacacatccgtgcccagggctggtgcccagcttgctggagcccagggctctgcagagccgggggccacgtgttgtgtgcctggggtgatgctgccccctggtgtcaggtggcggcagtgtggtccctgcattgaggttctaacgccggctccttcctgtcgctttttcagaccgtgagtccatcttcttcaacagccacaacgtgtcaaagccggagtcgtcatcggtcctgacggaggtgggtccctctgctgggatggcctggcctgaaactgccctcccgtgggcctaggtgtgggctgctgtggccatggggtccttggccaagctctccagcagggtagggtgggaaggacgtttgcctccatgccacaggccccaggaggttccagagccccctgttcctctgcttgcttcgagttttcatgctagcagccattgcagcccggcccagcacagggagaggtgaggggcacactgggcttgcagggacagaccactcactgcaagctgcccacacagaaggtgtgctgacccttctcccagcatgaggaattggaagaactgctctctaatctgccttgttcctgattttcaaaaaggctgtggaggcagcaccatctcagtcctttgtcctgcagtggtcctgaggctggcaggagtgttaccctgcccccagcactatgggtaacgggcgttctggccgttcagtgagtgttgctgtggccagtgtcagcccaggtgccctgcagtgcgggtcgcaatcaggtctcatggcatcagagaggctcagtgatctttgcacgttcacaaggctgttcacacggtgcaaggctggggtttgaccccagatctgtctgactccaaagttggatcttccaggaatttaggacttctgacctcaccagtgattcctgagcacctgaccccaaagaatttaggaaaggctaccctctgctgtttgcccgaagtccagagagccagcggctacttccctaaactcaagagccctctgccagggagcctgctgttctgaggatgcatgtgtgctgctcttctggggggctttgctggtctcttcctccctgtcctgggctggcctctccaacgaaccagcctccactccagtggcagtgctcgtgtccctcggggggctgccccagaacccagatggcctgtctgtctgtctgtcttttgtgtcagggtcctctgaggagccagcagtgtgctgaggattagacagagcacaggcgtgggcaggacctggagggaacatcgccatccctcaggatgttgacacatgtcccctgggaacatatcaggctttgggaacagatttcaacagagcctcagtgcctggctgagaatattatgagatgttctgtgcaagagacggctttcttctaagcttcagaatcctggggcttcttccgtgcatggctttgctctgggggcctcggcagcccatgcaatggaggggatttggcatttgcagactgagtgtcctctcaggggcaaggccagcagccgtgatggcagaaggacccatccagaagtcactgtcttggattatcacttgttgacctcagccttaatctcctcatctgtaaaacgggaaggggtcagcctagagacactgcagggcccttcccttcacctctgaggtctgcagtcacctcctccttccctcagcacatggctgctagtcaggaatctgccaggactgacgatttccaaaaatagaaaagagaaatgcggtcagcaccaccttttccactgggacatcagcccctcctggacgcccgcaggctggcctgacagagccagctctgttcccaggtgcggaaacacgcttgctgctcatccacctgcccctgcccacctggggctcctccagtcctgccttggcctccctgggagtctggtgcaggaagccctcctctggccttaaagcaccccctcccttcccagtgggatgcccctgcggatgggcctagccccaccgaacttggagggccccatacattttttgcttttcgaaattcagtctagggtattagttaagagcacagactctgacgggactgcctggggtccggcccaagctaaggcgagtcgcgtcgcctctctgagccttggtttcttcttcctgccccagaaggattccggagtccagggagttcctgggtgagaagcacccaccgcagttgccaggtgtgcagtatgggcacggtctcggcagccgggtgccgaggcccactggggacccatgaacgccttcccagttcctctgtcacctccttgctttccagaacgtcatcagatcacttgctttgagggccccaggcatcttgtcctaggatggctatttggttttggataaccagacaacttcggaaggatttctgagattctgcaaccaggccgagagcacttttgtaaatggcgtgccatggggcgtgtggcagtgcagcagccaagctcccttgctgctgggcctgtgctgtcagcctgaggcagcagctcctcccgtcgtcggcaccacaatctcacagcgagatgtttttattaccccatttactggggcaagaaaacaaggcccagaagggttctgttatggcttagggtacacagtggagagtgggcagctccaaggtatccaccagggtctctctgactcagtgagggccttgggctgcaggatgagtggctgagctgccccactaggcttagcctctggcccccactggcaagagtgacccaggaggctcagaaaagctaagtggctgggcgcggtggctcatacctttaatcccaacactttgggaggccaaggcgggcagatcgcttgagcccaggagtttgagaccagcctgggaaacgtagtgagatctttaatccctaccaaaacaaaatacaaaaattagcagggcgtagtgttgcttgcctgtagttgcggctactcaggaggctgaggtggtaggttcatttgagcccggaaggtcgaggctgcggtgagttgtgatctcgccattgcactgtagcctgggcaacagagcaaggccctgtctcaaaagaaaaaaaaaaaaagaaagaaaagtgctaagggatgagtgtctcttacagccaggccactcctgccccctagaaagtatttcttccagatacgacaccaaggccttgaggctgtgagcaggggggccctgtgtgtcctgcaaagccggggtgggagatgcgctggtgtaggcctcagagcgtgggtgatatccaggcgtgggtccctcagagcgtgggtgatatccgggtgtgggtccctcggagcgtgggcggcgcccggacttggagcgtgggtggtgcccgggcatgggtccctcggagcgtgggcggcgcccgggcgtgggtccctgctcagcgcttccctccctggaagttcccagtggttacttcagcctcctgtgcttgggtaagggccatttttcttggtgaccagggctctgtccccagccctgtcgatctgctttcacttttttttttttaattcaggtgcacctggcacagcggctcacacctgtaatcccagcattttgggaggccaaggagggaggattacttgaggccaggagtttgagaccagcctgggaaagatagtgagaccctgtccctacaaaaaacaaataaaattagccaggcatggtggcacacgcctgtagtcccagctaccccagaggctgaggcccaggagttcaaggctgcagtgagccgtgattgcaccactacactccagcctgggtgacagagtgaaacattgtctctaaataaaataaaattgaggtaaattcacatacataagattaaccattttaaagcgaataattcagtggcaattagtaccttcacagtgttgtccaatcaccacctctatctggttccaaaacattttcatcactgagaagaaaaccctgggcccaccggcactcactccccatttcccccacctcatgttattggcagccgctgagctcgttgctgtctctgtggcgttacctgtcctagatattccgtagaaatggaatcacacaatatatgagcttttgtgtctgggttcctgcactcagcatgatgtattcagggttcctccgctttgtggcatatgtcagaagttcattcctttttatggctgtacaatattccgtcgtatggatagaccagtttttgtagctgttcatctgtggatgcacgctggggtatgaataacaccacggtgagcgtgggtggacagcatccgtttgagtacacgttctcagctctggggtgtgtaccccggagcagaactgccaggtcagatggttattccatctccagcttttgaacccagcttcacttttgtctttcatggatcagccactcccttcccctttggcccctaagcccacaacccccaaaacttcactatttattgagcacctagtgtgagccctcccttggctgatttagaggagacgggatgcagttcctgccctagaattcagatgaatctcctcccagccgggcacatgctgtccacaccttatcaacataagtctgagatggaggcctgttgcttccttttacagaagagcaaacctgagacagagaggccaagtactgtttccgaagtccacagagctaggagttcactgtcaggtttggaacccacgtctctctgactccagaatccttcccagtgcagtgccccacttccttggaggccttggctgggggcaggctgagcccatgacagtgtgtgcctgtcccaggccagctgcgacaggcacaggacttgagtggcagaggggagtgccgggctgggagggagaacagagcagggtggcctgaccagcacatggaaaccttgaggaaagctgagcttggaccccaggaggcaggcaggagcagcagagcagcctctctggggagcccgcattgtttagggtgtgagttcatttggaaacagcatttttggggaaggaagactggcctgctgggccacagggccctcaccctcacctccttgggggtctctgtgatggcaggcaagtgggggtctgatcagaactcctcacttgtgcccggctctgcgccccagctgctcctagccatgtcccacagctgctggcctcagcacctttgcctcccctgtgtcctccctggggccgctctccttctcccacccctcccaggggcccacatcctcctgcctccaagttccggcttcggtgctctgcaccatgtcttcccgggtccctgacacactctccatctccttcctccctgttaaaaggctttggttttagaggctaaaaaatatgggtccaaattctgccctgtgcttttgagctgtgtgactttagaccagccccaaccctctctgagctccggtttccctgtgtgtaatgtgcagtgctggcactggccttccaggctgtgatgagcccacaggaggtaatgagcctcacacacctcgtgcctggcggccctcagagggcaggacctggccagtggccgccccgtgctcaccacagtaggtctgtctggcttcctggcctgaagcatgccagggcctcgtggcagctggtgtggggggtctgtctgtgtggtgtggcttcgcagctcctcggcccatggcctgacttccttgtgtatgttggcagctggacaagatcgagggcgtgttcgagcggccgagcgacgaggtcatccgggagctctcccgggccctgcggcaggcactgggcgtgtcactcttcggcatcgacatcatcatcaacaaccagacagggcagcacgccgtcattgacatcaatgccttcccaggtgagtggcggccaggccacctccactgaccggcctccagagactgtcctcaggtgaccaggcaggtgaggcggggtgactgaggccagaaagccagctttctccctcaccacgaggtccggggaggtgcagccccgagaagcctcagcctcacctgcgcgatgggcttacggggtgtgcgaggagggagggagagctgcacgtccacctggggagcgccaggcacagtggccacagcacgcatgtccctcacctcctctctccacctgcgtcattggtggatcagcccctcccccaggccctcctcgatttaaggagcaggaaggaccttgaagggattacagccccctgcagtttacatgttgggaaactgaggccctagagaggaggaagctgttcaggccccacagcacattggtggcaggccagagactcccaggctcacgttgcctccaccaccctgaactgcagcgccgggcagaggcctggggaggagccctgggctatggagtctgttccctgctgccagctgggccctaggaacccactggcattgagccaggctctgccatgtgcccctcagctctcagtgaggggccctatggggaccgcaggagcagagccccagcacagggcatgaggaacgatggtgtgacatcacagctcgcggtcaccaggctgcgtgcctcgccctggggacaccaaggctcagtggcttgtttacctcccgcagcagctcagagacagagccgcgcttgatgccttggtgcctgccattccccagatgggggtcccccgttcctttctccatcctgacccttgtaaagcatctgctgtggaggtgaagccagccttgctagctgctgaggtgcaaaaacgttcaggaaatgcctcctgccttcagagactgtgcctggcaggtggggactcggggttgtttatcgtggaggtgaggcaggaccttggccccacacactggctgggcactttctgtgtgtgtcacctccgctcgtctgagagcatgcgcaggcgcagtcagcagcaccggccacagcaaggaagccaaggctcagaggagtgtgctggctcctgtcattcagctggtgtttacccagggctgctgtcgcccagggctgctgtgtgtcccagctggtccagatgctgatgcagcttgagctccactgccatgccctgcctggggagagctcacccctgtctggaggaggcggaggacagagcgggcggtcagcgggctcctctgtgaggtggtgacactggagcacaggggcaggtcccaggagaggcaccgtggagccctgtggctacagcaggtgcagctgcggggcaggaaggctggaggacagagtcaggggagctgcgtgtggtgaactgaggacgttggagctctccctgggagtcggggagcagccaccgtgagatctgtgcttgtgaactgaaagggcagacccgtgcgacgatcgtgtttttctccattgcctctgggtgcagtgggggggaaaccatgggtttagctggagctgggatttcatggggttttgctggcaggtatgagggaaccagggcgcaagggacattcaggataatgcaagggacgttcaggataaggaagtgtgggatctaaaccacggagcatgttttgagtggcagaatgaaaaggggacaacgtcagtggctggagggccaggggggcacagggaggcctgttagaagagaagttctggaaggagggaggagacaggagagggtgggaagctttgcacctgagcaaggccagtgcctcccaacacaaaatgtgtagatggtcgcgatctatgggtgcagataagggatggccttgtgagtcagtgtggggcactgtgagccagtgtggacagggagggttcttccagagaagccaagagaagggccacccagatggggtgggactatggctgagcctggcggagactggtgagggagcctggtactgaggagaggcccagggctctggcagggcagagctggttccccgggagatagctcagtgtgtccgccttaccatagagcacccttttggggccaagcagagcagcaggcctgttctcctgcaccccacaggaggcaccttgggccatgggtgtccagcagcacgtgggtgggagaggcctgggagagggcccctccagagaggggctggctctggagtaataaccgcaacagctgcaagcgctgatgacaccgtgagccaggcctgccccgacgcctcacttcgtcctcacgaggcgttgtgcaaagggccgctggaatctctgtgttgctgataagaatgtgaggctgggggttgagtggcttgtccaaagtcacgtggtggagctggatggggcccagactgtcagccccagcctttccacctctcagctccagccatgggttcgaatcttgcctctgcctttacagtctgtgatggcacaagccacctaacgtttaagtctcagtgttcactgcagtgggaaccagtttcccaccctgcagacagaggagatggcttttgcacagtgctggtatggagctggcaccctgccctgcaggttcatgcctcagtccgctccccgagctcctgtttatcctcaggcctccgtggaggcagccgtctctgcaccaccacagaaagcggcctccctgccctgggccactgggcgttgtctggggatgctggaggaggttgctggagaatggctccctgttccctggcgctgacctgatggtggagctcctccactgcatttctccctaggcacccaacagccatgcccgtgcccgggacacctaccctgccctccaggcctagcccagggccgacggacaccccgggtcctatggtgggggacctggcaccatgtggtattcaagacacacacaagaccaagggcgtccttcagatcccactctgcctcttaggagccaccttgagcctcagggtcctcacctgtgaaacgggctgcaggggtgcggtgggctgaggaccgtggcgctcacagcccagtggctgctacttcccgagtgctgtgaacgccatggacgtcatcactgccctccccgtggtggttaacggtcatgcctcctcatctgtaaactggggacagcattatgaagattaggcgagaggatgttgcgggacgctcgcacagtgccagctcgggaggcgccgcttgccggccagaatagccatctttatttccaccgcgggcacctgcatcccctctcagacttgggcttcctcaaaccacagcagttgtttgctgaataagtaagggcatgggcagattcagcagtctcatcttccaggcccctgggcactgtaagaggtggcacagggtgcccccgtctgaaccttcattcccaccctggtggggctgatggttgtaaatgttgtcccagaggacagcccagggtttttgaaaactcccgcccctccaagttggctcaggcaggcagggcgcttgccctgtgtgagtctcttttggagcagtttgctgggagccagcagaatcctcccctgagatccgaaacctgcttggtggctcccgagggctctgccgatgttcgcaactgtgttaggaagcacttgccccaggcaggtaccatggtttctgttctgttcccctctgttaaggggagcatgtgatgctgcgccctggagcttgtctcaggcctggatgttgctagtgatgcccagcatttccgttccttggctgtgatcctcagagaatgggacacagggggcctccctgcaggtattttgtggtgagaaggaagcagactcagttggggcggcagctgctttgtgaagcagacaccactcacatcccagcctctctcagtagtgccacagcagcctccacctgggcggcagccttctcttctcagtttgcagacagggaagctgaggctcagggtggaagcggtctccgggactcagcctgaggccagactcagctgggcctcaggagtatttattactccaagtgtgtggagctggctttggtgctgctacctccagccacgccaacatcccctgcacatgtactggcttttaccatgcaagtggatgggtgggtgagacagtggagctgtgcctgagaggaacagggacaagcaagtttcatcctcagctcaggttcttcagcttctcacaccctggcaacagctgaaggtcgaggagcacgcacctggttgggcgtccaagctttttgactcccctcagccccccttatctgctgagcctcacgttttctctgtaaatgggacgctgacagcacaccctgcctcatcccaggagcccatcggttctgcctcctcctcctcctccctgcatgatgcgtgcccctggctcacgccccttgtgctgtctctctcccacccccaggctacgagggcgtgagcgagttcttcacagacctcctgaaccacatcgccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggtgtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtgaaaaaggcttccgggctgtcctctgcccagtgagatggaggacgctagagaaagtgctgagtgtcccgagagaggcccccgagccagtgcatggaggtccttcggcctggctcagctgggctgcaggatgcccactttgaggagggaggcacagggcttgggcgaggggcagaggccatcagaactgcccggcttttttggaaactgaggacccaacaactaaccacgtttacacgacttgagttttgaaccccgattaatgtctgtacgtcacctttcctagttctgaccctgagccctggggaacaggaaagcgtggctggcctcttgcactgctttgtctccaaaataaactactgaaatcaaaccgcatttcacacgtgtttacacatgttgctcaagtttgttatgtcatactcccagtccttaaaagacgtttaataaaacagctttaccttttaaaaataaaatttcaatcccagtctgcctcaggtacgggtgggggtgtgcagcgtgactcctggctgtgttcctgtaccgtttgtggcctccggggtcttgcgcgtccagggcccagataccgagtaactgccatgtggtgtcgtggtggcgtccataggcctccgtggtggggcgggggcggggctgtgggtgtgcagggcagctgcattttccaagagtggagatggaggatggagatttgcttcgtaaaggcctgggagctacatgggaggtagggaggggccagccacacccagggctggggggccggtggactctgcccagtgaagccaggggagtgtcagcaatgaggggcctggacagcgacgcgggacccgcacctgggagcggcagagatggagcccagctcgctaaacgtaccctaagggtgcacgctgaccatctttgatccctggacagtgtccatagagttgtctccccttcggtcacattgtccctggccttggagtttctgcctcagggaaagacccactaaaaccacccgggctctggcggcctcctcttctccagagcatggtggcgctgcctcctgagcagagtcactgagagtgtctgggtccaaggaagggacccacttagcaaaggttgttgtgtggtgctgtgcaggcacggcgcctggagttggccccgccagcatcggggtggcttggggctctggttcctaagcttctgcttctgagttggtcagcacgttggctctgcgccctgcagtgcctgtcttgatggtggtccctggatgtgctgaagggctccaggagcaaggggccagaccacactttggctgagtccttgggtagtttcagagggtcacctgcacagtctgcattgagcaccctggggctgaggccgtgggtcaagttctgcctgacagtgctttgattatatggtgatgtgattctgcaaacataaccccccaactgagtgccagctgctgggtgtccccaccccaagagccaaggggaggccaccctggaactggtgctttgcccttggtgtcatggaggtgtctgggtccacacgtggtgggtgggctgggcctgcagtcacccagcatggccggcgggattggacccagctgcaacctggcaggttccatggggcttcctgtgcctgggcctgcctgtgtctcatgcctgtcaataaaggagaaagcaacctgggaaaaacattcctctctgtacccaggggactgccaagtgtgctttatagaaggctggaagaccgactgaagtaggaagctgtcacatgtttgagccaactgagcaaagcagctgttgcctgccagacagccaccccaagaccaagggagccagcctgtcgtttgtccttctagcctggaagaccagttcttggctcttgggcactcacattggccactggccacaactgctgaatggcttcactaatgtccctggggtctgtatctgccctctcttctattccctagaaactctggccgggcatggcggctcacgcctgtcatcccagcacttagggaggctgaggcaggtggatcacaaggtcaagagatcgacaccatcctggccaacatggtgaaaccccatctctactaaaaatacaaaaattagctggacatggtggtgggcgcctgtagtcccagctacttgggaggctgaggcaggagaattgcttgaactcgggaggcgtaggttgcagtgagccaagatcgcaccactgcactccagcctggcaacagagcaagactcctcaaaaaacaaacaaacaaacaaacaaactctgatcattcacccggtgggatccccggcagctccttctccttcccgagctgtggctcatgggccattggattcagagaccttgagctgggtgctgg

SEQ ID NO: 13040 - DNA, 26159 bp, Human
caaggatcctgggaggtggaagcccagggcctcatcaagacgacagggctggagacagctgaggtgagcctggccccaggctgcctccacctgccggctgtctctccttctcaggaccaggcactaatgcaaaggacactgaacccagcagctgtcagggctgaggaggggccttggctctgggatctgttggacactgaatctctccacagctacagaaacagtgtggacatccccagtctggtcctggtcccacttctccattttgcaaataaggaaactgaggcacagagcggggatggggcttgtccaaagtcacagggacagtcagtgtggaggtcggagagctggagagaggacgaaaaggcaggaagaggccaggccttcagaggacagggtggcatcaggagctgggcggacagtggtagtctgaacctctgctccactcgctgtcatgctgaaggtgaccctgcacagttaagtcccctctcacagcctccctgtcctcatctgtaaaaggcacccccatctacggttgatggatgtggataaatgaggacacatgcaggcggtgtcctgcccaccccagtgcgggtcagtagaaggccagaagcaggggatgggagaaggcaggtgggagggcgtgacagcggcgaggatgaggaaggcagccaggcctgcaggcagccctgagagcatgaagcagaggggtgagcaggttcccctcctcctgccacccttgctcctctctaccaggctctggccttgctggggtgtacccacagaatctgtaggctctggcctagccagaaagagtgtgggtgcttctcagggtcataattaccccatgccccacagggtgtgagtcactggtagcagagtcctccccaatcccccccagaagagtgtggtgaaaggcccgggccactggggtgtcgagagtgccaggcctgacctactgggggtggtgtcagtaggggccatataccctgttctcacgacaaccccaggccaactcagatttgtggagcggccatcccacctccttccggctcttccaccctcacaggagcctggtgggtcgggaaaactgaggcctagagaggcaaaatgatgatacaatgaagagtgagtacatgtggaacaccctctgtgccttacactccactaagctcctcacaccattcacttactcaggcctcaccggccctcgagcacaggctgttttcatgccaccttgcaggagcggggactaaagcacagaaaaggtcaacctgtctcacgtcacacagccaaggagtgccagagcccagatgtgaacctgtgtctgtctgactgcagccctggttccgacgcccttcctcatgcatcctataataacactatagaggttactatagtgtctgctcctacccctgggacaagatcccctaatgagctggcaggtgggcgtggggggcacaggtacagcttggcttctcagctttgctcccctatcctctgctttgccatgaatctctcatccagccccgcagggatctgcctggccagcagtgagcctgagcccctttcatcctgggacctgccgaccacggctcacatcctcctgggtgaagaatgtcaccttgcttcctatctgcctctttcgtggttggctggggagggggaccggggggtggggtgaggttaacctcattgttgtcttatatggtcatttaaatctcccagggcttcctccaagggccaaaaataatccggagacacagcagctgtgtccagcacacagaggacccggccatctgctttggttcagagccctgtgtctgtcagtcagtctctccctggctctccctccatcctcattcctgcctgaagccatgacccgcttctcctatgcagagtacttttccctctttcactcctgctctgcaccctccaggtccactgcacctcctgagagttcgccggcccgggccccaatgggcttgttccaaggggtcatgcagaaatacagcagcagcttgttcaagacctcccagctggcgtaagtgactcctgtctggccccaggaccatccaagttcactccgctaactgggatggcagggagggtgggaagcaggcccacagcccccaggagggcagagggcactatggaggcacctgccaggcacgctccttctaggggtgcccccctggggccccactgctcctgctgagatgggcttggtggccacagacttcagtcctcaaggaacttccagccaggcatgctggtgatccccccctcagatgcccccagcatgggacctgagtgctggaggagccccatggggctctgaaactggggacccagcacgagggaaattggggagatggccttagaaccccagaggcccaggagagcttggagttgaacttgatgagttggctgcacccttctgtttgtcccagtctcactttcccccatgccatcgctgtgggtacatccaaaatgcccacacccacagcctttgttttgtttatttgccctaatttgtgaagtgccaggtgctaaaatccagaaataatctaagctgcaggggctctgtttgcctggcaccagggggcagggctaatgcgctccttagaaaataattctgcctccctcccctctctgtacccctggaatagtgaccccggaagcagccaaaagcaaaagagggaccctatcactggaactgcatttcctcactcagttacgttgtagagaagggaggaggcaattggccaatattttctttctccttcccagcctttttcaaatcctgtcgccctccacttccttggtgtggtgggtgtgtggagtggttgacaatctggaaaagggagacccagagctggtctcagctactgccacctcctgcatgactgcctgagagtcgctgtcccctctgagtctcccttctctgcaggacacggctggagagggcaacgtgacctctagggtcccgtccagcttactactctgatggcctgacacccccagaaccctcccccactcatagggcggggactttgcctgaggtcatggagaagctgtgaatatgtgggctgagggctccagggtccttgcatcacagctggagagacccaagctgggcggcaggtcctgaaagtgttctcacgacactgcaccacgccctgctcgccaaggccacgagaaaagccagccctcctcccttccacttcagctggggtccctttggagacactccaggaaaaggggggcacatacccccactgggcttttcctgatgctgacaggggctgctctggctgttcctaagtggaactcgtcaaggtggcagtgacggtgctgatggggacctcaggacttatctgatcagtttcccatcgtccttgctgggtctgttgcttcaccggcatctgtgctctgacaccattaataaccacagagtctgagagtcaggaggaagtgctgctcacgctggaggaagtggctgggagagtgcaggggctggtggcagagaccgcccagagcccatcctagcccaacatggcgtgggtgtcctgggaatgaggcctgcctccagcctcaccttctccatctgggaaatgggactattgatgcagaagcctccccaaaagtggatctgagaggcatagacatcgtggttctcacggactctccaaggatgaggtagggagctcagtgaatgaatgaaggaaggaaggaagcaatgaatgaacaaagggactttaacaagccaagcaaggaacggcttcactttagccctcaaatctttttgacattcagaagttttaaactgtgaaggcttcaaatttattaatccttccagtatatattttttttctgcagctggatgtactgggagtaggaataagcgacagggcaaggagaggagttggaagaccccagagatatgctcagggttaagagggggcccccgagatgggcgtgcctggtaaatgctagagtgctatactcagggaaagcatttaattatcacaagtgcctcacatgtgggtggttagccaccctctaggaggctggcattgtgtgcctgaatcctcttggtagaattggttttggtataacattcccggcagccatggaaagccacagagatggagggatcccccagtcctcttgcagccactgggctgcagggggctgagtgctcatcctggaaccagcagggacgaggaccgagtgactccactgccagcactcctgagagagaggccccctggcctggccttggcctgaccttgaggactgacccactccttcctctcacaggcctgcggaccccttgataaaggccatcaaggatggcgatgaagaggccttgaagaccatgatcaaggaagggaagaatctcgcagagcccaacaaggagggctggctgccgctgcacgaggccgcatactatggccaggtgggctgcctgaaagtcctgcagcgaggtgagggctgggctctgacggtggcaagaggtgggaaagggactaggggaagggctgccgctcctggggcttcatgttctttgcccacaatcatcttgggagaagggcaggcaaggctgtcactttcatttgtcagttagtcatggagttacgagaggggaaatgagttgtccccaccccctgctgccacctctccaggcctccaaggacaggagagcctaattcctagaaaaggaatgagggagggctgacttttagaagaaccactgccaacttgttccagaatgtcccaggggctgatttggtgtgaaaaatactgcagctgtgcctgtgcccggccaaggctatcccccacctgctgtgggaccgcgggacagccgtgcctcctctctgagccctgtcttcctactgagccaggttcagaagggcaactcctgcaggcaggtgtcacctctgccctgaagcagcacagaccccacacggcccccgacactccaagaaaccatggcatgtaacagtgggtttccagcaatggctggtgtgagttcgagggaaggacaggagtattcgaagagggaggggctccattagggaaggcttctcagaggacgtggcatctgagcttggacgtgtacgaccaggaagctaaaatggccctgtgaaagggccagatgaatgcagtctgtagttggtaaatttcagaggatgtcatacattgttcttgaaattgggaggcaatcgggaaagcctctgtgttgcggggctgagtatcttcctcctacatgaatttcccggtgggccctccctagcgtacccagggaccatcgaccagcgcaccctgcaggaggaaacagccgtttacttggcaacgtgcaggggccacctggactgtctcctgtcactgctccaagcaggggcagagccggacatctccaacaaatcccgagagacaccgctctacaaaggtgaggtccccaccccggagtgagctttcctgcggaagaatccagaagctgggtgagcaacagggaatgttgctcccgttaagtgcataacccccaacgtggccctgctcaaatgcacaatttatgtaactgaatcattcattcctgcatgtattttaccaacattttccaactgcatcccatgggccaggatgctgagggacactgagggcttggagctgaaaagctatagtccaacctgtgcaccctcccagccctgtaggcacccacacacagagagcaggaaagggcttggcaggaggcattgtgggagcatgggggaggggcacccagaggaggggtgcctgagctgaaccacagaggaggaatcacctgctggccaagcagcgggaaccgcacaggcaaaggcatgaaggtatgcgagagcatgtacctctgggacatttgtttaagaaaaacaaggcctcctggcttactcagtacatcatccatggacatttgttggctgccctagcagtacccagagtcaaagtctaaataatcacaatagctagcattgattgagtgtttagtatgtgccaggcaccgttctcttatggacccctcatgtccatctgcacatgaagtaggcactgctggtatcccctttcacatatgaggacctaaggcaccaagacattaaatgggtcgcccaggatcacacagcttgcaaggggtaccccagtggtttaaactcagggaggtggatgtcacactgccctcaactactacattctaaagcatcctgtccatgcctacatgctgaagcaatcagctggggtcttacaaatgatcaggcctttgtacttggaaaaattacagatatccctgatttcccatgtgtctatccagtgcttggaacagcttgggcagcaggaactgagtagtaggtcactggatccgctgcagacccaccatggaagtgtcttccctggaatccgtgcctgccagggcgccatggctatcacctggaacctcagctgtccaaagggagtgcccaggaagctgggcagcccacagccagagcttggccctggtcttgcaagcacacctactatgtgccaagcactatgctcatgccttacacacagtctcactcccatagcatctgctcaagaaggttttattctctccattttacagatgagaaagtcaaggcttagagaggtagaaggcttggcctatggttctatttgaaacagtacacaggcagccctcctccccctgctgccagtctccctgacccattcctcactcctcctcccactgacacggacacagagaagcttccagggctggttaatttggaaaagtgcccaggtgactccaataccacctgcagctcctggtgagaactctggggccagagccaagggcacgtttggggtctagagagagatgaggcttataaaggaggttagagcaggtcaagaaagacttgaggagctgtactcacaacgtgcattttaccctgaactaaattagtagcctttgctggagcagggggaagttcagcaggattatgacaccgctgactcctcatctagaaagattcttccagccttggtaatgtggaggactgaagcaggtaccactggaaggggaaatgatagggacatcctgggacatcccaggggacagagaccttcagcctgactaccagggtttgaattccagttctgccacttagtatctgtgtgactttgggcaagccacttaccctctctgtgcctcaccttccttatctgtgaaaggggataacatcactacatcctttaaggggatttgggaggattaaattagttaatcctgtaaaatgtgcttagaacagagagcctggcacagaaccagtactaggcatatgaatcagcaagtattcttgctaatgttagtatcagtattacttttagtcgcctatcccaggttcaatgcagggattggaacttaatacacatgcagtggaaagctgaatgagtggatgagtgaatggacaggcgaatgaatgcagtctctgctggccagttcctgccaggccctgctgaccatccctgcttccccctgagcacagcctgcgagcgcaagaacgcggaggccgtgaagattctggtgcagcacaacgcagacaccaaccaccgctgcaaccgcggctggaccgctctgcacgagtctgtgtctcgcaatgacctggaggtcatgcagatcctggtgagcggaggagccaaggtggaatccaagaacgcctacggcatcacccccttgttcgtggccgcccagagtggacagttggaggccttgaggttcttagccaagtacggtgagtggctaagggtccctaggtcatggagtccccaaagggcacacgggaaggatgtcagaggtcagctctaagggaaggcgagttaggggtcatcttgtgcgcacactgatggagtgagagtttcctcctagagtgctgtgttgagaaagatgctgaggctgtgtccaggctcagtgggaagagcgtcgggatccactagtgacatctgccattagaacaaatatgggggggtctggcccacggaccacctatttgccatttataatctagtccaacactttcattttacaaacgaggagtctgaggcacagagtgaggaagtgacttatctatagtcctatagcaaattaattgtagaactagctagactcttggtctcctgacaccccaaccgcttctctttccaccacatcacacttcagggccagaaggaacctcaagcaacatttagatcacctcccccttttatgggtgatgaactcaaggaccaggatgggaaagtgatttgtccaaggtcacacagcaaattagtggcagagctgggacttgaacccagctctttgccctctttgcctatgaaatatcttaatgggagaaaataacacaatacggcctgcattatgatggcccagtagcaaaagaccacgagacatggcagacttgcttttggtttcagaacattatatcctgatcttccccaagaatgcctttgatttcttttctctctccacgggaagtaaccctctctctagcaacagagaagccagaggtaatccagacgctgaggctgaactgtaggaatctgttgaggacttgctaagtgtgaacacagatcggggcaatggagctttccccgtagccccatgttgtaggtagtatgctcgtcccattttatagatgaagagactgaggttcagagaggttaactaattggtcacagtccaagcctggatgctgacccactgccatctgactccaaactgcacatgctttgtgctctgccagccaccctaccctgtgagagtcggcagcacgggactctgcccaggtaagcatccatgcactcagcacgcgcctgagcagtggggaacataggtgcaggcccttccgtgcagccaggaacaaatctggactgcccagcgtaagaacaaaggggcacaggcagggtcctgggagcccaggccgggggtcctggtgacggacagcatgctcagcaggcaagggtgacctcaataactccaaacatctgtccaggtctcccaccgacactctgagtcagggtgtgttcactttgtgggctgagtccattttccaacccaaatatttttcttgtgcaagcaggcggctttgctggtagggtccaggctctccagggcacctgcctctgagagcccaacagagggttagggcggctcactggctctccctcaggccggaggcaggacgaaggcctctgcccagctccttccatcctgagcaactggcatttgctgagcagcttccctgtggcaggcactgcgctgagagatgtgcttacactattttgtttactccctgcagtaaccccgaggggtaggtactattatccctggtcaacagatgagaaaaccgaggctcctaaaggctttctgagactgcagagcttgtgagccatgaaacagatgcctcagctgattctcatctgtcgccaaagcctgtgctgtttccgctggatcagaaactggtcacaccatcatcaaaaataataaattaccagaaagcctgagatcggcaacatgcttagagagatgacctgtggttagcagatgcttttgattttagccccactgacatcttcgagcatcttagttccatgtccttccagaacaaggaaggactgctgaattctctttctgcagagaaagctgtgtgcacatcagttctccccctcaccccctgcccgaggagatgaagcaggtgtagaagactgagctgaaggcagattgtcaccaggcctgattcctccttctagcagcatggattaatgttttctgggttttgttttgtttttgttttgggaacagggtctcactttgttgtccaggctggagtgcagtggtgtgatcccggctcactgccgcctatatcaacctcctgggctcaagtaatccttgcacctcagccttccaagtagctggaactacaggcatgtgccaccatgcccggccaggggctactcagtaggtgtagagaacagagtctcattaggttacccaggctagtcttgaattcctgagctcaagtgatctgcccgccttggcctcccaaagtgctgggattacaagtgtgagccattgcacctggcctagtattttcttgggaggagacagaaagtaattctcttattccttgaagtgaaaggcagagaattagcaattagcaagcatgcagggaatacctagcacaaggagcactagtgataagagctagaagttattgatagcagtaaggatcaatattaatagcatggtaacattagcaataataatagcaatattaatagcaaattgcaattaataatgttattggggttttcctttattaggggctctgtgccctcctagacctgtgaggcctctctcagggcagagcccaggccctcttacatggagtgagggttaagagcatggcctctaccatcagaatatccaccatggcctctgccatcagaccatctgggttcaagtttggctccatctttatgaaatgggtggtctgaggcaagtggtctaggtgttctgtgcttcactgtccccatctgtaatctggagataagagcagtactgacctcacaaggtgaccacccactgtggattcagatatagcctgtggaaagcacgatgttcagcacgtagtaggtgctcaggaaaaaccagcatcatcgtggctgcttgtagcctctcagaggcctctgttcgggctggcaggcccctgggtctttttttttttttttttttttttccaggcggagtttcactcttgttgcccaggctggagtgcaatggtgcagtctcggctcactgcaacctccacctcctgggttcaagcgattctcctgcctcagcctcccgagtagctgggattactggcgcccaccaccatgcccagctaatttttgtatttttagtaaagacagggtttcaccatgttggccgggctggtctcgaactcctgacctcaggtgatccgcctgcctcagcctcccaaagtgctgggattacaggcatgagccacgcctggccaggcccctaggtcttgatgttgttgaaagaagctgggggtagccccaggtagactcctccttcctaagggtcgttgttaaaggtcccgtgcattaccgtggttagcacagcaggcccaccacgcggtggcgttacattgaggacagcaacttcccggtcacttggccacttgctgatctcttctccttccccaggtgctgacatcaacacgcaggccagcgacaacgcgtctgccctctacgaggcctgcaagaatgagcatgaggaggtggtggagtttctgctgtcacagggtgccgacgccaacaagaccaacaaggacggcttgctcccgctgcacatcgcctccaagaagggcaactacaggtcagcccaggctccgccagcacccaggcagctctcccgaggcccacactgggagtaggggattggaggggtgggcctgccctgaatgtcccacccacaggattagggaggcccaggagaggtcagaatggacatcacctttcccatggaaaggagggaaaccccttagcagttagcaacatggagtgaatgcctgtaacaacagcaactgaaataataacagcaaacccttatgcagcgcttaccagtacttcacatcagaaacttatttaatctgcttaacagctcactgaggtggatattattatctctgttgtttagatgaggaagctaagacacagagaggttgagtgacttgcccaaggtcacacagctcataggcggcaggtactcacctgctccaaaggtcacagctacaggaattctatcctggggggcagatatgagtctgagctaatgaatatttccgggagtacaggaatgcaaggataacctcccaggcaattagcaagcatgcaaggaaaacctacaataacacaaatagcaccaatgataagaactagcagttattgagcaattactaagtgctagatactctgagtgagaagagagaggcttaagttcccaaggagcaatctggaggaagggaagaagcacagacatgtgaattcatgacatcatgaaagagcatgccgaagagctgcatggctcctgtggagacagacgagccggggctagaggcagaggtgtgctagagccagctcgtgcctgttctcaggaaccgactgcacacctcttcccaactctgtgtttactgacctcacattgatagcttaaaattggccatgggggaatatttacatggggaaataggcaaatgctacaaaccagagtcctttcccccttctctgcccttgcttgagccagtttttaagcattcccagcagcactgctacatggggaagcctgggccgcagaggtgaagctccagctgcccttgaaggatggacagggcttggtcatttccagagtgtgactcatctgcctcccatgtgagcctcacactgtgctgcgggtatgcgggtcaacccggattttcattttacaggacaggaaacgaagactctggtagttaagagatttgccccttgaaagccccgtccccagggctaggacttaaaccccagcatctgaccctttttgctggacagtgcttcccaaactgtccattcacagattttcttcctgattttaaatatctatactctcatcgtttagtaatttttcctttaaataatgtttttacttacaatgaatttattttgaagaggaaacatttatcacactagtatgttatccatttacaatcaattttaaaaacatttcatttaaaatcccatctcatgtaccctgatgacacttggggaaacacacccgaatcttccagacaggcaggagagtgagaagcacagactgcgtgtattggggcatgtttgttgtcttcactaaggcagagggaaatggggtcaaagtgacattccaaagactgaaatgaagactcaaggcttcagagccgccccttaaagctccagccccttctgtgcaggttgcctgcaccaagaccacccaaagatgccctccccactccccacaccccccagtacatacacagaggagacccagccttttctggacagcacagctgtccacaaggctgacagatctgggtgtgaatccctgctgaggccattgggaaagttgcttaaccttgctgagcctcattttcctcatttataaaatgggaaatggttacacccgcctcatggggttgtcggaggaccagtaaaatggatacgtacggatatagaatggaaaaaagcacctagcagagcgcctgcacccagtgtgtgctcaggcgtcctatgctcacccactcttacttagggagagtgcattccatgattgagcggttcagacagcagctcaagccaggcagtgggcatggacaagacggctcctttctcttgagttccacaaatcatcgggcatcagtcagagttgggcaaacacagtttaccttgagcctgaccccagagagatccagagtgaacacacgggaagtgggtgcactttggaaatctcctggcccactgccccccaattctagcctgcacatccatgtccctctgggctatttttaaaatgccatatcagatccggtgaatcagaatctccaggagagaaggagccccactgtctctttgaaaagctccctgagcaaatcagatacagcctgtctatagctgcagggaccattgatctaattcaggccctggttttacagagaaggaagccaaggtcagatatggaagtgatttttgagatagcggcagggctgggaccttcatctgggctgccttcaagtgaacccagaggtgttggcagtctggccccagctggaggagaagctgaaggggcactaggtggccttgcggatgatcagagagtaaggcgcgtcctgcctggaacactgtgtccatggctgatgttcctgtaaactcatctaccttggattcacgtggattcccagggcgaattccctggttattcaacctccacccccgggccccatttccctctgtcccccaaggctcagaggggcctgggccactttttagggctaagcaacaaagggttaaagcctggttcccagcagcttctgccaccaggcagagcccatggccagcaagccccgagctcatcactccctccctgggcatacagcattaaaggccctctgctcggggatttgatgtgacattccataggcattccacactctgccacctgccaacacaccctggccatccgtcccaggcatggaaggcagcaccaggagccgaaggctgtttgccagatggtgtcttctcgtcagcacacttaaccgcaaggggtgacatgcgggtgtgctgagaaaggagccctaaagtcccgatgtcgcagtcacctccaagacacgcattttcctgttgttcatttccagtttagcaaagccaccgtatgaaatcaaagatcaacaccaaagatagacgtattaagaaactgtgtgagttagcgcagagcagatgccccaagaatagcacccaaaacagtagtgtccaaccttggctgcaccagaaaccctgatgcctgggccccacctgacgagatggcgctgccgctggtctgggccgtggctgaggcttcagggtgtctaagagctgcccgggagattttactgtgcagcctgggtagagaatcaggatcttagagcctcttctgtggccaacagaaaacacagacttgcattctgggccttacttctgcctccctcgtttttaaatattccttctcttttagttccaacatataacacttttgctgtattttatcaatctttgcaagccacttgaaattcttcctagaataaggcaaaatagagaacacttaacacattaaattaaaaagcagcttataaagcacactgacaagcaagttaatatccccattagttaaaagagaaactgaggctcagagctcaagacttcatagaaaacaagtcagggtggcacagtgaagctcagaagtgttggcaatggagccgtctgtgggcaactggttcccatgtcaatcctccagccaatgtttttgttgttgtttgtttgtttttgagaccgactctctgtcacccaagctggagtgcagtggcacaatcttggctcgctgcaacctctgcctcctgggttcaagtgattctccttcctcagcctcccaagtagctgggattacaggtgtccaccactgtgcctggctaatttttgtattttagtagagaccgggtttcatcatgttgcccgggctggtctcgaactcctgagctcaagtgatccacccgcctcagcctcccaaagtgctgcgattacaggcgtgagccaccgcgcccggccctccatccaaatttacattgaacactgacaagggtcaaaccacagtgacctggtgatccagaatgcctctgtgtttagggtagcaggggcagtaggctgcagttgtggtggtggtcaagataccaagagcattgttcattcactgccgactacgggccaatcagattcatgggaaagatctcatttatactcagaagcagccttggtgaaagatcattacattgtgctttgtaacctggacctggggttgtaagcagtcctaccttgccggattgttatgagtaaatgagtaaatgagattaagttcttagctctgagggtcatgctaggattaaatgaagtaaacaaatgtgaggaccactttaaatggtacctggcacacagtaagcgctcagcaatattagcacaattatgacttaagaaggtaaggggtaaagtgctcacagcaacccactggagctcaataaagggtagctatagctatcaccatcatcatcatcatcatcatcatcactattattacaattaattacccctctgctttaggtgcggttcagagaggttaagtgacatgcttgcgctggcccagtgctgaagggtagagctggtgtgtaacccatgtacccctgactctgagcctcccagtttccccactgcccatgctgggcccctctctagctaaggacagcttgcgttggctcaaagctctctgcccattcccctgctgttgggctagattcaggaaggacatcagagccagggccaggtggtatggcaaggctgctgctctgaggaaactagaatcctggagtgggagcccagacctggggcaaggatgtcaggcttcagatactggtgggtcctaggaacaagacaagagcccagtgattcggaatgaggtccaaggtcagagacagctcagcacctgccacactgctgcactgggtcttcctggaatgaccctgagctggatctgctccggtctcagggcccagacaggaaaggctaagctggtagttgtggcctctgcattggggaggggacaaggaaggggtagggggccattcttccagacacctacggctctatcagacaatagtcacctttgttcctcttcatgaggtgccgcttgagcaattatactctgagaatccaaaacgtgcctgtgggagaagtgggaagagtcagactgtttggtggggtcacccccttgtcctcctgtcctctgccccacaaaatgggctgggaagaggagtgatgatgtgcagtggggctaccaacgtggccgctcccatagttgggaggagaggggcatcgtagaaggcttggccctggacatccagagacctgtattttgctcttgtgcaccacccaccttctgtccaacctcactctgttccccaccccaagcctgggcttcaggtttactctgtgtaaaatgggaaagctggacgcactgatctccagagcctgtccggcgttacacattcactttctgattggcagagtcctgccgcagtaagatgattcaccacataactgagacaatgctcaagttcccacatttctgccactttcccttggttcgtggagaactgccggagaccagctgtgacctgccagagataccagccccatctgtccagcggccccggggcagcccctctcactgttctttcccgttcttgggcacgttacagctgttagcagagcatttgttggccgtggccgccatccagggtgaggcccaggcctgcctttgaccagcacctctgcagagcaaagtcaggcctcctgtgcctacacaaatagaaattaggaggcaattagccccccgggtgtgtgaatttccttttgaggttttagagtcagattttagccaaacacagcatcactaacaatcataatactttccactgagatcccagcaggaggtcgctggcatcagatttccaggaagcctgtgtgccaggaggccagaggcgtgggaatgggcctggtggcacctgcttctctccccttcccccaccgccccaccccctgtaatggccacctccttggagtcccacaggaggctgtgaggtcacctgtcagcagggattggatggattagggtctggaatcatattggtgcaggagcttgttcttgcaggtggcagggctgtaggagaagagagccaagagaaggggtaaagagtcctggggttgagcccccagaattgtcttatgacccctgattagtcacttcggctctctgagccacatctgttaaaaagaaggccacaggcctgctccggccactcccacccagggctgaagtgaaggtaaaatgggcaggcaagttaacacattatgaagactgcaaaaccccgggatatattaactgtcaccctgactgctacacaagaggtaggggcattgttaagagtgtagctttggggtcagactgcctgggttcaaatcctggctccatcacttactggctgtgtatccttggaggagtcacataccttctctgggcttatgtctcctcatctctgaaatgaggatattacagtactcacttcagagggctactgggaggatttcacagatgaatagaggtaaagtgctgagatcagtgctcgtgttttagggaagagaggaactggtggttgcagggagctcaggcttccgcagtggctgaccaagttctccacacccagaaggtgaggcagagagactgggagaagctagcgtcagccttcggggaggaggcgttgagactgacaggagaggagtgtaagtgacctcatggtcacaatgggctggttggggcctggggcagtagtagttggggccaaattagttggggccaaacacatttgtccccttttgtcctcaggatctcgtggctccactggggtcccaggacagcaagatagggacagctcagccctggagtcagaggagggcacacaccctggttcccctattctgactgtatgactgggcaagccccttaatctctcagagtcttgactcttctcatctgcaaaatgggaatgatgagccttgctttaggggttattgtaaagattaaacccaatcgcacttgtaaagcctttaggagcctcctggcacacggtgggctctgggatctggctgtccctgtccgtcctcccccagagagagcagggtctggctccaaacttcgccactaggctctactgcctcctgcagggaggaggttggacattcattgggtttgggggccttccaggcaattcctccaaataactgagctggcaatgggcaacagcgcttagcctgaaataaattagtgggagcttcttgaaaccctagtgcagtctggctgaggtttttaagaactcagacttcggaggccaagggttctgggtctgaagcccagctctgccccttactggctatgtgactttgggagggtggctgaagctctctgagcttcagtttccttatctgtaaagcggagacggcagccgacccaccctgcccagtggggtgagaatggttgacccgcggcgccccctgccggtgggatccgcgtcgcagcccgcggtcagggcgaccagccgagcctggcgcccgagctctcctgctggcggggccggccctacccgtccacaccccgaccctcccctcacccgcgcccgcccctcgacccggcaggatcgtgcagatgctgctgccggtgaccagccgcacgcgcatacgccgtagcggcgtcagtccgctgcacctggcggccgagcgcaaccacgacgaggtgctggaggcgctgctgagcgcgcgcttcgacgtgaacacgccgctggcccccgagcgcgcgcgcctctacgaagaccggcgcagctccgcgctgtacttcgcggtggtcaacaacaacgtgtacgccaccgagctgctgctgcaacacggcgccgaccccaaccgcgacgtcatcagccccttgctcgtggccatccgccacggctgcctgcgcacaatgcagctgctgctggaccacggcgcgaacatcgacgcctatatcgccacgcaccccaccgccttccccgccaccatcatgttcgccatgaagtgcctgtcgctgctcaagttcctcatggacctgggctgcgacggcgagccctgcttctcatgcctctacggcaacggcccgcacccgccggccccgcagccctccagcaggttcaacgacgcgcccgcggccgacaaggagcccagcgtggtgcaggtgggcagcgcacgctggcggtggggagcacgccttttgggtgtggcccagggacgcgcgcgcgcatgggaggcgggcggggccgggtggttcgcgctccttgggagcagcgtggactagtgattaacacccttcgggggaagtggggccagctttggaggcagcagagcacggtggttaacctgcgtcctgggtagcgtgggttagcgcttagggcgctttggagggagctttggagggaactaggggttagctcactttggaggcagcggaaccggtggttagcacacttaagaggccgcagaacttagtggtgcattggaacggtgaaatccttcttgtggtccactgcgttggggaatttaaggaaccaatgatggagcggagaactctgccaaactaagaggctcgtcacctccagcaaacctacacctggaatgcgatgtgaaacaagcacgatccggaaaggcatgtcaagagcaggctggtgtagggtcaggtcagaagcagaaagccagcgacccagaggcaggacacgtccatgttgttactttaaaagtcagaacttggccgggcgcggtggctcacgcctgtaatcccaacactttgggaggccgaggccggcggatcacgaggtcaggagatcgagaccatcctggctaacacggtgaaaccccgtcttaactaaaaatacaaaaaaattagccaagtgtggtggccggcgcctgtagtcccaggtgctcgggaggctaaggcaggagaatgacgtgcacccaggaggcagagcttgcagtgagccgagatcgcgccactgcactccagcctgggcacagagcgagactctgtctcaaaaaaaaaaaaaaaaaaaaaaaaagtcagaacttaaaaggaagttagacacactcctctcctggagctcattgttttaatggttaatggcgatcattcatgggctgcctactgtgtgcaaagtttatgttcatattacctaattctcatgttaaatccccttggagttggtttcatatacctattttatagatagggaaattgaggctcagaggtgatgtgacttgctcaagttgcccgtcttccactttgggcagcagaagcctgtgttgaggggacatggttcaggggatcctagcctgggtgtgcacagtgtctgtgcttggacacatccgctgccgtccctggccgcaggctcttgcaggtgggatgaactcacttcttggtcccggcatgttctctttcagttctgtgagttcgtatctgccccagaggtgagccgctgggcggggcccatcatcgatgtcctcctggactacgtgggcaacgtgcagctctgctcgcggctgaaggaacacatcgacagctttgaggactgggccgtcatcaaggagaaggcaggtagggacttgctgctgctgccaaggctggcagatctccctgcctgactcagagtcccaggcctcagggagtgcgactgttcctaaccctgtgagcacctgctgcttgccaggctctgtaactccttggatgaaacatgaggaatctgcctctcagagagctgtgccacctgggccaaagtcacagttagttagtggcagagctgggattaaaacccaggtttgaccaaccccagagtctctccgctacatctttccatgatgttttaaacagctacagctccctgaggggtaccgggaccttcagggtaggttgtgaatgatttggggccaccaagaggcattgtaggaggggagaggggaggatggtggtctaggatgtctcaaactaaagtgcacatgaagcacctgagtgtcctgttaaaaatgcagcttctgattccgcaggtctggggcggggccggggagtctgcatttcaacaggctcccaggtgacaccaaggctgttggtgcacagaacaccctggtgtgggagacaggcccctgaaccctggagccagccttgccagggccttgctgggtgaggcctctccccacctgaacagaggggcctgggcaggctcgttgtccagctcctttcagctggacccgcctgaactgtgccaggcacagtgaagtggagttcggccactgtccctctgatgtgtgcagagtagatggggctgcctggctaagtcaggctgaggaagccagaatccctcttaggcatttttggagctcacctgggcaaacaggatgccacaggtgacagaaatgggtatctgtgcagtggcattctagctaccctagggctttctctggctctgagggcacagtcctgccctggccaagtgtttacaaggaggctgacctgcagcaggtcattgtcattccaccactactgctcctgtccccaggtgggactgtgcagcctcggggggcccacccctgtgccccaactctgactcaccacattcctccttgatccccacacccctgtgaacccaaatgtgctgtaggatttttcattggcacaggtgcctggaagccacttgaattgaagcctttgataaagtttctggggcagtgatggaggagggaggcgtcagcttgcccattcactcagggcttaactctagacgcatgataaaccttcagggaactaatgaataattagttgctgtcaccacgatccttggccactagagggtggagcagtctatgcctaggtatcagtcctacccattctgtcaccttctcctgccttccttagagaagggtggtcccccacaactaaaccatgccccagggaaatccctgcagagaccttagtgtggagtacgcatttgttagccagtaaaaccaatcgttcttaaccaatatctatttgggttactttaaagcccactttccacctgcaagacagtccccacgagcttgtttgtttaatgctacaacattgacatccttattctgggaaggaactacccagagcccatggattggccagcccagccctcatggttccgtgtcctctgctcaccagcagcctgtgctgagtttcccagaggggaggttatgttctaagcttgttacctaagggtttccccatctattttctggactattaaaaaagtgtcctaactggcctcaatgcctgtaattaattattccaattcagccattaaatgaatatatattcaagaccttctgtgtacaaggtaaccacattattttttatccagaccacagcatttaggagatagtaataggaactaaccaggcaagctgcccgggcaacaggaatgatgcttccctgctctttggcgtactatgtggtagaaaaatctgagctcagaaggcagtgaactcagagggcagtggaagtgtcagaaacacagtgatgggtgtgtgaatgcttcgctaggcaacgctgcagccgcctggccctccgcccttgctccacatcccacctgcccctccagccccaggcttgcatgacttccttgccttgccacttgctgttttccctgcttagaatgcccctgtcccccttccgtacctggaaattcctgcccctcccccaggacctcactcagagggcaccgtctcttgtggaagcctccactagagcctctgggcaggcacctctgcatatctggcccaagcacagagctaggtgcaacagaggggctcagcattcgcctggtgaatgaatgaatgaatgaatgaatgaatgacattctgtgattctacaagccctttaattactccgttactggatgcgttcatccctgctcttacctctacccactccccagctcagaaaactccactacgtggctcctgggggaggcagccaggtgggattctggggctcgaggcgagctgtcagtctctgcccccttatcctggcctctcagcaccactgggagctccaagttgaattccacatgtaggggcacttaagtggtcaaaccctctgaccccattgctaaggctgtgtttgggggcccaggctgtgtgtgaagaggaagaggctcaagaggagggagacaccaccactagtcccaggagggatcctgggcaaggctcagaaccttgctaagcctcggtttccgcacctgtgaaatgggtgtgctaaccacgctgtgcactgcgtgggctgtgcagatcaatgaggggtgaacaatgggaaggtggcttgctggatctctttagttggcagggactggggtgaccagcagcaggcactccctctcttacccagccacatcagctgggcacctcccataggctggggtcacagatgcaatccctttgcttattgcaaatgacaaatcagcctctgtctttccctccttttttcagaacctccaagacctctggctcacctttgccgactgcgggttcgaaaggccattgggaaataccgtataaaactcctagacaccttgccgctcccaggcaggctgattagatacctgaaatacgagaacacccagtaactggggccacggggagagaggagtagcccctcagactcttcttactaagtctcaggacgtcggtgttcccaactccaaggggacctggtgacagacgaggctgcaggctgcctccctctcagcctggacagctaccaggatctcactgggtctcagggcccagagctttggccagagcagagaacagaatgtgtcaaggagaagaatcatttgtttacaaactgatgagcagatcccagaccttctctaccttcaggaatggcagaaacctctattcctggggccagggcagagcttgaggtgttctggggaaggtggtgctcagagccttccctgtgcccctccacttgttctggaaaactcaccacttgacttcagagctttctctccaaagactaagatgaagacgtggcccaaggtagggggtagggggagcctgggtcttggagggctttgttaagtattaatataataaatgttacacatgtgacacctgcccagtgaagtccctctcatcagactccctgaagcctgaggtcctcagccttgctcctggcagtagcgggagcggggcagatgtggggacggggcacaaggacccctgaacgtgtcacctttgggctcctgaaagacccaagaggctgtgtccttcactccccaggcaagaccggatgatggcccaatgggttttcctctcctggttcaatcaccatggaaacaggcactccatcacagtctcagggcccacatgtctcccgacacctggggttgtcttatacatgtttcctggcactctgttttcacacgctgctcacccctgttttgctggttgttgagaaactaggaaaaaaaaattaaatactggccactgtgagcaatggtgctagagtgatggccatggtcagcccttgcaaaggcaccaagcctgagagtgcacagagctctggcccctgcgtgcctccctctgtcttcatgtggccctgtggattgagtagagcaggaattgtcatcctgttttcaggtggtgcagggcagagttaaggctcgccaccacgtggcactctggggggtctctccaggccccgagggctgagaggtagaatgccctatttccatggaagctgcggtaactcatcaccactccctttacaagtgtgaatgaagccgctgagtccaggctactctgcagcaacaccggagcaggccacctggccgagagtctgtactaggccagccccaggatctagtagtgtcttaaacaaggtcaaaggtagtttctggcctttggaaagtaagcagctagattggtggaggggagcactggttccaggctcagctctgccattggcttacatctctggggcctcagtttcctcatctgtatagtgagacatgatggcccctggtggccttgccggctctgacacgctgggtttcttttttttttttcgaggcagagtctcactttgctacccaggctgacatacactggcatgatcttggctcattgcaacctccgcctcctgggctcaggtgatcctcccacctcagcctcccaagtagctgggactataggggcatgacactgtgcccggctaaagacacactgggcttctatggaatcagtaactcccagagaaaaagtcttccaagcagcactttatggccacaggtcaaagggggctcaaccaggtcttgcccaccccttcgtggtacaaatgagaaactggcccagagaggggaagggacttgcctgggcacacacagcaagtccctggggttccagctcaacagtgctgggccacagtcccatgcggccttgctgtataccaggcagaacctgcggggatcctaagaaagccccaaaggaaacctgcactctcccccactgggggatgcccaacactgagagcccagagggtaaattgccaaggagggttcagctcccaggggagctgactctgaaaccccacatgactctgatggaagaacgcctttgct

SEQ ID NO: 13041 - DNA, 26076 bp, Human
tttgtcagtttattttcttcctcataatgaacgctgttttcctgtttctttgtagctttgttattgtttttatcgcacatttgaaaaacagccacatttcataatctatatatattctgtgtcatgacaatgatcagctaatatgcttggcatattcttaagtctcgacatcagccctacatgaaaacttaaggtcttctcagttcttttctgaacgtgcatctgcctagactctgtgtgccctatttgatttctccaaatacccaatggttttgaataccttatcatgtcaaaaattcacagctcagcttctcctaagtgccatagatggcctattgtatgtctcttccccctaatctcttgccagtggcatctgtgcatctatagtcaccctgcatctctactgagccactctataaataaatgagtttattttagttcatttcagattgttttttgataattccatgggagatttgagagctttctaatctaccatcctgctgatgacactctgtgtgaaaatttttaaatggctctattatattccattgcttcaatgtatagtaatttacctaattattttcttttattgttccttttaggaagaagtgaatagaagaaaagagggtgttgcaaatcaaaagcacatagagatatcatcttacaccagtcagaatggctattcttaaaatgtcagacaacaacagatattggtatggattcttcacagatgttaatcatcttcgttttttgttttttgtttttttttttttttttgagacagtcttgctctgtcgcccaggctggagtgcagtgacccaatcttggctcactgcaacctctgcctcctgagtttaagcaattgtcttgcctcagcctcctgagtaactgggattacaggtatccactaccactccagactaatttttgtatttttcgtagagacaagatttcacttgattggtctcaaactcctgacctcaagtaaacctaccgccttggccttccaaagtgctggggttacaggcgtgagccactgcccccggcctaatcatcgtgttctagtctgccctccaatgggagaaacaagtaaaattatgccatgtgaggattattcaccaatttattttaattacttttttctttataacatttaataagatcacaaattatataaaatagttatcagctttttgggaagttacttttgctggtttcttataaaactgatggaagatacaaacactattaaagaactgtttgcatgttgcaaatgatgtccaaagtccaaacattgttaataattaatactccaataaacatcatgtcagaatttctgttttcttttccctttgaacctttgcaggattaccacatcatcaggaccacaccttcatcaggaatgaatattcctactacaattaaagaagaaacaaaattaatttgttggtgaaaaacgtaaaaagagaaattttctttggttttgtttaatttctttattgagggtcaccactaaaaaaaatgctcactggtcattcttttgaatactgtctgagagaaagatgtaagatggttgattatttcaaatgacagaagataaagatgggatatcatcatggcatgaacaaaaacaagatttgtagctggaggtattttatagtctaacatgatcaccaatcattctataaacctgttggatgagtttatcagacagacagagagagagattgattgattctgaatagaaaatttcactttagaaaaaaatattttgactatataataatgtatgtaaaaattctctttgataagaaacgagtgaactggattcaattttcctcacagcctgtgtaatacaccatcacttgcttcctcctacatgccattgattagccccagggagcagtgcagcactgcctgcccatgttttacataacccctgaatataaatgccagatgttgctgaaggaaacaggatctgcttagtgaaagaagtggcaagcaatggatcccaaatatcagcgtgtagagctaaatgatggtcacttcatgcccgtattgggatttggcacctatgcacctccagaggtaataatcacattttcagcattgagcatttaaaagagcaaagctagaataagtgaacgatgacctgggttgttcagctttgtgtttctgttaccctgagtgactcacgtggtctgtcttactgggctagagctattctatgttcaaagagaaaaggtagtcaatgtttgttttgcactgaggtctgtcatatggtaatttactgcttatttttattttatacactgtttttatatgctgtttctgtgtattgcccagcttggcagaatatataaaactcaacagtgaagaacactgcctggcagttccctttctaggagatgactgcagtgagaatggtttctccatttatttctgtggttgaagaaatcttttattcttctactagacgtgatcaaaagaaacatttgtggtaacagcacctaaagatggggtgtatgaaaactgttgggagagtactgctgagctgccgcgtggtcttgagcatgacacagtaatactggtcctggacttaatacaatgccctgcacaactctcacctctaggaaaattatctgaaaggaaaaataactttattctaaggaaaacctagaacctcacaagaaaaattttaaatttttggtccgtgttaatatgcatcagatttgtatcaaaatgataggggtggccctctgacacggaagtgggcaaaatggagacattttttctagactgagctatttctacactggaagaaaacttgtattccaagactactaagtgtgttaataaggagtagtcacataaaatttttgtctaaatttgatcaactatacgttgtaagaatttacagagaaacaccttgaagaccatcgacaggagtggttcactttgtaatgcaaattggcatgaaggagaagtaaggaaaagcacaacacggaagctctagccttggtaaaccttgagtgcctgcacagcaaacagaggatcagggttggcatcaggggaaggtagtgcaacctggcatctagttccttttaatttcactagaaaaagaaagcttcagaaaagcttatattaaaatagaaaattgtttcatttacggttttgtcatttaaaaaatatacctttcaaatctttatccaaatttggtagataagtcaataattttaaatttcactgaaattatatcgtttctaaaagagttggtcttattttttagggataaagcgtaccttactaatctctcacaggtcgcagttaatttcttaggtataaatctacatccttggaatgtatgtctttactcctagtatttagttctgtcatgcacacagaatggctaatggctgtgtagaaaggagttaacacaatagactgccacccgtagatgcgcctgttttcaaagttggagcctggctggtatctgagaagttgaatttctcaccccttcctaactgataagggtagcatctataattaactggttgtacaaagtgtggggtttctgtatacctgctttctttacaagaccggaagtttggtgtgtgctatacagactgggtcaatttaaccagcacccagttaaaatcttgggaattgagtctccaaatagcatcccttgtagtcaacatttcccctatgttgccaaaatgtgatgctggaggaagtcagtgtgtttcctgaaacatcactgagagacgaatcataggaacttacaccgtattcttaccataatttcttccatgtgcctttttccatgtgttaatttcactatattaaaaataattaggagtgtgtatgcagtgactcatgcctgtaatcccagcactttggtaggccaaggcaggtggatcccttgagctccggagtttgagcctgggtaacataggaaatcccatctctaccaaaaatacaaaaacttaaccaggcattatcatgcctgtctgtggtcctagctatttgggaggccaaggtgggaggatcacttgagcccaaggtaaagaaggtgggggtgggggcagattttgtagtgagccaagattgtcccacttcacaccagcctgggtgacagagtgagactctgtctcaaataataataactatttataagttgagtcttgttaatttttctaacaaatgactgaatctgaggttgttgttgggaaactccatgctagtgattaaccagtaactgcctgggactgaagaggtccagggatacccaatctttattactaaccaggaaagacttcagcaaattgggatgggtttatcaccccacatatagaaccaacccaagacacgaggataatgtgatttttgtgaaggtcagtgctggtgcctgaactactgatagggatgtgctgggaagggaagagcgtggtccctttaaatgatacagaaagcgggaagggaagtgctggctagaggaggacgtggtccctggctacggctccaccgcctcggacctaggtgaggacaggcatttttgttttcctgcccaaaagttgcatttcccaagaccaccctggcctgccatgcccccatcctgtgcctataaaaaccccaaatcctaacaaggcagagacagaaccgggtggactttgagaggatcacatcggcagaggaatacacaggtggctagacatctagagaaatgcaccgaaaggcaccagtacgccagcgggccacctactggcagaagcagaatgacgctgagtttggctggggcagtcagaagacagtccaggctgctgagcagccggactctaggggaaaacgttcctactccatccccttctgacttccccccaagctacctccactcaatgaaaccctgcactcattcaccaagcccaggtgtgatccgatccttccggtaaaccaaagcaagaactcaggatacagaaagccctctgtccttgccataaggtagagggtctaattgagctggttaacacaagcctgtagatggcaaaacttaaagaacaaaactaaaagagcaccctgtaacacatgcccactggggcttcaggagctgtaaacatccacacctagacactgtcaacgggtcatagtcccacaacctgcccccatctgtatgctcccctagaggtctgagcagcgggggcctgaagaagcgagccacacccccactgcacaccctgtgaggacaagggaacttttcctgtttcactacctctcaagcacattgatcaccaaatactacctttcgttgctccttcaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaaggtactgtgcctatgatgagcatgtatgcacatgtatttaatgggattgtgtggagatgacaattctgtaactggttcagtagttgtgggtgaattgtgcttattagttccaatttattcacacatattcaggtattaaagctaaaataaaaggcagagaatgatgatgcctttctcatcattgttgtgttcaaatttactacttgaaagttactttaggttttgagcctcagctcagatcagtataattattttatgaattcatattttaatttcaacaggttttggggtacaagtggattttggttacatgaatcaattctacactggtgattctgagatttaagtgaagctgtcaggcgatcactggacatcgtactcactatgtaggcttttatccctcacctcactcccaacctaacccacactgagtcttgaaagttcattatataatctgtatgtctatacatcctcgtagcttagttcccacttataagtgagaatgtacagtgtttggttttccattcctgaattactttacttagaataatggcctcaagctccaagttcctgcaaaatatattatttcattcctttttatatatacactattccatgatgtatatatatatataccacattttcattattcatgcattggttgatgggcacttggattggtttcatatttctacaattgtgaatcatactgctgtaaacatgtgtgggtatgtgttttttatatataatgacttcttttctttttggtagataccagtattaggattgctgaatcaaatggtagatctactttaagttctttaaggaatctccatactgttttccataaagattacactcatttacattcctaccagccgtgtaaaagtgttctctttttactacattcatgccaacttctactgtcttttcagctttttaattataaccattcttgcagaaggtgatatctcattgtgattttaatttgtacttccctgattattagttatgttgagcattttttcatatgttcgttggctgtttgtatacttcttttgagaaatgtctattcatgttatttgcccacttttcaacagggttatttgtttttatcttggtgacttgagttccttgtagattctggataatcagtcctttgctggatgcatagtttgcaaaaactttcttccattctgtaggttgtctgtttactcgcatgattatttcttttgctgtgcagaatctttttagtttaattaggtcccatttatttttgctttttgtgcatttgcattttggggtcttagagacaaattcttggctgaggccaatgtacaggccaatgttaagaagagttttccaatgttatcttctaaaatttttatggtttcaggtcttagacttaagtctttgatccatcttgtgttggtttttgtataaggtgagagatggcttccagttttattcttatacatgtggcttaacagttgtcccagcaccatttattgaatagggttattttccctaatttatattattgtttgctttgttgaacaaagattagtatttgccctaatttctgtgttctctattctgtttcattgatctaagtgcctattttttataccagtaccatgctgtttgtataactatagtcatgtagtataatttgaagtctggtaatgaaatacctccagatttcttctttttgcttagtattgccttggctattgaggcccttttgtggttccatatgaattgggaatatggccatttttatactattgattctttctatccataagcatgggatgtgtttccatttgtttatgtatcatttctttttagtagtgttttgtatttttttgtagagatctttcatctctttggttaagcatattcttagggattttatttgcagctgttgtaaatggaattcttaatttgactctcaacatggttgttgttggtgaatagcagtgctactaatttctgtaaacggattttgtaacctgagactttactgaatttgtttgtcggaggagctttttggatgaggctttggggttttgtaggtatatgatcatattactggcaaacagcaatactttggcttatccttttccaatttggattccctttattttttttaccttgcctgattactctggctaggacttccagtactatgtttaatagaagtggtaaaaattgggcatccttgtcttattccagttttcaggggaatgctttcaatttttctccattcagtatgatgttggctatggatttgttatatatgcattttatgcctagtttgttgagggtttttatcataaatggatgttggattttattaattgcttttttgcatctattgaaatgatcctatggttttggtttttaattctctttgtgtggtatatcatatttattggcttgtatatattatagcatccctgcacctatgggatgaaacccacttgatcatgatatatttttgatgtgctgatggatttggttagctagtattttcttgaggatttttacatctgtattcatcagggagattggtctatagttttcttttgtgtgtgtgtgtgtgtgtgtgtgtgtgtgtgtgtgtgtgttatgtcctttcctggtattggtatttggtgatactggcttcatagaataatttaggcaggattccctctttctctgtatttttgaatagtttcagtaggattggtaccagttcttctttgaacatctcctgtggagatagcaactttggctttcaagctattcccctccccatccaccttcaaggccaggtgccagccttctgcatttgtctgcagcacacttcctgctttcccccggggttctggccaagggggctcattcccacttgagataatattaatatcatgaaattcagttaggagcttctttcgatctgtgacatgtggctgaactccccaagttcaagttggctgactttgctgatgtcccctgtgagataaaataagaaatggcttccctcagtccatgctggagactggtaatacctttgtgacacttgtcactgccgcttctactttatttctcacctctccctaaatcagctttgggcctgggtagggttaaggccttacccatggcctgaattctcagattccctggtggggaagagtattctggaggcagtttctccccttctcacactctgggcacttacagtttttcatctgtctcacagtgttggctgtagcctgccacttctttcaaagggtctgtgaattttcacttttcctattaagttcctgcattgcttcttggaaaaaagtttgcagtgtgaatctctatatgctattctgtctttccaagtgggagaggcatgctaacactgcctccaatccacaatcttgggaacaaaaaactcagaccaggatggtttaacatagactacagattcagagagacctataatcaatattttagtttttcttatgtctgggatgactttcttcaatatcttattctgaatctcaattgtccttttcagtgaagagtgtgggaggcagggagatgcaacataaggatgttatgagtatgaaacaacagataacagaagtatcttgaatgattgctcaacacatgtcagcacgtaaaaactttttgctcttcagtttctaaacaggaatgcttattcttgcccatcgggttcaatggatgagaaaaattagactattcaaatgctttataatttctctcaaacacagttcagatcatcagaattacttgatatcaatttttacctactgaaaattttaattccattgttcagcagttgtactaactatatatgcaatatgtagctttcatataggtaggtcatatcaaaataaaacaaagggaatttttgccagaggtcatctgtttggaacggtgaaaaatgtctaaatattaggtgaagcaaactaataaaactagctcatgtttttattcaacataaatcctttattttaccatgcagctttggtgcactttctttcaaccacagatggtccaaccagccttggaaagctcactgaaaaaacttcaactggactatgttgacctctatcttcttcatttcccaatggctctcaaggtagggaatttgtgagatcaacttctcttctgttctcagcatgaccatcctttatgatggttgaattgaacttcttctaaggagggtgtaggtgttattacatggcagaagagtcctaagtataatgcctaagccattttcttgaagagtacaaccttccttctgtaacgtatgatgacaagagaagacagtacatcaacctcaaagcctctgcttcaaaaattcaagaaaataacaacagccaccttcaaggctctgtcttaattagggttcctgagtccatctcttaggatcttcacagatacagagatccatgcagctgtggtaccccaaaaaaactgctgcacatgtggtgtacagtgagtttccattatctttccccattttaagctgaagtagatttggtggaactcactctgggtgagttttaaaaaggaaaccataataggacctgagaatccttgcctttttcactaaggcttgtttcacaatggagtttgtagctttgcctagtcatgaatttcggttgtgcataacttttaaatttatagaaaaaaaactcaggctagtttatttaaaaaagagtttattgcatgatgcaaatgggtagtcactgccatgaatacatttcaagatttgacgtagactctaaaaatgtgacctttctccataattatctatgaactccaagaagttttctggatttttgtcccagcctttttgattgttggcaatgatagctttgaggcagctcaatgctcatggtgattaacataaaagaacctccgtgggtcttacaactttcaaattaatactgaaaagaacttccatttgaacatgtttagcttatgatcctgctcatggactatcaagtcttcagggggataaggaactcttattgtatcacctggatcaagaatacaatcccttattgctggatatcaagggctgtttgagtcaaagagaggcatttcccccaaaaaaattataggatcagacaaaagtaacagaagtcgactgtgaacccccattaaaacctgtaaaatggttattaatatatataatggaagtagaagattaaaggaagcctgtctcctaaagacattccttaaaactctgtacgtgaaacacttggcccacatcactttctagaacatttcagcacctacctcacggtggattattatcctaaaatgtacatgggagcatgcctatgggtggaaaagttaaatggtgacactaaagtgactgcttctacttcagccaggtgagacgccactaccaaaagatgaaaatggaaaagtaatattcgacacagtggatctctctgccacatgggaggtgagtgcttggaggacagagtacagaaaaggaagacaagaagaggtaaacctgttccccagctttcatatgcaacattggaatatgcaccattggaactagaaattaaggagcttgacaaaggaagttttgctgagtggtagggaagaatacatgactgaaatagaatagcaggaaatgaaggagataaactggggacaaggaagacagatattcctcccgctccatggacatttatctctccagcttcctaaagaggatacacaaattcttcttgctgtcactatccttttgttatctgttgtaattttttctcttgagaatcactgctattttcattgtcatatcttaacagttgttgctttaacagttctgtcttgcatttatcataatctgcagccaactgcacaaataattcctcacaacccctttctccccaggtcatggagaagtgtaaggatgcaggattggccaagtccatcggggtgtcaaacttcaactgcaggcagctggagatgatcctcaacaagccaggactcaagtacaagcctgtctgcaaccaggtgagcaccctcagcctcctctcctttctcttctcaatgtccatcttcctgtcctactgcctggcttccatttgttttgttccacttacatttgtgaaacagaagattctagaaagcaaaacatctgtctagaagaaaacggaagacccttaattgcacctcttcttggagaagtcttaatgaaaatggtacagagaccttcatgctaaattgtgtgtactattttggggggaggtgaatttcatcaaggaggactgaaatggttaatcagaactcagggagaaggtggacttatctctaaggtatgaaagaccaccagagagtggattggtaaagatgatttggagtagaatgtatataattatagaggccataaaaacatgggatgagcaataaatcaggagacagtgagaataagagaagatcggtactacgggtttaaatagggtttagatgtctgaatgctttttgtcatctctgttttcatagttcttgagcaggtactaaaaattaactggaaacaatgaaagtcatccaggttagggagaggaagttacccgtttatgagagttgcttgagagataagctgaaaggatgtggcgtgctacccccacccctgcctcgtgtagaaaagcctgccaatgttgcctcatttagacccagactccaaaacgggagtcttatagctgggccacctaggaagagaggttctaaagcataaaaaagaaagcatttcattttgggacacttatttgcagctggaaatgggggaatgggctaactggctaaactactatcttgtccatcctgccttcacttcagtccttccacattgttatttggtgtttggactgtgctagaagaactgttttatacaggctgctattcaataaatttgtaaataccatacccacaccaaaggatttaacactgaaaagattaaggtaattttggaaaattctaaaagtcacttttcactcctgagatgtaggtggtcagaagaaatgaggaacactgtagaagccatatgcaagatgcacagatggcattgtgtttgttgtggactgttgatgttaacaggatggaagaagtcaaaactgaactttataaaatagggtataagaaaataaagatgtccctgtacttacaggtgctaagaaactagacttgaagaacttgtctctctcagaaattgagaaattgttagcaatggttgaactaagctcatcaactccttggcatttgcagcctacctgtgcaatcataggacatgaaataaaggaaggacttgagaaactccatgatgtgataatgaagagaaaaatattgcagtaatataaaaagatgaatatgataccttttctatatatgtagaatagattttctctggtctgattttgacaaatacaagactgtctacagcctagttttcctgtatgccctcctgggtgctatcaaagcttcatttcattgaacaatcagatgcccaactctgtggctttgtggaagatgagtaaatgcagtaatgcttgaaatggtctcttctccctagcccacaaatattttggtactatcattttgggaagtcaagcaagtatagtaaattaaccagaacacaattgtggaaatttgatgcaaagttagtgaaataaaactttaaagagtgaaaaaaagaaagttaactatttatggagataactagttatggtggatgaaatcaacactgaggaaaatttagcagaacattgagctgaccttttgactgtccacatcttattctgatgcactgctttgctttctgtcatcaaatcaactgtttagatgcatttattctgcgtatggttctgttctcttactcttttactacttagagtcaatgagtacaggtctacagttgaaacatgtatttaaaatttatgtatttggtaatataatacaaaatcatgattttcaattaaaaaggaattaatgtggttttaatattagttttactcaatttttattatgacaactttcaaattttagagaaatttgaagggataatacaggacatctacatgttatcatctatttccaaaattgttgacactttgccaacctggcaagtatataggcatatatgagtatatctgcatcaatacaggtagtatttgttgaatctcttcaaaatatattccaatgatcacaattcacctctacagacctttcaaagcatggcataggaatgaagatattctcccagtaacagtgcaattattatatctaaggaaataacaataatgccctcatatcattgattatccagtcagtattcatatttcccattgttttattgaaagatctcttatacctctattttaaccataaatagaagatgaaaaaatttaaagataccataagatattaagtacctgaaattatacctaataaaagatgtgtatgacctctaaggagagaattataaaacaatgaagaataaataaaagatgtatcatgaaaacaaaaacaaaaaaaaaacatccaattgtgactttcagtttgttgtactttggtcagttaacttgttgttccaagtttttaaaatttaagtttgtgtagattagaagttatacttgaatgctttatatcatagaagttaaacatttttggtgagaaactgcctctacattgctgtatccctgaaattataccacagtaggcagcatgaaatgacagattgtcccacaattagtgatgctaattttgatcacttggttaaacaagtggtaaccagatctaatttccagagacatgtgttctcccctttgtaattactggtaatctgctgggtgaaataagagggaaagttatattacacagcaaattttcacatgatgattgagtatacatcaatgatgttttaaatttttgtattgtattattgtatttgttctttccttggggctttaaagtaattactttcaattttaactacaagttttactattctttacgttttattataaaaaaatttttttcacaaagtcaagaaaagaaacaattactgctctcagatatgccaaaagcttaactccttccctttaattattcatttcctagaaaaaaaattactgtaataatcactatattagtccattttcatgctactgataaagacacatccaagactgggacttatagttccaatatggctgaggaggtctcacaatcatggcagaaggcaaggaggaacaagtcacatcttacatagatgatggcaggcaaagaaagagcttgtgcaggaaatctcctccttataaaaccatcagatctcatgagacttattcactatctcaaggacatcatgggaaatatctgcccccatgatttaattatctcccaccaggtccctcccacaacacatgggaattatgggagctaaaagatgacatttgggtggggacacatagccaaaccatatcatgccacccctggcccctcccaaatctcatgtcctcacaattcaaaaccaatcatgcattcccaatagtcttccaaagtcttaactcatttcagcattagatcaaaagtccacagtccaaagtctcatctgagacaaggcaagtcccttccacctataagcctgtaaactcaaaagcaagttagttacttccaggatacaatggcggtacaggcattgggcaaatacagctgtttcatgtgggagaaatgggccaaaacaaaggggctacatgacccatgcaagtctgaaatccagcagggcaaattttaaagcttcaaaatgatctcctttgactccatgtttcacatccaggagtcaatggaactccatttacatccatgctgatgtaagaggtggttcctatgttcttgggcagctccaccactgtggctttgcagggtacagcctcccttctggctgctttcatgggctggcattgagtgtctgcagcttttccaggtgcacagtgcaagctgtcagtggatctaccattctagggtctggaggatggtggcccttttctcagagctccactaggtggtgccccagcagggactgtgtgggggctctgaccccagagcactgccctagcagaagttcaccatgagagtgcatgcctagtggtaaacttctgcctggacattcaggcgtttctatacatcctctaaaatctgaaatctaggtggaggttcccaaacctcaattttttttttttttgagatggagtctcactctgtcacccaggcccaggctggagtgcaatggcgcgatctcagctcactgcaacctccgcctcccaggttcaagtgattatcctgcctcagcctcctgagtagctgggattacaggcacgtgccaccacgcctggctaatttttgcatctttagtagagacagggtttcaccatgttggtcaggctggtctcaaactcctgactttgtgatctgcctgcctcagcctcccaaagtgctgggattacaggcgtgagccaccacgaccagccccatacctcaattcttaacttctgtgcacacataggctcactaccacatagaagctgccaaggcttgggacttgcaccctgtgcagccatggcctgagctgtaccttggccccttttagtcacggcaggagtgattgagatgcagggcaccaagtccctagactgcacacagaatggagaccctgggcccagcccatgaaaccattttttcctcctagacctccacctccctctgggcctgtgatgagaagggctgacacaaaggtctctgacatgccttggagacattttccccattgtcttggtgattaacatttggctccttgttacttatgcaaatttctgcagctggcttgaatttcttctcagaaaatgggtttttaatttttactgcatcatcagactgcaagttttctgaacgtttatgctgtttgccttttaaaactggatgcttttaacagcacccaagtcactgcttgaatgctttgcttagaaatttctttgaccagatatcctaaatcatctcaggtccaaagttccacacatctctagggcagggacaaaatgtcaatttctgctaaaacataacaagagtcacctttgctccagttcccaacaagttcctcatctccatctgagaccacctcagcctggttactatcagtatttttgtcaaagacattcaacaagtctctaggaagttccggaccttcttatacttttctgtcttctcctgagccctccaaactgtcagaacctctacatattacctagttccaatgtcacttcattttcaggtatctatctttcaacaatgccccactctaccatattagtccattttcatgctgctgataaagacatactcaagagtggggaaaaaggggagtttaatggacttacagcttcacatggctggggacacctcacaatcatggcagaaggcaaagaggagcaagtcatgtcttacatggacagcagcaggcaaagagacagcttgtgcagggaaacccatttttaaaatcattagatcttgagagacttattcactatcatgagaacaacacaggaaagacccattcccatgattcaattatctcccctgggcccctcctacagcatgtgggaattatgagagctacaaaatgagatttgggtggggacacacagccaaaacatatgaatcaccattggtgaaggcaaatacttttgatcactctgtcttttaaccactcaacactatgaagacatggattgttttgctataatttgtaattcattttattcattgttggtttttgatgctcaaatctatgcaaatgttactgggattcctataaaactacttttctcttttaaacctgcccttatgagtctttaaagaaattcttacattctggcacaatttgatgttcaaagctcagaatcttaacctatcccaagtctagaattggccatgtgcacttctagtggtcaaaggttgttagaaactggctctggttcatagagttgctaatgctcagaaataacatttctatatatacttttagaccagcaatataaactgtatttttataaactgattgttacttgacagtaatattctgttcaaatttaatgttatactttattcagcttattttaatctttatattaacatatctgttttgaattatctgatgcttttctctcttgatcatctaaaggtagaatgtcatccttacctcaaccagagcaaactgctggatttctgcaagtcaaaagacattgttctggttgcccacagtgctctgggaacccaacgacataaactatggtaataagagcatcaggaagtttacctaaaatgccattttgatgaaaaattttagttatagcatactcagtctcctagagttcattctcaatgggtcagggtaaggggataatttgcatttcttatgagataccaggtgatgctgctgctgttcagggacctcacttgagaggctctggtgcagaatgaacaccttagtctgtttagggagcctcctaccaaactgaatccagcctcaagacttcagcatttctggctttccttccagggtggacccaaactccccagttcttttggaggacccagttctttgtgccttagcaaagaaacacaaacgaaccccagccctgattgccctgcgctaccagctgcagcgtggggttgtggtcctggccaagagctacaatgagcagcggatcagagagaacatccaggtgaggagttgggtgggcatcagggctcctgcacagtgtccttcacacgtgtgcttcttgtaaggttctcaggacacccttggactaagtccacttcctgggcatttcctatgcacaaatgctttgtgtgcataagtgttttctactctaccacaggaggggcagcatgggtggagagaatcaggatgggaccaaaaccaggaattttggtttcacaacataaagttggcaacttaactctatccctctgctagggacatcaccttttcttcattttctgaagtgaggagttgggttaggtgttctctaatcttcaaaaatcattgcagatttttcatgtccttgtttactcagtataaatttcatatatttattctcttagaattatttgttgagtgcctgttgaaatctttgggtattttattaggttgcatgtctttttctatgtgtagaagatcataattatactgagtaaacttattaaagaaaacctctcaacatagaggtttaatacaaaaccatttatttaactgacaattccatggtttgaaatttagcctaaagctccacctgaactcagtctcgtcctgtttctggctgggctttctcacgtgtgtgcagggcaatgaggcagctctacagaattaatccagaatccatattctggatattctttaacagcttcaaatgtattgttgaaatagcctctcccaaaatgtacccgtattttgattccctttatggtggttttaataagcaaaagtttctactcttaatgtagtcaaattctttatgacattttctcgtggttgctaatatcatgactttttctatattggaaacatgacaatatgttaatatattatatagtaaaatattatgtagtaatacaaagtaatatattattgtctattaatatcttataaaagtattaatgtgcttttataaactgggatagtaatttgatttttaatatgtgaaataagagtacaaatgtacatatacataatcttcacttgatactaaaatgtcctactaagaattattgaaaagtccatatttcctcacttatcttgatttttcatcctaagtgtccataagtacttcactgacatttcccctctttcagagttaactttcctgtactgtttaagattatgttgaatagaaagtcttactaccataatagtaacagtatttttctgacttagtctatatataataatggcttggctagtcctgaatgagtgttctgttacataacattcagtaatatcaacttcaacaaaagggctaatattttgttctctggctgaaattgctgtgaaactgcagatcaatttggtgagaactgattgagacttccagtttacgaccatagaccatatgaatattcagttatttatgtgatattttaatatgtgcttcaattagttacatagcattctttattaaggcattcgtgtatgttttcctagatttattcatagaaaacttatacttttaatagtctttggataactttttttgagaattttctaatctatgcaaatattctaagaatacaatgaatgcttcttacctagactcatcaattgttaaattgatgacatttttattcttttcctctcattctctgtatcattagagtattccattaaaatttagtaatttagtattatgttagcaatgagtgacatctttttgatatttaaattctttccaatttgtatactgagaccctcttcaagaaactatttgtgttctttgagcatgatgttattaggatttggacaattactgtcttgaattttattgaaaacaattgtttttcacattatagctgtttgtcaaagatggaaatacagatgaataaatttggatttcagtatttctacatctgatgtgaaactgtataatgctgcagacaaagaggatctcaacagatactagagatgaaataaagttaaactggtgtgtacatgactggttcatgtacttataagattcggaagaatctggagaaaaattttgaaacttataatttagacagtttgatggtgatacaatttggatatttgtctccttctaatctcatgttaaaatgtgatccccagtgatggaagtggggtctggtgggaggtgtttgtgtcatgggggcaaatatagaaatatagaaatccaacaatatccatctgtattagtctgttttgtgctgttgtaaaaaaaatacttgatgctgggcaatttatacagaaaagagctatatttggctcacaatttgcaggctgtacaaaaagcatagcaccagcatctcattctggagaggcttcaggaagctttaagttccaacattaggtcattcctttgcacccatacctgatcataggctgttagaagcagtcacactatctcttgaatgttttcctgcttagaaatttcttccaccagatacccttagtcatcactaagttcagacttccacaaagtcctggaatggacacgatgcagtcaagttctttcgtaaggtataacaagggtgatctttgttccagtttttaataagtttctcattttgatcttagacctcattagcctaaacttagttggccatatttttaatcagcattttggtcagaatcacttaaccaatgcctaacaagttccagactaccccttatcttcccattttcttctgaaccctcctgacacttccaaactgtgctaattatccagttctaaagccactaccacattttcagacatttttagcaatgtcccactcctggtaacaattttccatattagtccattgtgcgctgctataaagtacccgaggccagataaaatatgccgaaagttgttttgacttaccattttgcagactgtacaaaaatcatggcaccagcatttagttttggtgagggctcaggaagcatttactcgtggtagaaggtgacagaggaggaaacatatcaaataacaagagatgaagagggaaaaaaagaaaatgtcaggctcctttttaaaccagatttcatgtgaactaatgcagtgaacactcattaccatggggagggcacccagccattcatgagggatgcccccagggcacaaacacctcccaccaggacccacttccatcattggggaattacattttaacatgagattaggaggggacaaatatccaaattgtatcaccatcaaactgtctaaattatacatttcaaaatttctctagattcttctgaatctaagtacatgaaccaatcatgtgcacataaggtcaacttcgttccatctttagtttctgttgagatcttgtcttcagttttgtgcagtttcaatatgtaatatctaggaatagatttatattttatctgatattctttaatcacttgagagtttagagatggtctttcataacttttggaaacttatcaagtattttacatattgcctctacaccctactgtgtgatatacttggctattccaagttgacaattatgcaatctaagaataaacattttctacttctttggtaggtttttgaattccagttgacatcagaggatatgaaagttctagatggtctaaacagaaattatcgatatgttgtcatggatttgtaagtaactttggaaaatgggtttcccagtttatttttagaggaggaatgtcagatgggtgttgaaagtgacctcaataccagggagacagaggccagtgcaagtgagaggtgagacaggaactctctggaactctccttctggattcactccagagctctgttctctgacagggtgagtggacccagggtcagcatgggtcaacctgtgcctctgctctcctgactccatggaaatttccagagcagccaatattattgctaaatctgcaactttcatgtaggcctggcatttctgccgtggcctagtggacagtagatattgcccatatggcttgattaatgtttttccaaatctgtacttatagctttttcttccaaatccactcagtttcttatcagctaaaaaacatttccaacaacactggtgtccatgccagaaattctcttctcttccatatggaattgctcactagatcatgtcaattcagtatctttaattgtttcaaatttctttcttccttctctttagacatttgctcatgacccaaacactgcattttgcctccaggaagtttgcccttagtaggcaatagaactcttggctttaatttttgcaatatggaaatctcaatgcagagtataaagaagctttagagaagatagattaaaaatcaagggaagagccaggctcagtggctcatgcctgtaatcccatcattctgggaggccaaggcaggtgaatcacttgaagtcagaagtttcagaccagcctggccaaaatggcaaaaccctgtctctactaaaaataaaaaaattagccatgcatggtggcacacacctgcaaatccagctactaaggaggctgagacaggagaatcccttgaacccgggaagcagaggttgcagtgagccaaaattatgccactgcactccagcctgggcaacagagcaagactcagtcattaaaaaacaaaaatatcaagggaagagttggaaagtcccatctttggggataatatatagctgacaaaagatcttactcttttctatatgctccaaggttctaggattcacagaaaggcactcatgtgatgagggcaaaacaagttatgtcactgcctgcagtggagatgttaacaagtaatagacatgagataatgtattaaaaaggataagcacagcagcacatcataagaactcaaacatttttagatatctttattagtttagaggaaaatagtaaaatagaaaatcatgaaaaggaaaggaagagtggcaaacatcagtaattctcaccaatcaattattcaatattaatgaatcatttattcattctattttgtgtgattttcacctaaagattgcccttagcatattgtagggttttgaatatggaaccccatatcacatatgacaatttacatgtctgaatcaaagaaaatattttccatatggtaagcagctagtcagtaatgaatacattcttttaaaaggatatgtgattgctaccaataacatttaaccctcaaaactttttgttaatgatgaacatatagctggcttatttctattcaaaacaatgcaagatgagttcctgctttcattgagaatttgaaatagaaaatgtcagaatatctctttgctctgttgacagatatggaggactatgtttgaacaattgaccctgtgtagtttgtgtgataaattccaggcaagggaatataagttgaaaattttcttattttgaaaaaaaaaaaacacattataaactcatgttcatgaaagacattccacaaatagtccgaaaataaacttcttaacattcacactaatggcagcttcatataaattcactttgctaccagctttttaatagagtcatttcatccatatttatgtactatcctttctcttttcagtcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaattgaatgtttttccttaaagattcttttcctactcctttctctgttacttgtgtgtttcttttccttctagttctttaaggccaaaaactgatttgcctataagtttggggcagagagcagatgataaccaatattttatagacatttttgaggtgagagtaggtggagttttcagcctctagaggagaagcaagtgacatatttgttagtctgtctttagctcttccagaaagaagaaaacacacagcacagaacctgaacatgagccatattgacaggatgaccaacaattaatggcctccctccagcatcgcaagaatgggagctccagcaacctaggggtgcagcatccctgtggggtaatggttagggaggtgggagggcacccatccaggagaaataattaggagtcagatatgggagaggtgagaagggagttgagcacattctgcttgggaaatacaaacacatgctcttttgttaattacgtcttgtgcataaaaggaaacttcccacatcgttttaaggctgagagccaggccttgacctcctctgtgtgcccagtatcagcagtgaccttgctgggctgtggtggagcaggacatcaaagacaccagtgactggccacattctcctgaatatcagctccatttagaacaaattttagattctaaaaatatactcttaatttgttctactcagtcttttgaaatatttcatacattcaaaaaggcacacttactaatataaaatatctgaaagccattacatgttgtcaaattaatttcaaaattgcaaatacatctaattatccaaaatttcaaaactcttctgtaaacagtgtatgtcaatagcatgatgctttcaaactttgtaataattattcctgaaagttactaaagacacctaattgttcatatagtttgtaggggtacaaatttaatcagctagtcaagaaaataaaatttcattccagacaactttttgaaaagttgggacaatgttatgggctactggccaaagcactttgagactgacaggtgtttatgacctgtgcacattttccagtgcttttaccctccactgatttaaccccattagaggggtttccttaagccatgtctttcagctgagaaatatcctgccaagttttgtagtttacaatatttcctaaaatgatttgtttcttagaagtggaagaggccataaactttggaagacccttgggtgatctttggactggttttctgtcttcactcatttccttgatgatgtcaaatattctcatggctttaaatacaacctctaggccaagaaaccacaaatcaatatcggcaggtgagctttttctccgaaactccagaatgaaacatcatattgtctgcatctctacattagtgcctaatggactttcacacttagcatgactcaaacaaagctcatttcaattgctgccttcctgttccacctcaatgttcctagactaagtaatgattatttcacgtcttgtaaagttgattgacataatcaaaaattaatgtttttttaacttattagtcaagtatgtaatgctaaagaatttcagattttcttagtatgcatgacattattttccccaagatgtgaataattagaagtcatttataaatagtaaatctaaaaaaataaaaaataaatagtaaatctgctacaggcttattctacttgtttacccttcattttcacagaaatcttattttgaaaagaaagtttaggccaggtgcggtggctcatgactgtaatcccagcactttgggaggccgaggcgggcagatcacgaggtcaggggatcgagaccatcctggctaacacggtgaaaccccgtctctactaaaaatataaaaaattagccaggcgcggtggcaggcacctgtagtcccagctactcaggaggctgaagcaggagaatggtgtgaccccaggaggtggagcttacagtgagcagagatcgtaccactg

SEQ ID NO: 13042 - DNA, 150394 bp, Human
  misc_feature (1)...(150394): n = A,T,C or G
aagcaaatcttgtatctagaaaccgaaatgcccagagtctcgcacaagctgctcgtctgggccaccaactcacacagccgccgcccagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccctgtctgcgccgccattggccgcgggccccggtactggcgggctcacgtcaccggccgggcccgcccccttggcaatgtcttcagcccgctgctctcctaacttaagcatttattccactgggatagaagcggcaggagcagcgttggcaccggcgaaccatggctgggattttctatttcgccctattttcgtgtctcttcgggatttgcgacgctgtcacaggttccagggtataccccgcgaatgaaggtaagagcgggacggcctttctgtggtcggggacagcgaggggccatcgcgggtgaggggtcctcaggagcgcagggccaggtggtgcggggggagcccagtgtgaatggtgcgtcccgattcgggagaagggggctgaggcgaggggatcggcgaaggggcagcggggaaccgccggacagcctgccccgaggcggtgacccgtgcacgcggcgggtctgtccaagtttgtaaccaaaggccaaagtttatcagcatccgccagagaggcccgctcgaggcgccctgaggggatgcacgggagacaacgccgggatttaaaaaaaaaattacaagaaccacatcctctcctgagccagcccggggcgaggggaaaacgcagcctggagcacagtgaaggcttggtgctcccggattctagcgaaagcctttcgagctctggtttctgcaaagtttcccgagccctgcgcttctcgggaccgggctgcggggcctgctccgcagcgcagcggtcgtggcgccgctcgtcaggcgccagtgacctgatttctagcacccggagtcagacacctttctcctcgccaagcccagcgccccgagggtgcgattgcgggcctgaggggcccgagctcttcgccccgcagacttggggaacccgccggcaagttgaacgcagtcgagttttagcttttcgccccagaattgcacacagtttagagctaacgtgcggggtcgacgggacccgtctgggtgctcagttttctgtgcatccgttcggacgtgctgggaggattgtatgtgcctgtgtgtctgtgtcgggaggtggggcggggcgggggggcggtgatcatttagtttctgagaaacccagggagaggcgaactgtgtgtgtgtgtgtgtgtatgtgtggtgtgtgtgtgcatgtctgcgtgtgtgtgcatgtctgcatgtgtggtgtgtgtgcatgtctgcgtgtgtgtgcatgtctgcgtgtgtgtgcctgtgtgtgtgcgcgcgcgtgcaactgcgtgtatgtaggtgcgcgaatgcctgcgtggaagcggacgcggaggattgtatgtctgtgcgcagatgtcctgagtgtgtgcgcgtgtgttcgagtgtatgctcgtgctctgttccagcgtatgctggtgctctggcctgcgtgcatctagtctcacatccgtctctcattcttctcctttccggcatccatctatctatccgtccgtccatccgtctatctatccatccatgcatccatccatctctccgtgcatccgtccgtccgtccatgcatccatccataatgcatccatccatatatctgtccgtccgtccgtccatccatccctccatccatccacccattcatctatccatccatccacccatccatccatccattcatctttccatctctccagacatccgtccatccatccctgtgtaatctatcgttttctctgttccgaaggagggagccaaaaaccaacttagccttggctgggcagccggtacccggagccctccagacggaggctctgagagatttatacacctgcccacagacatcgcttgggaggaaaggggccctctctcgccctctggatctcccatctccttccgacgtggcttctggtggttctggtgccatctcggccgtcgccgcccctcggtccctagggttattcattcccctgagaggaatcgtggatcccgcgttctcctggccacttcacacacttgttaggacgtcccctgagacctctctcgccccagatgtagagactgttttctttcttttttttaaaccccctctttttttgggggggggggagaaaaacttgggagcccaagacaaaaaggctctgagagccctaggctaatgttgaaggggagggagggaggtctgttcccctcccctcccccacctcccccttaaaaattaattcactttgttgctttctattcccatcacgtttccttttctctcttttaccctccctttctactccctcctttttttgtaaattgggtcttattgtttcctttgtgtccctaatccaccttacataaatccaaatggatgtagcgggcttttctctagggacagagagaagagaatggttgcggtgggggttggcggtggggagaggagaggagggaagggggcgggaactccaggcgggagcgacccagggaaggctctacattttaaaatcattaacagaccccaggaattcagactccccgggaaaagtaggggaaagagactgatttttaactccattgactttgaggtgaaatgagagggaaagtgggcagaatccaggggtctgggggtaagcttgagtgttggggtgcgcatgagcacggatggcggcttcccattcccacccctcccccagcctgaagagccagcctggctgatcaaattaataacccagtggttcctttgaggtgggcctttcgacccccaggactgcagatctcggtgggaaagagaggttttgaattcattgcgtccctttggatgttccccttacctagcgctcttctagcctgagcggggtaccgcagctcggtgggctgtcctcccttccccccaagctttgacgcactcaggtgtagcacaagcacactaaagccgttaggcagcactccatacctaaaattcaagccagtgatttcctacgggtggaagacgagtctctgattgtcccccaacacatcttgagaaagagagaatactttcggtacgtttgcattctgattctgcacgtctggcattccctctttctgaaactttgatatttaaaaaagcagcggataccatattcagggactatttacttggttgtggaagggaaaatgttagggagagccttttcctgaccctttggataggatactctctgatagaagagagaattcacttgtggctctgtcaccctgatgagttatgtggtcatctgaaacttgcaaaaacaaataattctagtagataccagacagagatgaatgcagattttgctctggagtgtaactgctctacatagatgtatttatctttttgaattgtacttcagattctctattcatcctttttagaaaaatgaatcaagtgagtcctaggatggaattttaaatgctaagcaagttgaataaataagaacctgcagatttaaagagggggagaagatcaaatgagtaatgattatttacataagtgagcccaagtttaggttttgatcagtgttggatatgcacagcctcagcacatatggaaacgctcaggcaaatggtttttgtgttattggctttttgcaattggaaattcatctatttttcttttgttttttgcagttaccttattggattccagatctgttcagggagaacttgggtggatagcaagccctctggaaggaggggtaagtcctgagttgctctctgatccaaagggtaaaaaaggagtgattagcaactttctgagagtcctaatggcttgattcttgttgattgtggtgagggggtcagatttccgctgtggcctatgaagtgaattacgctttgttggagaaatcctatactccctttggataactctgtcatggaagaactagaaaccaaaagggcagaaaggggtttcaaaattaggagactggtggaggcacagacttagatgcctatttaaaactaaaataccaacaggaaatatgatccggggaccaaattagaatttatgcctattactgtgatggccatgaagtcctgacaaggttaatttaagagcaattgtcctgcttccagatgaaaaaaaaagaataaataaagatatgagagagaagacatttctaattgtacctgcatgaactgcaggaaggctctgtaccttgctctcactcttaaatcagctgctgttcttttgcacactgagagacagtcatgtgaacttgtgtccaaaaaaccctaagcctgtgtattaatggtgctaaatatgaaaagtttatgtgtctgtaatcttgaagaatctttggggattgagtagtctggattataaggtctgaaaaaagcatcacttcatttattctcaaatttgtaatacttgtcattactgcctccatcttactaggtcaacggccacattctcctactccccctaaataaccagtcagaatgaatcagctttggaaagaaaacagtacaacatgtaactgacttctgccaaactgaaataactctcaaatccttttaaaattaaacaaatcatcctaccttcacaggcttgatagtttatggctgagtccattgattaaaaacaatgggggtgaaagattaggagtttttactaggcaaaaattgtaatgctagaacctggcgtgggctccacaccggtccattgaataaagaatgaaggattttaaattaaagattcatagagtctgctatcaaggacatatttcagaactaagactaagcaagaaaataatcatgaaaatggagaattttaggctgtcttgttgcaaacagattttgtaatccacctgagataaaacagattgccctgtcttcctattttttctgcctgaacttgactgccattggtttgttctctcctgaaaaattccagtctgcccttaaaaccatctttttaaaggagggaggagtgattggcaggcctctggcagtgtagacaggctgtattcaccactgattgcaggcaattgccctcatcctttgaatgtgaagaaaggtacggctttatcttggtgagagtcagactcattgttaatcctataccctggaaaggtcactgattcaggcgaggctttcccaggctacatgtaccaggggtattgcttggtaggttaaaatgtattagaactgctggtaaaattaaggatggaaagtgtcagtacttgtattaataaattcagtgagccttatttttcttactggctgcttttaagtttgaagagagtatatacatctaatcaaattttgaacctgacttgtttcactaaatatatgtgtgagctatatgacagcaaggactgacacattttagggtacagtccatagtctatctagtttctggaaagcttttattgcaatttaatatgctgcagacattttcttcttcttcttcttcttcttcttcttcttcttcttcttcttcttcttcttcttcttcttcttcttcttcttcctcttcctcttctccttctccttctccttctccttctccttctccttctccttctccttctccttctccttctccttctccttctccttctccttcttcttcttcttcttcttctccttctccttctccttcttctccttctccttcttctccttcttcttcttctccttcttcttcttctccttcttcttcttctccagagctgctgaaagagcacctggtcactttttctagacacaaaacttatcttggttgacttgaggtctatttaaaactatgcagagctgactgtatacgacccagtacttttaatgggctggatataagcaggtttttttttcttttccttaaatattaggcatgtaacattttaagcattattgtaagataaataattttatttgtatataaaagaattagtcattccaaaatacacagtagccattgagaaattgtgtcaagttataaagtttaattaatttctagattttataattgacgaggactttttcaggattagagcaaaggaatgaattgggtatctgtcaatgaggaatggattgattgtctttaaaaagttctttctagctgagagtaaaagcatattgagtcttgatcattctaaaatctctgcttgcagttaggacatttaatgtctttattcactgttaacttgagatagtaatttggtctgataatgacatttatttcttgttgttatgtttaaaaagaaaaaaaaacaacttgatttgacaataccaccaaggaaaatataaattagaatcagagacaatccattgtttgtctataagaacaactaagcaagacatgagaattagggaaagtgatggctcctgataacatcgttgtagccaaaagctactttcttggtaatattcacttaaaagagtatattgagttgctgacactgactgtgaaatataaaactaagggaggatttgtcactgttccagtgaattgatcagtgtggttagacaattacgttcaggctgcaaagttcatattagacctgaattatcctgcatgaactctgtagagataccctatgtgccttcattgacaaatgtgtttttccaaattcccattgttctgagaagagaagcatgctgagtaggtgtttttgaagatgggaatctatttttggatttacatgaatttcctaaaataagtaaattactggtgattttattgcttactggataaaaagaaattttcatcaccacagggcacttaccccctcctagtttcaacttttataatggtggcagatgaaaaggatacagaattttatggcttatggtccttcacatagtaacatttccatccattaagagtttgccagtgcatagttgggaaacctattaaaagatacattatgattctatgcacttcactggactgcatggagctttacctggagctattacagaatacaattttttaaaaaaactatctcttgttccttctaattatattcatatgtttgttaaatacttaagctgatttataacagatctgtatcaatgcattactgtagatgttaatgaagaatttgaggctgcctaccagcttagtaggagtcccaaaagttttgctgcttttcggattatttttaaaagctataatgacagtgaaacttttagtcacagtggtagacgcaagttgtcctaccattagattctttgtgttaggaagtggaatgcaaagaaaatgctaccatctcctttcattttcttgggccttcagtcataaacagcacttgctattttatttttaatgtccacggaagagttagaagcaaagcatgtctgttttctagttttgttatttgtctatgttttaaaaatgagaacatgtacaaattttttaattgaatacacagtcttgaaaagttgtctactgttataaatgatagcatatttgagaaatccagccataaaatttactccctgtcttcctaggattactgaaaccagaatggtgggattttcttttcacctttaaagagtagtgagggtgccaaaaaaatcaattgccttttttttttttttttttttttttgaggtattagagagcaaagttctgacaggagcactactaattaactgataattgtcttcctttggcaagctctgctcttcctgcccttaatttgcaggtctctgctcagtggttgaaacaatacccatactagtttttcctttatgagtaaatttgaactgttgccacttgaaattgtagctgttgtaataggtgaatttgaggttgttggaccaccacaaggaactgccgagaactcacaagcagtaaatccaccattgcctctggatttcaggcaaaagattgaaacaattaaacaaacaaaaaaaaaacttcctcaataaaatattgtcttatctcccataagatcctttattagtgatgattggtgctcagtagtttgcttcattattgaaagaaaaataatcaggtgtcctatgagaataaaatgggattgacaaatcactgcatgatgaaactttgtagttgatacatctgctttggatctttgcagtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaaggtaagagggtccatattgcagttttttcactggggcttagtgcgagtaattaaatcagagatgagactaaatggagtaaagccagtaattagtagcccctgtgggatgtggtgggacacaggggtctaatgagtaagtgctatagctccaggtggcaaagctaagacgtttctaatactgacaaaataaatgatgctgctgtaatcagcagaaagccaaacacatttgctaacaggcacttatatctgaactggcttgatgcgccctctgaaatgtaaatgaacaagctgaagaaacagccttgattgatccttacttaaagagggcggacacatttttgagccatagttttcctgtctatggacttggtaaaatgacaaagattgttaaatatctcccgtcttctgcataagtgcgtgaatgatctaaatgtgaaattaggattaagttgttccagttccctcccactgactaaaatcgagtgaagaaagtccattttttctttctgccttgtggaccggtggagatatgacccaacaaagtggagggacattgcttcaagtacattctgttccctgaacacccaccgatgggttctctaaatgaaattaatcttgatgaaagacctctttatttctcttaggaggtggtaattaagcaagcaagagtcttcttatttgatctgtggtcagaagcaatagcaaattgtgacccaatttggtattgatttcagttattgagtttttgaagaaatctatgtatttttatcacattaattactacttaccatattactaagtggatttttttttctcacctcaggttcagtgtatgcagttgattcttgcttttttaccccttcctgtcagaatactggggagtgtataaagtcctttgctttacagaaagtttatatctgagtaagagatgagagtaattcctatttatacagattgtttgtcatgtgtgaaataaggctcaaaaatatcttttattccaagtttttgtcttgcttgatacttgtttttataatgtagttatcaacagtctgcggctgccaatccattatggttactacaaaatagttagaatgtaattctggtctcatctatggaacaatcagattaatcttttctctgggtaattgttgagctgtagatggcattgccacatggttcatctgatttggtggttaaagggcctgaattaactgactgccaaacaatttgtctggcatttcaaccattctaatgacagggtgggattaactatggggcaatccacttgattgactgaaaatccagttagaacatgaagaaaattgcattttttggtgatttggtgtcataaagttacacgttactccattcatagtttacacttgtctgaagtggcattcctgcttagctatagttatttctaggagtaactaacagtgaatgttctttcattttgtggtaaatagaaaaaagagtggctatcttttctgttgactcagtgttaaaaattcaaaaaaaaaaaaaaggaaatgtgtaaatttaaaagtttacaagttggaatttaaggatttttaaaataaagattaaggcctcgatttttggtttgctcttgacttagcaactactagataagctgtactgaattggtaacccaaagtatattctggtattaatataagaaaatatgtgagtgcattgttactggcaactaaattactatgatcatagcaggaacagtgaaatgagcagggcaatgacatgccatcacattttagagtaaattattctgccttttccgttttgtaagacaggagccgcacatcttcacatgtcaagattcttatatatatttttaaaaaaacaacattggcttccatttcctgctaaaatgttcactctcagcattagcacatcttcgtgtatctaatgtcattgattttcaattgtcacagagcctagtaactcatacattgctacattgtgaaactccttgacatttttacaaccaaaattagaaagaaaagagaaaaagatggtgggcaaagtgaatataaaagcaatcgaacatttttctggtttgctttatggaaatagtcttgggggatccagttaatcacgtgcgtcctcgaaggggaggaatttagggtttcaaatctagtccacttccgagcaagctgttcctaacatgaggccagatatttcacagcagaagcaggtggattgagtcgtttttgagaaacttcagtgttttcaggtgtgtcaaccaagtttgtttttgttttttgtttttgttattttgcttttttttctgctaataaaatgattaactctttcaagacactttttgcacaagaccttgcactttggttgtttgtttctgttattgccatgtaaaaatttctgatgtagttaggtaagaaaaaacttgaatgacaaaggattccaagcttgagtgagactttatttatttatttatttatttatttattttgagatggagtctagctccatcgcccaggctggagtgcagtggcgcgatcttggctcactgcaagctctgcctcccgggttcactccattctcctgcctcagcctcccaagtagctgggactacaggcgcccgccaccacgcctggctaattttttgtatttttagtagagacggggtttcaccgtgttagccaggatggtctccatctcctgacctcgtgatccacccgccttggcctcccaaagtgctgggattacaggcgtgagccaccgcgcccagccagagtgagacttttaaaagatgacttgagactctaaaagtcttaggaataataaaaacagttggccctatccttgatatcatgataggcatcaagagtagcacccaggcacagtggaaataatatagagacgaggaaagatgtatgaatttggtcacttagctagatgaccttgagcatgtttcttaagccctgtgagccttggtttgttcatccataaaatgggatgataatagttatatttagtttacagacttgcaatgaggacttggggttgtaagattggtaaaagtcacctcagagatcatgcaacaacttgatactagcatttctgttgtcattgtgctcttcccaaggtcatagctattgacttttaagagcgttgagttgaaatagtagaaggaaaatccatcccctgaccactccttgatatcaaggctaaagataggaagcatctctctcctttgccctaacaaataataatatacgttttcacactttgtattgaaaatattatatggagtatgtcatttttttttcctcctcgataggaaagagaaacttcctttgaacgagcaaaaagtgacttgtgggtaggacaagaaagagggtgtaaagaaagcttaagaaggaatataaaggaaaactggccaagtcttcagaactctggcagcagtttcctccccaattgtcttttcaatggttctactgtggcaggacaaatagaagaacaggtgaaaggtcacctacttcctcatccatcttccttggggtccgggaggtcagagggaagattgattaagatcttaaatgtttgacaaaggatccttgggcaaaaatgggcagggcgggcgggggcctggggtgtgctgttgtttgactctaaccctgatcatccactgagtcgtcaaaggaccttggggacagaactacacttcctcttgcagttcctacccccagcagtacatgctaatggagaggaaggatgagggcagggggatggtggctttgccctctgaagcagaggcaagttcattctgctcttgaataacattttctgaaatgatttggcttggtctcagtagaacaacaatgtgtatgagctacttacccatcttctcaaggagaatgtatcgcaggagttagcagccctttgaacttgcctagtgattggatgcagaggataatataatgattctagttagtcctgcttccaggccacatcagactgttggaaaaaggaaacaaaatccacttcagacatctccttccggacagacatacccctaatgaagaaatgttccagatgttttacaggactgttttcattactttagaaatagtaagcagaaggaagagaggaaaatattccattaaatttttttttaatttattttttattatttgttttttaacataagagatgaagtctcactctgttgcctaggctggtcttgaactcctggcctcaagtgatcctacctcagcctctcaaagtgctgggattacaggtgtgagccacctcacccagccaaaaagattcgttattagtgtattttttgcttaattaaaaagctgaaaaatgaaaggagagctccagattttctctttgggaaatactaatcagcagttttcagagcatacatataaaaaataataccaataaaaacattcttttggagtcactcttaaggccaaatgattacaactatgacaaaattaagctaggtaagaatcaagccttgctgaagtatacaattttgttgtatattgaggtcatcagtattaaaatgtactcatatcaacaaaaggtatcgtattaaaagctttttaaagaaagaacaagatagaaatgttccaatggttttaaaataaacagacttgtgctctgaaaagaggaagagagctatgtcaaaaaaaatgatttcttttttcaactatactatagaaggagcttaggagaaagaagtaatggaaaggaaatatttaaaatctacttcacagagatgctgcttccatatcctttgcactgttgaaatttttcctctacctttgaatcgtatcattaagaatcaattgcttgaatcacatggctgcttttatctccggctttgaagcatggctgtgatcattgaaaaaatgtaattctttatctataagagagcagcgtttaattattgtcctttttctgatatacttttttttttcctctttgtgtgaccaggctgcctttgtgagtgtgaatcatgcaatagtctctatttggggttcaccaaaacatcgcatagaaatcatctcagggatttttgaatatggtattcaagatttgatgacttattttagtctaactgagcttccttgtatctttcagaaatgaattaacacataattattctgttaagatctgagcctctaggaaaaagccttcttaagtggtttttcagttactgctgtgcaaagcaggggtggtcatgatataagtttgactttcacataactgaactttactagttaatggcggggggtgggggaacgggtaattggtaaatttaacattagcaaaggactgcatgcttgtcagataaatttctcatatagaattacataaagtaaaaattgtaagtctaccattccctgcccacacacacacacacccacatccacccatacatacacacacacagttttcaaaagcttactccaacattttacaagttaccatttttcacaatttggcaggcaactcaaatatagccatatacatgtatttttaaaataatagatggaatcatccttgtaattgtcatcctgtttttatgatgcttgactgtcatagatatcgctgtatattagagaatatagcttttcttaattctccttcattgaagatgaatattctgtagtataagtataccatgctttatttaatgttttcgttattggtagctatctaggttgtctcagtatttcctagtaatacttttaaactaacacattaatgtgtaatcatacatgtatatttttgttaaaacattgaatgattaaccttgctttgctatttttctgcctttatcttggacatatgaatttagtagaacttccttatgagaatgtcagtggggggagcattaggcataaccaaagtagtaacatcgattatttggtggagttatgtttcatggaatcaatatgatatgttaaaatctttgcatgtgactaatgtattaatgaggtccttgttcatgatttctactcaattgggtcctttttaaatcgtgtttatgaatcttctttacatctgaaccttcaaaattctctgcagcacatgaagttaacatacagttagcacaaaatggccaagaactgcctttggagttgagccacttaatcagatgtgcaattgtagacactaacttagcttccctaaactcaagttcacgtttgcaaattggtggcaatagtatcttattatatatgacacacatatatgcatgaatgtataaagggcctggcacagtgcctagaatcattaaaatgcttagaaagtgaaaattgttactcttatttttattgttgttagatagaaatatggtgacaatatgggctgtttgatcaatccaacaaagaaaccatttcatttaggttccagagtagagagttttttgtttggttggttttgatcttctgaggaggcaatggtgacaaatacagggaagagtgaagcgatggtaccaaatggctggtcttgtctacattgatccaatcctctgtgccccaagtcactgtggttctccatgtggtccagctatgttccccaagaccctttcatgtggtctgcaaggtcaaaactttcttaataacactaagatgttatttgccttttttttctaattctctcatgagtgaacagtggagttttccagaagctaactgatgtatgataatgttattaagttgaatacagaagcaaatacagtgatcccctttaactttggacgatatgttccaagaccctcaatagatgctgaaagctcaaatagtaccaaacccttatacattatgttttttctatacatatgtacctatgctaaagtttaagttatagattaagcacagtaagagaatgccaacaacaataataaaatagaacaattataacaatatatcttaataaaaattatgtgaatatagcctctctctatcgttttttctatccctttctcaaaaatatcttactgtactgtaccttcggtaggcaaaaccacagaaagccaaatcatggatatgaggagactactgtaaaagaatctggttgtcctctattaagccagacattcaagaatatgaaaaaaaaaagtagtgactgggcgcagtggctcacgcctgtaatcccagcactttgggaggctgaggcaggtggatcacgaggtcaggagtttaagaccaatatgttgaaaccccagctctactaaaaaaaaaaaaaaaaaaaatacaaaaattagctgggcatggtggtgtgagcctgtagtcccagctactcagtaggctgagccaggagaatcgtttgaacctgggagatggaggttgtattgaaccaagatctcaccactgcactccagcctgggcgatacagcgagactctgtctcaaaaaagaaagaaagaaagtagtaaaacaatgtcacttttctcactaagtttacttttgttttggacaacagtgtttaaaatatgctatttgtgttaacatgcaatgcgttaattgttatttttcaatgaattaaaaataatttaaaaatttatttttcagtttcaatttgtattggtaaatattagtagttataactcacacacacgaaaacattctcaataatttttgagagtataaaatgtttgagagttcggttctgaggccgaaaatgttgagaactactgcacctagtccatcacttttcagtttctttggaaggtaacacagactgcacttctgcaggtcatggagaggctttaaaaatgaaaatgaaatcaagccctaaaaactttttcataatctgggagacttaggtagtttagaagaatgacattttatttactcaaccctttagacatttctataaaattaggcagcaatttatagctcttggctttttaaaaactggttatctgtgtccaataacatggctcagtgctccctttagttttactgtgctcgtgagaaggaatgattaaagaaggcctcagctgtcccctgtaccccgagagactgtatctcacttaaggcataaaagctttctccctgtatcctgttacagctggtacctctgagctgttttggggaggagaacaggtgaggtcacttggttccatgatctggagggtaattaagaatcccatgactaaatgaacattttatgaatattcagggtctatttctttttcctgggaaacacacatgttggtactgcttacaactccctttggagacctcagccttttctgggtgaatgcaggtcgtcagctgtctgcccagccctgcagttccaggcagcagattcttcatttgcatattctgtattcgtcctcatgcaaaacagcacacccatttccccctttcacaaaggcaatgagggcttcctttggaaaccccagccaaaatctccttctgtttatgcagagcccaatgatttagacaccatgcaaattaattcggttttgatttgaatgcttccagagatcaggggtgggaggcagagaggagactatttgcacagggctctttttatgcacctctgcccccagtgtggctggttgtcactctgcggcccccctgccccatgcaaaataacccaagtccctgctgctcatttcattttgacctttggaaaaggaacccagccttggtgaatcccttggcttgtctgtttagtgacagcttcagctggaatcttgctgttctttctgaggtgggaggggatggcactattcagattatgctaggaatgttcagatgtgtcccaacaaagggctttaaaaaattgtaaagtaaaagatacaattctttgaaaaagaattgtcagagctcaggaagttctgaaaataggccttaggtcactaatgggctggagtccattcatgccatcagtgagtagatatttaaagtctatgatgtacaaatcaccactgggattttcatctgtgtttcttcatctatgaacgaatacatcaatcttcatacctagaatcacaattaaaatttcatattttcacttatgtccccagataaaattctttaaaatgtgtattgactataattctgtttcttattatatttgtggattcactttttgttgaatattgtcttttgtttctgtctccctcctccccactccccccagtgtctccaaatttacttattttttaaccttacctttattccttctagaatgggaaggcaagcgtactgcatattttacccaacaaacttaactctggttgaaaccagcactatcttctgaaaggccacgatcatatatgcattctataaactagaagaagaggactttgcatgaaatgtttttgaagttcaattagacttgagttcaaactaatttcacagagcagaaaatgggcatagctagacgttgcagtctaattaagtaaaagcaaagtcagttaaaacaacatctaaatgtggaagagctttggttttgctccacatggtctgacaaagtttgatgatgctgttcaaagtccatttgggatggattattaggattaaagagcagcagaatgctctctgtacatggtgtgttccctggtgtcattagcggatgagaaaattcagctgcttatctggctcttgtttctcaggatggatttaaacagacccacacttctcaaaggtgatcttactaacctcttcttaataagttacagatctcaaattgctcaaaatccttaaaataccatttgaagtaagttgattgataattatcatttcccttccgtttacagatattttctgcaccagtacaaagctgtggtacagtttcttaattacccagataatcctgtttgcttgtatttttaaactatgaagtgctgggtaattattcaattcttaatagaaggcaaatggcaatgtaaacaataattaggatgttagacagactaatgcgcttcaaagcaaattggatttttttcatactgttcagcttgaagtcccataaagctaacaatttagaagcaaggcgaaaaaggttccatgttgttcatattttatggcgttatctcttcatggcttgtttctgtgaatagcagtttgccccaatgaagctgcctgtgcccaagccaaatgtttctgtaacaatcgcttccctgctgtttgacatttggctatgttctcccagggctccagattgggcctttgtctgcttcagatctgaggggtcagaggttaacagaatactgatttcctcctataataccatggcaggtaaatatgggccaacctcatgatcagttaagactcagctcagttaggaatgctttttctcttgggcttttgtccttaagaacttccctgatttaagacttcacgtttcccagctattgctttccacagtggattcttcattaggatcgcagctgtctcttttatgtgacttcttcctttaataaccgttcgcaactaactatccccagaaatacctgagctgaaaactacaagcaaattattgcttttgatgaatgaattttacaaactgaatatggtaatactttgcaatctttaggcccttaattatgtcttgtagtcttatccctactgtatgtttcactgatgaaataataaactgataacaaaggcagtaaacaaagatacttttataatgtggcaattccccaacccctcctttttcttgtctagcctcatgatgtgttgccagttagaggtgcaattaaatgaacaatcagttttattttccattttcatcacttatggagaggcccaagtattcatcaatatcaatgttattaatgttttacatcagtttaattatatcagccttaatttttcttccatagactaatgttactaaataggttgcatcttaattggttatgatgcattcacaggctttagacatttaaaatactcgatcaaatttctcgatcaaaattcatcaattaattttaggacatctttctacatattagctatcctgtttgtgtttggccaacctctcttgctttgcactgtgaacttgaggcttggattcatttgttttcagatttaagtgtttaaaaaagacatctccactttgaaaaacagtttccttttgaagtgcccagcctggcaatggctgaagcagccccaggcaaattaacatgttaaaagaatggatcaatacctttctggctcctttaccctcctcgcactcttccaagggagaagagttttgaagaaccctaggaggcccttgacagaggtgccaggaggcttcaagaggactgtcagtagcccaagtggggaacattgacagcttgatctagtgcccagatcgcttctccgctggccatttgaaaatggatgcaagaggaattgacagcttcaggaaagctttagccgttcatgtaattatggagaggattagaagaaaagtgttgggtgacataagagatcaatacaagggcactagttgactgaattcacctttagctgttagggcactccattttgtaatatttagcctgtgcttagagaagaatgtttgataggcttgtttatttttttaggggttgtgtagacctatgcataagaaaaagaagacataagcagcctctggtttttgagcgtggacttgtagataattaacaatgtaatgcttccagtccttagggtgcaaaggtactaattaactaatgggagagattgagatttcattactgtgttctttaaggaggtgccagcaaagaagtgcagttgaaagtaatatatgaatattcaggtttctttttcaaaccctttcttttagaattgcctctctgcttgtatcctagagtttaaaattagcactgatacactaaaccaaggtaagagtgtggttgtttttgtaagaaaaaaaaactcatgttgatggagaagtgaaaacattatctttgcatgaatgaaaagcgtctttaaaagatttggaatcaaccactgaatggtctcaaatgatctgacttttggaagttttcctccataggataaagaatggctagtgtacttaactaaaataagcccaagtacctaatttattctagccttcatacatgattctgggattctcttgtacaacatgttggagctacaactttttcaataattttaaatggttactgaatatgacaagaatcctacactataatttcagcaattgtactaaaactttttaaaaagcattgttagatctttcttctagagaaccataaaatcttttactgaagagaagtaatgttttaccgtatgaaaatcataacttttattgcaactttgaaaactagatacactaaaaagaacccctccccaaaaaggattgttgacttctacaagagatagtgattagaaaacacaacccattgagtttttccaatattttcaattatatcttctagctggttatcactgatctacaggaaagctattgatttttgtatgtttatcttacatccaatcttcttattgaactatcttgtgaatactaataagttttcagttaattctccggagttttctagagagcaaatagtttccattgcaaacaatcatatatgtatttttctcttatttaaaaaattaagcctcttatttcaaacttttatattacaacattggtcagaattttcagaccaataataaataatagggtagattgtgaacatccttatgaccaattttaatggatataacttaactataatatcagatctattttcttaatatcatattaattttaaacacttctcagaggagtgaatgttgaattttgttaaatttacatatttatcttggttatgttgcttttttggtttgttgtattttgtatttatgagatctaatatattagtagattttttctcgtgataaaccataaactctctttgcatttgtagaaaaaaaaaagccttattagatagcagtgaattttgacaaattcttttgaattcagtttgttaattgaaaacagtgattaggagccagaactttggaataccaactgaattttaatctcagctctgccactcactatgtgactatgggctagttagtaaactttagtaatttggctttctcttctataaaatgggaataatgatacctattgcatgggtatacttagtgttaaataagataatatatctaagtctcaacaaggaaatggtgtctattaagtgttcagtaagtgtcacaatttttattgtttattttgaatttctaataaatatccaggtgacattagtctacattctctctctctctctctctctctctctctctctctcccctttcctcatcaggttttggtactataattgatttataaaattaaaatagttttacattaaaaaattagcactgtagaatgttaatgtgcatgagaactatcttttctttgcaaatttgaaagattccaccattaacactggctctggactgtgcactttgaattggggcacttttctctatatttgctagactttaataaaaagtaaaataaccacaacaaagaaactatctctcagaccttgttcagttgcttttcaaatcacatatgtagattttccagcccagcgtagtggataagttctttgatttggtatctttttagcctctgtttcttttacggtgaacagcaaagatgacacattgctctcatccataattacattattgaaatttctcattacttgtgtagtttttgtttgtttgtttgtttgtttgagatggagtctcactctgctgcccaggctggtgctatcttggctcactgcaacctccccatccctggttcaagcaattcccctgcctcagcctcccgagtagctgggattacaggcacatgccaccatgactggctaattttttttagtatttttagtagagatggggtttcaccatgttgaccaggctagtctcgaactcttgacctcaggcaatctgcctgcctgggccccccaaagtgctgggattacaggcgtgagccatgtgagccactgcgcccggctttgggctttgtgtagatcttaaacatgcgaattaaaggtaatgggtttgttaaactcagttagttcataggcatggtagagctactctttaatcaggagccctggctgccaatgagaattctggttgagaaaatacttaatatcccattaggggaagctacttttcactgcagagtgaatgtggatgcagcctctctgagctgtggtgctttactctcctttttattgagagaccaacagccagagagagaggggagagtgaaagtgagagcaagaatgagagagagagaccaagaaataactgtttggagacacatctggtgctccttagatcagcaactttgacacagcaatttgtaaatactttacattggttttgaggattggaaagtttcatttttcacataaccacacaaattctgtgggccacagcaggcaggatgaagaccagaggacaaacattcactggctcagtataaagaagaactgtttagcattttgaactaggcaagagtagagtgtgatgctttttgaggcatattttttggatgtgttcacattggctgcatgaccccagggtacctaacagtgaaagattggaggtcctgtgtttcttaaaaggagcaccactggcattttggacaggatgattcttcattcagtgaaactccatgaagaatggagttttacaggactcccaagtggctgggactaccggagttatagagaatttagtagccctagtagtccctgagcggtaaatcctggtgtcgtcctcagtcattttgacaggccaaaacctgcccttgcattttgaaatgtcctgggatggatgctaatctcaattatgaacttctagactatgaggttactaagattctaagatagaatgttgagtactctgctttgggtatttcatatatccttgggtagacaatctaggtctaagatcttgtaacatagaaaagatggagaagctcttccaacaatcccagctagccatctctctttcttatttttattttccctaaatctaagagtacgtcataatatttcaaaatcaatatcatgtttcctccatgtattagtctgttcttgtattgctataaagaaagacctgagaatgggtgatttattaaaaaaaaaaagtggtttaattgtctcatggttctgcaggctgtacagaaagcatggcctcagcaactgcttggcttctggtgaggcctcaggaagcttttactcatgtcccaaggcaaaggcgaacaggcattcacatggtgagagtgggagtgagagagagaaggacaacgtcccagactctttttttttttttgagacggactctcgctctgtcgccaggctggagtgcagtggtgcgatctgtgatcttggctcactgcaaccttcacctccccagttcaagcgattcccctgcctcagcctcccaagtagctgggactacaggcatgcggcgccacgcctggctaatttgtcccagacccttttaaacaaccagatctgtgtgaactaactgagggagaactcagtcatcaccaagaggatggtgctaacccattcatgaaagatctgcccccatgatccgatcacctcccaccaggccccacctccaacactgggaatcacatttcaacatgagatttggaggggagaaacatccaaactatatcactcaataaacacaaattgaagaagataggaaatatctttgggaagaaattattaacgtttcacaaaagtatctggaatgatgaccatcagccaagtgctctaccagttttaatttatttcatccttaaacagccttgtaagtcaggtactgttattatccccatttttacacatggaaaggccagggcacgaaatgatggatgtgtttggccatgtatactgcttgacaatttgaacccagatagactggctccagcttacacacttgagaactgttagaaagaaactttcccccagtgccttgcattcttatataaggtgagaagagtatttaaaaatgcctgagtgattgacttgttaagagtgccccgtaattattctaacatttttcagatattcacctgccaatgggtggcccttgtgttattttgaacggccttacaaagagcaaaatgcagctgcaaggctggagaccttgtcaaagagtatattactgggcaaattatttttattttgactctgtatcacagcagaaacagatgatcccttttcttttcaacttaagtaattgggaagttacaagcatagacccaacttgagaaaagacagaacatcatctcatcttagcaggaggacagcttaaccaaatgagaagttttggatttctctaatgcttctgtaataaatctagagagatttagaaggaaaatcaatcttaaaatgagaatgaacttttaataatctaaatgttgggtatgtgatttttagctgattcaggtagaatatttgttaaacgtttacagaataaaacaatggcaatgaaccaacctatttggaaagcaatccatttaagtaataagaagaaaagggaaaaaagatggaagaagcaattgctgttggaggtacttgtcacttcctgtagcatccacaagtactttctcaccttcccctgttgtattgctacctgtggcttcagtggaaatgactcacctttcagctcagtagagccagtatatcctgaattatgatagccacaaaaatttgtccccccccttttatttttttagcctcttagctattcagagtcagattttctgtttcttgtaacacaaccctaattaatacaggaggcagcattattttaacaggcagactagctatctatatacaagtatttcacatatgaaacacgatgtttgcccagggtgagtagttgtttttccaaaagatttctttatagtactataaacaatggggacatcttaaatggttctttattgtcttttctcagccttatggcaagatagaacagtttgagtcactgacagaggcagagggaaagcctcttctaagccatagcttagtgaagcaaaaaaatctctctttatagccttggagaatatttaaatgggaaggaccttagaaatcctttagttagttcatgcttctcactttacagatgaggaaactgaggcttaaattaataaaatatataataaatatcagatgggaagaggtggaggggaaaaaaggaaataaaagaaaactgataaaaataaaaaagaaaaaagtatataataaatattaaagactggtgctttaattccggattttttgagtcttactttcttggtagtgttaaaggtagaataagctcagaaaacacatgggcagccgaaggcaaagttgcatctgtgtatctttgaaggaggccttgaggagtgaagtctcatatacccaaacctactcccaacttaagccttcggaattagatcaaacttgttccctcaccacaatcactggggtttcagctgccccctcccccatccccatataggcttgaatgcctggatatatcgtgtctatgccagtacattctgaggtctccatgcctttccctgaactgttgctttgcaagagttcacagtctaaggtgatgggcagacctagaaaaatgattgtaatatgttataactaagttcaggtaaagccctgggggagggagatgctgagtcctgctggggatgaggtataaaggaaggtttttggaaaattaaacaatgttgaacagcagttgactttcaactataaacctttcctaagcatctgctcagacaatggaaaggcaaaaatgcctgacatggcctttaagtgtagaatcttgtggattaagcaagtgcattccaggtcaacagaagagggacacattgtgtgcgggtggtgtgtgtatgtgaatgtgtgtactgccgggagcccaccaatggatacagtggccattggggtttaggggatgagtgacagggaaagctgtaacttctaagttttaggcttgatctattggtgcatggttattccatctttagtttcagaaaatccttgaggaggaggtaattttgaaggggtaggggtttggcatggcaggatagaaggtcagtttaatttatacttgctgaaagtagaatatataaacggctgagagtactgatccaggaaaggagggtggtcaccttttgttttgttttgttttttgttttttttaagacggagtcttgctctgtcgcccaggctggagtgcagtggtgcagtctcggctcactgcaacctccgcctcctgggttcacaccattctcctgcctcagcctcctgagtagctgggactataggtacctgccaccacgcctggctaattttttgtgtttttagtagagacggagtttcaccatgttagccaggaaggtctcgatctcccgacctcgtgatccgcccacctcggtctcccaaagtgctgggattaaaggcgtgagccaccgcgcccggccataccttttttatttgctttgtaattctgaatttgactttgtagaaaagcaagttttgagaggctttatttagattgatacctttgggagacttatcagtcagttcaggctggcataacaaaaaatacaatactacagactgggaggcttaaacaacagcaatttattttctcacagttctggaggctgaaggctcatgatcaagggttcatcagggttggtttttagtgaggcctctttcgtggcttgtagcaggctgccttctcactctgtcctcacgtggtcttttttctttagggtagagtcgagagagcaatctctggggtctcttccttttcttgtaagggtactagccttatcagaataagatctcacctttatgatttcatttaacttttattcactcctcataggctctgtctccaaatatagtcacattgtggggttagggcttcaacatatacattttggaggggggatacaattcattccccccacattcatgtatttcttcttttttcataaaaggttgtgaacaagcctgtagcctgtagcgtggtggcctgtaatggcagcactttgggaggccgatacgcgtggatcacctgaggtcaggagttcgagaccagcctggccaaaatgttgaaaccccatctctactaaaaatacaaaaattagtagggcctggtggtgcatgcctgtaatcccagctacttgggaggctgaggcaggagaattgcttgaatctgggaggtggaggttgcagtgagctgagatagtgccattgcactccagcctgggtgatagagtgagcctccatctcaaaaaaaagtaaataaataaaacatgaaaaaatgaaaggttgtgaatatgtggcagatctataagacttagcctttgtatcaaggtttctgtgttcacacctgtgtgggtttcttgtgataacagtgtagcttggtacgatgatctgaatatttatgcccccttcgaatttatatgttgaaatcttaaccaccaaggtgatggtattaggaagtagggcctttggttggcgtttaggtcatgagagtggagccctcatgaatatgattaatgtccttataaaagggaccccagagagctagctagtcccctttaccatgtcaggatatagcaagaaggcactgtctaggagccagaaatcgagccctcatcagacactgactttgctttgatctcgtactttccagcctccagaaccgtgaaaaataaatttctgttatttataagttacccagtttatgatattttattatagcagcccgaacagatgaagatacatggcatcctaaagcttccacccccgtgaccaggacttttctggatgtgtgaatcttgtagaagtcactttatccttctaagccctgtattccttgtttgtgaaatggagatcatattatatctatcaatcatctatgtgttttagctgattaatatttcactagactttaacataatcagatttattattaattgtactgtggttttattgtgtgcgtagctgctaagtacagcatagaaagcctttcttagtaaggtaactaaatatggcttagagccatgttgaagcgaacttatttatcataaggttatcaggtttagtaaaaaatcgcaaattaattttgtatgtataaaaatgcggaatacaggcaagtataaagataggcaaaatcatctataagcttaccacataatgagagccacacttattttgctttttatgcttccagactttctttgatgtacacatatacaccacaaaatgagttaatgatcatggagcatgatcataaaatcttttcagatcaataaatataacttcataacattatttttaatggctacagagttttctgttgcctgaatgtaccacagtttcttcaactatcctctattgttggacatttaagatgctttcagtttgatgctttcaataatgttgcccttaatatccttggccaaagttttaaaatgtagccttaattattttcaaataattgccaagttgaaaaatatgcattttttagaaaagcttcagtacatactgaaaaaggctcagttttgagacacatgcttcctgagcttgaaacaaacataacgagaaagagcatacatataggatcattatatgttaatttccatgcaatactcattaatgaaatgaactccaaagtggaggtagttttactcattagcacttgcatgtgagaaaacttcttttaaagttttactttctcaaggttttttgccatcaaagcctttcttttcattctaaaaaatcaattaattttaacacttgttttaaacaaatgtaggattctttggctacatctgttggcagctaccctttaacataaagggttatgtattttagtctcctgatgcaaattatcgcctctaactctgctgcaagttttccttcccactatttcaggaacatcattgcttttgaaacccaaagcaaaactccctttcaaaaaggcattgttaaagtgagcttgatgaggctgattgtttttatataatggcttggacactgtagtcttacaattttacagaatgcctttagggtttcaccaactggaaaggaaaatgacttcatggatgaagtatggactttaaaatatttccccatacagaaccaggagttcaaatccttgtagagttgcctaattccctttctttatgagttcaatgcattgattgctgtgtaatcaattgtttctgtgaccttgaaattcatcttgttagactcctgagctctatcaccttgaaactgggtcatctaaatgcctgtactagcagtccataaacttgtttcccagctgtaacttatacaccatggactattattaataattatccagttaagttttgcaccttcttcttaaaaaatatttttggcaagttatttttccaattgtttgcacagattgttgaacaatgcttcactctttctttctcaccttttcctagtccttttgcctctcccttctctcctgcctaccctggcctctggtctggaagacattgtcatttagaaacagagtagactttccaaggtcagtgaaaccagggatgtattttcttgaaactaaagcattcattctgctttctgtaactcttctcttcagcaataagagtataaaatcatatttttttgatttttttctatttattttatttatgaaacaaatactgtttattgtagaacatttggaaaatgcagagaaagaaatgctgctgcatgcaaagtaaacctgaaatcacatttggtaatgtctgggtgcctatcccctgtctcattgctgtacttgtaatgtacaaagtataaatgcaatgtacaaaatataaagagtattactctgtttgggtggtggtgctccccttttcctctctactgctggtccagaccaaggaaagtggtttgttggtaacgtcagaatcacctaccttgctgggtaaagcattcatttgctgttttagattgcatttctgttttgcttgggttgagtactgtcatctgtatgcctgtggagttacagcttcccacacactttattggcccacaaactacagctacttctgtccgcctccccggctcaacattccagttccccattaggactggcaccttcggctgtaactctgaaatcctctatgaatgagctcttgccattcccttcccttagggtgctgcaccctgtttctcaatcccacagaatcttgttctgaatcaccaggagcttgaatttggcttactgatctgactctaatatggtaccttcttaggggatcccctcgctgcttcggttctctgccctctgcctagatgtcctgagagcttgatgtcatcccacagcaagacttagttctcagtccaggcaaagtggcatatgcctgtaatcccagcactttgagaggctgagatgtgatgattgcttaaatccaggagttcaaggccaccctaagcaacatagcaagactttgtctctacagcaaataaaaaagtaattagtgatgcgtggtagtgcatacctgtggtcccagctactcaggaggctgaggcgggaggctcacctgaacccaggagtttgaggtggcagtgagctatgattgtgtcactgcactccagcctggaagacagagtaagactctctccccgccataccctcaaaaaaaaaaaaaaaaaaaagacagttttccacaacattttggacactgaattggccctacatcagtttcttttaatgtaatcccccgaattccagcttcttcccatctccctctgttgcctatgtcagtgaggtttcgacaagcctgtacagctctcccgtcaaagataaacagtaaggtctatgtcatggaaagatgagtccttaataaaagggagtccttagtagagggaatccttaataaaagaagcttcagctgttacccctggctggttatccagttgcagggactggaataactcctggtcccttataattctgaggttattgcaattcaacagtgattgcctttcctacttcacaggcaatgaaaagtttcttactatgttcccagtcccgtgcagagcatgacttggtacaggttttgtggtgtattcatctcttgaaaaaggttgtatcagtacagaaagaggggaaaaaatgagttgatcaaaactggcgtatttgatcatttaagttgtattggccaaattatttgttacatagtaatcctgtttccttctgtgagatgttatgacaactgaggacatgctttgattcactggctgcagtgcagactagttgggtgttcatttgttttgttttgcacgtggaaatttaagtaaccacaacagcagcaactggatattgttctttgaatagagagaattcattgaattaaataagaaaactgggctgggcgcggtggctcctgcctgtaatctcagcattttgggaggacgaggcgggcagatcacttgaggtcaggatttcgagaccagcctggccaacatggtgaaattccatctctagtaaaaatacaaaaaatagctgggcatggtggcacacacctgtaattccagctactcaggagtctgtggtgagaggattgcttgaacccaggaggcaaaggttgcagtgagtggagatcgtggtatattgcactccagcctgggcaacagagtgagactccatctcagaaaaaacaaaaagaaaaaagaaaactggcttgtaaagatgcacaagtgccaagtgccaataaatgagtgtaccaacacatctttcttcttctatctgctcccctcctccacacccttccagccttcattgtattgggggattacaagtcttcctaaatctgagtgttgatcctgtgatcactcctactctgaaaccaccattggcttttaaatattagctcttatttctaccactactactcccgtgactactccgcgttactggggccctgtgtcaaagctctaacgtcggtgagaggagtttacgctgtattttaggataggtctccaagctctttcttcaaagctccttcactattctaagaatctagctgctgtgcctttttctacacaatttaccctgccccaaaggccctcctgctggtcacaattttgcacattccacaaggttctacagaagcatcatttttttcttctctctcctaactcccaccagcattttgattgcgttccttcatgtcacttatgctgtgtaatgccatcttatcggacttgttagggcacagagtacagtattactcagtgagtaattgttctgccatttattagctatttgacttcaggcaaattaataatttttctctgtacttggttttctcatatataaaatgcaagtagtaatagttcctacaacatcagcttgtcgtcataagtaaatacgtgaaacacacatgaaccgtggctgggacgcagaaatcctgcaatcaatattagcgcttactcctactcctgctactgctgctactactcctggattgtcatggccctgtgtcaggaccttgaacttggtaaaaggagtgtaggctgggctctagaccccactttccccttcagttggatactctttttcagtgaacaacctgtacaactatatatggcagttctgtaccagaatctatgcacttcccaggctaagtctgtatttatctttgcattcactatagcacctaaaacaatacagtacatagagtcctattcagtcattgcacgccacgtgtgatcattgaaatgaacgaagaaacaaatgtaaaaaggaaaatgtaaaaatgtcaatatggttttatttgtaagcagcccattgatttttgaagcatactcaccgaatacatcatgtattttcagtgagaaagcagtatttgtcacaatactagaaatgtcataaatttaaagagtaattgagtctgaattttctgcaggtttatttactagatcaaagagtgacttcaactttcagtgcttattttatttgccagcataaacttacaggttcagtcaaatgccaagaaaataagttaataatctaaattatgcagattctggcaaattctctttcttttgggggagaaaaaaagagagagctttgagtttttatctcacttcagcaaatccaactgactataatagtaagaataaaactctagcaattaatctaatagctctaggctgctagtcattccagaaaagtgacattacacagaatatactagttactctcattgcatgtcattgatatataattcaattgattttcacattttttacactccaaaatgaaatacaacttttgtcatgtcaccagattggaattcattgacaatacattaacatgccaaaaataatattacacacaagaataatgtagaaataaattacaggtagagcagtatccctaaggagattttcatttgtgtcctataacagaagacttataaccctactcatacatctgtttcatcccactacgttttagactcttcgttcaattcaataaattactcattttgccacacactcagcactctgtcagttttgctgggcagtatacttacacaaaagagtctgtataattctaaagtataaccccccctttttttttagcaaacaaatacagagactttcatgcaaatgaatccttgaaaaagatagtctggataactgtaaggctgccacaacttttgtggaaatgttttggaactgtcttcttcaaaatgtctgggaccttctttttattgataatctcctcctcctccttcttcgtcatcgtcatctttgtctttcttcttccttctttcttcttcttcttttcgatggaatctcactctattgcctaggctagagtgcaatggcaccatcatagctcattgcagcctccaactcttaggttcaaatgatcctccggcctcagcctcctgagtagctagggctacaggtgtgcaccactgcaccttgctaaatttttaattttttgtagagatgagtggtcttattttgtggccctggctagtcctaaactcctggcttcaagcactgttcacctccttggcctcccaaagtacttgcattacagatgtgagccactgtgccaggcctggggccttctttttaaatgtgcttagttctgaacaattttgtcccttaaggtggatttaatttttggaaatcaaataattcactgaccaggctattgataaatgagatcagccatactgcgtaatattgggttttactcaagaacaatgagtgattgcaaagtaacagactaattttaggagtgacttttaaattgctttgagtgtactttcaagagaagtatttggagcactgagaacataagtggaagaagaatgtggaagatctccagcatccttggatttagctgtcaattacaatgctacttccatgagagaaggctttgttttttgggccttgcttgttttttgcaggactctcagagcctaaaactgagcctgacacacagttgttattgaaaggaatgaatgaatggattaaatgcaacagttcacaaatgcattcaaagtcccacggcatagagatttctctctctctctttgttttagcctttatggcattaatttaaaataatttatgttaaggtcgctatgtatttacctgatgagaacttggctttgtgctaagcactttattttcagtatttcattgtgtcaccacgacttggtgaaatagtgactgtcattatcctcttttcatagatgaggaaactaaagcccagagaagctaagcagcttgcccaaagtcacacagctaataggtgaggagtctggattcaacctgcaaagtctggccactgaccaagccttcacccttaactacaaatctgggctgcttttcagcacatctttgttgtcctgatttggtcatattctcacattatgtttcaatcattctaaactgggtatataataaccccctttgagagacaagggaattgaccaaagtacattgtttagagggattttctgaagaatgacttcatggatgaagcatggacttattattacctccttatagcctctgtctccaaatgtaatcacattgggggttagggcttaattattgggaattaatgaggatttggggaaacatctttcaagaatgccagggtctagtgcagagcatcgtaaggccggtaatctggagggcagccttcagtgagcaggttcgcattctagtacagggattaaaaaccatttctcatttaaagcccacatttccaaaaggcttataatctttagaggaatacaatacaagagggtgggagactgtttctaatttttattctgaataattatctgatctgatcatggacaagttccttaggctgccacattagtttcctcatctagaaaatagctaactggacaaggtcatccacagggtgcccggtagctcttaagtgtcaaaatgagtgataagataaagtgctcttttgccaaagataagaaggactatctttgttgacagttatctagaaaggcttccaagaataggaacttggtaaactgtagttaaataaagctggtaaaagaggaatgaatatcccttgagccaagaacaggagttagctgccacaccctggggttgaagagactgggtaggtaggtggagctgagttttgaaagatttttgaagagcagaggaagagtttggtctctacccctggctcgttcatcagatatttcttgattgccatctatcttccagccattgagagccattgatcatgtaagattctttccctactggagttgggaaagatatttcatccaaccaaagggaatgtgcccttgatatgaagatttgtaatgtttaccaaaaaatctttgttctaccactttaggcatagaagaagaagataagaaaagcctcacagtaaagttgacttgcaggttatatttaaaggatgattgtctttatttgaacaaaaggagaaaataacaaatccgttgtttgaagaggaaaaaaaacagaaaaaaagaagtgcctttgatttggcataattgatgctttattgctttgtagataggtggtttagggcattggacaaaagacgataatgtttatttagatttgggatttgggactgttctagaaagtcaatatatggttgttacttttagtagctgtaagaatggcataagataacttagtggaaggtgagtgctttctgagcttttctgtctgatgatgaaccctagtggttgcaaaaatgagtttataccttagaatcatttgaggtactgattacaaatgtacacttttaacatcaatcctcaagactttagagtttggagtctgtgatctgaatttttcacaagctcctaggtggttctgattaatttaggttgaggaacagcattttggaagccacaggtaaacttgtgtattgcccacaccactaaggctgactctggatgacacccagttgaaagtgatttccaggttcccttgctaagtaaaagatccaagagagagaatagtgctgcttatttctttttaactggataagattgaaaaggtctgtggatccaatagcgatggagaacgtgcagaagctgcaccccgaattgccgatgaagttaatcccagacagctagaaattagccagtatagcacatatgcttagattggatgctgtgaatatatgctttctggtcaacaaaaaagttaaatcatgtagatgctcaagtgaagagcacctctgtcgactggaaagagttgagttatttaccttttttcccccagaaactgtttcttgaggtggaaaagcaactggaagtacaactacacagaactgaaaggctattgagtttgattatgggcataaaattaaattttcagctaaatgtgacagccctagtagaacaaagaagaaccaatcaaaaagttattgactattgagacttttagacagagctaacaaattgaccatgggttccagggatagtcacagcctggaagttgcttattctctttcttctaaaaggtagggaagttcacacaaccacagccactgtagccaggccagggaagaaggccaatttaggcatttaccagcatgtgcaagatgcagtttttcatctgagggggtgagaccttttctaggtgcctgtgttagaacttggagcacttgcaggtaatgagaacgcattccaatacaagaaaaacctatttagggcagtactggatatggattagccaagaagatccacagatcaaaatagaatccagggcagaaacagagcagagaaatttcccagagccacttatgggtaagtggaacaccaatgatttactaattacaggcatgtttttgcacaaattcattttttagtaaacaagatatgctttatgctacttgcaggccattcttaaatcattcttttgggaatccttataaagacatcagttaaaaatctcatctgttatccttcaagagaagtagttggcatgatttttgaaattgagtccctgcctacctagattcaacagattaaatatgaattatcagtggataattacctagggctgttcttatatgtatattttatttccttaagtgtgaagcacatggagtgtcacgcagatgtgggaaaaggtaactcacaaggatcttttgcccagaactcttctggtagggcgctgctggctcttccagtatgcacccaaggtggcaaagagtctgcctgtcaatggtatccagaagtgacagtggggatagccctggagaaggttgtttggattttcataagggagagattctctctctgatctttataatctgaatcctaccctcacaggctttttttttttttttttttttttttttgacactagtcacaaaattaacagtcaggatgcttttgaaatcagaacaatttccctggaggaggcacagcccccggtaccatcattattatatatgttttgaaactccatagactggaactcgttcagcgtgctgtaatctgtgtgtttagaagctgtattgactttaggagtcacacagatgggtgtagacccatgtttcaacatttttctttcagggacacacctttgaaattctgcttggaacatatcagcttcctcctccctccgagtcatcagccatctcagtgaatagcgcatctgcatcctttattgatacatacgggggcaggggtgagggcagttactgcctctgcctctgttttctcattcaaatattagcaaaggtccacaaacagaaatagagaaaccagattaaagaggacagattgtatttatggtaggctgtaacacattttgatcaacaacaacaaaaaagtttttggagctatggggctgcctgatggtaggatacatactgggtttattataatgcatgtacattgttcaatgtaactttcccatcatttttatgccaaggccatatgtatggctcagatgaaatgtaactggcaatttttcattgttgttgttctttatttacctttctcttttaatcatctccctgttccaactaaacaaatcacccccaaaagccagtgattaaacacaagtgagttcaaagagccaaggcaagtctgcccaagagtggccgactccccctacagaaggccaagtctgccaattgcagtcttcactcagagcctggtagtaaaactgctgagaataaggtggtttcagaggcaaacagtcacctggcccagagggcttctgcaatggagccccctcagaagggctaggctatgtgagaagtggtgggtgttggccgtgtcaaacagctccttccagtaggcatccaggaactgagtggtgtgcaccccttaggaggccaagcctaaggcaccagctacagacaaggtgcccaggtggcagaatgcagcccctggcccggccaaggctgtgtggatctataacagacaattttggcatgactgcattgactttcactctggtcttctgggttctaaaatgttggttccttaagtaggaactaaaagttaatatctgcccttgtgatgactaggaatttggttaattcatgtgcctgcttagcaaattaaaatggccagtaatcagaactagaatgttaaatctcaactgatctgagtttttctcatcttttgatagaataaattgaactatctggctgggcacagtggctcacacctgtcatcccagcagtttgggaggccaaggcagtcagattacctgagttcaggagttttagaccagtctggccattatggtgaaaccccgtctctactaaaaatacaaaaattagccacgcatggcagcacgtgcctataatcccagctactctggaggctgaggcaggagaattgcttgaaccctggaggcagagcttgcagtgagccgagatcatgccgctgcactccagcctgggcgacagagtgagaccctgtctcaaaaaaaaaaaaagaataaattgaaatatctgtgtgacaattgcctggtgtttgaaattccccttttcaaacatcccagcatatttggtttgtctcagtgagctctcctttgaaagagcactggctactcccttggtaaaagaaaggggtcagtgatggggctgcaggtccttgttcctgacacgttttccttgggaaattcagtacaaggtatttcgtctctcattcagtcatccctttgctcagcaaatatttgtctttaaagactctcacgttctctgagaagaaaatcatggccttcgcacaaaaacaagaagattctatttagatttgaataactaatgtaaacaataaaaataaaatagacatttacatattttatctatatctagatacatagaaattagttaggccgaatgtatgtgtgagacagatagatgagtataactgttttcatcctatttatattggctttgttcttcaaagaaaaaaaaagctttttagatactacaccaatgaagaaaaaggtatcatctagaatcagccctgagatgaaaaagaagtgtgcttatttatataggaagtagctttgcatacttttcctttctgttattgttcaatcttgaattaaactgtcttttatttttctacttccatttgtgattactatgaaatttctgcctaagggctgccaggaattttgtaaaaattaaacaatacaaaattctttgaaagaggattttgagtcccaggcatgctgactttttaagctcaaaaagtacgcgtggcttttgcaagcagaagcaagtcctaatgctttgaagaatgtaaaatataatcagtatttcagaggcattgaggtggttaatctattaatctatactagggtaataaacctaccagtataaacatctgctaactagaatttggagctctcaccttaccttagagagaaagtttaacctaattctgccgtttcaatactaatcatgggttagatttttttcattgtagatctcacttgtccttgctttcttgagtagtcttagagcgtatttgtttgctgcaattaaagcagccgtagtctgattattttcttaacttgattgtaactgggtacacttggctgatcatgtgactctctaaattagctgttataagttaattcccaagcctttgaggtgtcaactctgtcctcagccacttagagctaatatttgaaggacctccagggtacttggagggggaggtggtggtgcttcaagaatcccatttgcccacagcacagtggaggagtacgatctgggctgtgtaggaggtgctgatttttggactgaaaaagcactgaccccctgcagaccacgatgtcctgctgtgattcttcccttgtttgaggcagggctacagatacaccccatggagccagagaacagaattccatgtgtcccccaaacccaaatcatatacccaaagccctgagccctcagatttaagaattcctagcctagtagctttttcgggtggtttctctgctcccaagaaggatgtccaggaggtccatgggcccccagtccccctacttcttgcagggtgctgccctgtggcagagccacctctaccttcatgcctgctgcagggattcacccatccttaagtcctccagcccgttgctggtttgctccattctagaatttgcttcctactgcgcgcaaatgtttcatgttagagaatggtaactgccatctctataatggttaatgccgaacatgactgcagatgaaagtaacagtgtgatcacatcctttctcttcctgttctgtggcatgagtcagtctctttgccttaatgtttatacagatccttaataacaaataacagctgatggcgacttgctgagacatgtacaataaggaaagaaattacatcgtaaaagatttgggctttgtcccaattttttttttaagagaaaaaaaaaaaagcagggagagagaaccttgttctaataaccagtttgtgcaacaatgttccttttttcaaatctaatgaggtctgatccccacaagtattatgatttattacctgcccctactggactgtttgcgttgggtgtttattatttggatattcggttaacataacacttgaaataatttcgctttctgaatctgctcttctctctttttcttgggtggttttgtggtaggtcggacatcctcagatgaaaataactcacaagagagccctttttctgttatcagtgttctgtcttcatgtccaggaaaatagactcgtgggtttcctcaaatgtaggggaaaaacaaaagttgtttgctttgtgtctaaaagttccatggtgtcacacctagaaaccctcggtgttggagactggtgcttcatactccattgtcagcaactttgcagaaagtgttgtactaaagctactacagtgagcaagcttatgcccttcagcgttgtctcaaattttgtttttaagtccaggcgtaaagataacatgtgataatgacctctccatttatttggagtcacagatttgatactggaggatctcaaagcattaggtcaaaataattagctctgtctgtagaataatcaactccctctctgcctggatgcaacagatttgtaaccttgttttaaaagctaggcgtttccattggtacaagtcagcgtgtttaggtgtggagagagttggcagcctgcagggaggggtggctgtttcccagaagtcacaattcctggtggagagaggaagctgtctactcagtttccctcctgtgctttgtgaatggtgaccgccccttctcccagcctctccagccttcctcaaggtggggcaaaatcagccccctgcagcaaagtccctttccttccttcctgtggagacctggaatttttcagtgctttcactactgaacatttctgaaatctttttttttctgatgtcaagcaacagtgtcatgtatgtaaattatagaaaatttagaaagaatagactattgcagtaaaggaaaccatgcacaatcctcttactcatggaaaacatctattactatattgtatgtactcttggagtggtttttaaaatttttctttaaaactttttttggcatatacgtagttttttgttgttgttgttgttgttttgttttgttttaatgatccatgcatttgatgtatttgagacctgtaaatgccactttgatctttatctggttgtgttagagagtatgtcggacagaggataagagcatgcctttagttgtgtgggccatttatttatttgaaatctggaatgtagcctatttggtgatggcacaggagggcatggaacccagaagccaaggctaaaaaatgtatagaagtggcatcagaggatggggaaatggtgtcagggaagcagcacaggacctagaatcagaaaagccagtttctgctcctgctggctgggtaatctccctgaaactcagtttcctaatctgggaaaaaggagaactcctaccttaccagttgtattgatgattcagttaattaaatgaggtactgtttaggaaaatgctttctaaacaagcactgcaagactcagataataatattataatgaaaaagttgttcagacttggctgtggtgattcaaagggaataagattaaggtgagcagttggtggctgggatttatagtcttatgtccatgagcagagaaaacgttgaattggctgctcgaattttgttgttattgctgttgctgatgcatctaatggttaatatacacttcctgtttaaatggttaccgagcctggattattactagggaggcagcgtagcaaggctagtatttgctattttatgctggtcaccctgtcttcttgagtctgtgtattttttactcaatgagtacattctcccacaatgctaatatgtttgctctttcacctaagagacgcttatcagacttttactatggattacaggcctttgtatcaggaatcttgctgcatttacacaagagagaatgagacaggcataactctatgttttaaacaacagataaggtttgtctgctgtgtgcacagagaaggaaggggaggggaaacggcggggttgggggtggttaggtaggggtggggcctgggaaagatgtataaacacttttaacttgtgaaagaatgtctttgtctctgctcatgagcctcagaaattggcgaaatattaaaaggaggggtttgcagggcagcttgtgagctctggagtcagattgccttggactccaccctgctccgacagttccttagccatgtgacagataagttccctcatctctttgttcctcaatttcctcttctgtaaaatggtaataataatacaatgaacctcatcgggctattgtgagataaatataaaccgctgatatcttcagaactgatccaggccaatgttatgttgaatccttaagaaggatttgagaaggtggccctgaggaagcacagacacacgctcttgccccattgtctgtaactgcccagtgtcgggcagaccccggtggacctccccggttgctggggctggggcctccatactcagctgtaaatgaccaggtgacaatgagagtggactctcagtgggcctcaccacaggagcctctgtcatatggggctgaatcattgtcctgtatctggagattgtgaaggtctgtccagggcatcttttgaggaactgtatctatttcagctacctctttagttttctatttctctttttctctccccttcttcttaatattttctgatgagagactcggcaggtgaatatgtgcacgtggacattaatcagaggcacttgtcattctgaagaggcctcaagagccgaacagggttattaataagaatcctctaaaccaagagaacatggagcatgttgaatttatccaatttccacaacgttctagtttattcctatgttgttgtaaggacaaagtagtagattcagattcttttttttccttgagacagagtctcactctgttgcccaggatggagtgcagtggcgcgatctcggctcactgcaagctccgcccgggttcacgccattctcctgccttagcctcctgagtagctgggactacaggtgcctaccaccacgcccggcttaatttttttttttgtatttttagtagagacgggggtagattcagattttaatactgctcattttaaacgtgtttgtgtgtcaattttttttttttttttttttnnnnnnnnnnnnnnnnnnnntctggctatattgcccaggctggaatgcaatggcgcgatctcgatctcggcccactgcaacctctgcctcccgggttcgagcaattctcctgcctcagcctcccgagtagctgggattataggccctcgccactgcgcctggctaatttttgtatttctagtagagagcgggtttcaccaagttggctaggctggtctggaactcctgacctcaagagacccgcccacctcggcctcccaaagtgctgggattacaggcgtgaaccgctgcacccagccatgaatttttttttttttttttacactagattgtgttgtttcctgagcacacaggagaaaggtggagacctttgagacgtgtatatcaggctcatgaccttcgagggacacatgtatcctgcctgcaaccttcgaggcacacgtgtattgtggctgtgacctggaattacactgccttacttcaaatcctgacactgtcacttattagccaaatttactcaagcaactgcttaactgtatatgccccagtttccgtagcttaaaatggggataatgtgtttccttattcataagtgtcttatatatttagtatgattatgtatataaagtgccggaattacactgccttgcttcaaatcctgacactgtcacttattagccatatttactcaagcaactgcttaactgtatatgccccagtttccttagcttaaaatgggaataatgtgtttccttattcataagagtgtcttatatatttagtatgattatgtatataaagtgctgagccataattcttcaataaatattagttataattatttttgaaatgtgataaacctcaattggactcctgctttggctatgtaaccagttggacctttgctaaacctcaattttttttatctagaaaataaaatgggaaacacagtatctaatagagagttataaaagaattatacattatttctatcactctggagacacagtccctaaaagtactcggtagaccctttcctatcctcccagcttcttttcttggcaacgttttattttttttcagagaatctcagttcttccctgtaagggatataggctccaactttgtttcctggagaggactcaggtagtggtgtattgagtgctggtgccaagtactttgtgggcagtttcttattattattcctcacttaatatcaaccccattttgctgaggaagccacagctgagagttaagagccacatctcgcctgctctctcaagtggcagcaacatcattcaatgtgtttgtctgactgtcgagcctgtgtctaaccactgagtcgttcgtcctccatcagatcaaacctgggaaaggcgtgacagtgagcatcctcactgccggaactaatggcacggaatcaaggacatatctctctctctttccctcatcttttttaaccgaaaggaaatttacggagcatatggtaactcgttttcctccacagctctactatccagaccacgagtcagaaaattaaccttttaacttaatctacatgttgtgcattgagtctcacgcctgttttcatctgcctaaatggggagttccatgcagcgtgatgggtgtcctctctgtgctcacattgccggggacagatgatttgcagctgctctgtcctgaggccattgtgaacactgaggtccctgacaggttggtctagtctgcatcgtcaatttttatcacattcttttatgaaatagaaatttctatcatgggcatgtaatttggtgagcattgcaaatagtaaactctttcaaaaggctataaaattacatatttatagatttataaaaattgcctctttttttctctctccagcactccttccaggtaaataagacaataggatacttttgagaacttaggagttataaaaatataattgttacttggaaaacttcattttaaatctctgaattgggaaacacataccttaagtatgagcatgtccattttaattcatgagcagtagccgtgccgtagccatcacatcaagcttttgggtgctaataagcatcaattgtgtggcaactaatccagctggtgtttagtaatgtaaatggagacgtgagatgtttttatatgttgtatcttcccaggttaagtcaagccgttaaagcatatttgcaccttatgtagatgattaagcatttggtaaattctgaaaggtcactaagtacaatgtacttccttgtcttccccaatttgccttttcatttgacataggctttgttaggaaattacagccgcttttcccaggtgacattcatccccatgtaacactgattgtaagtctaactaggtgggttctaatgacttctactaagatgtaacatggaccaaccactgcctacatcctcattctcattctcatttcagcaaaaagtcctgaaaagataggcaaacactggaggaaccatagagacgtgtcatttaccactttccctcttgactgtatataggtgattatgctttctcaagtttcacttgttctttcttttaccccgaagcctagcattaaagggtgctcaggcagtacctgatgggttggatactggtgctaagaagtggagttagcatccggcaggagaggaggcagcacacggacgtggctggacatctttgctctggagttttctcttggcatctgacttctgctccgctacttcatgaactttgcattgccctctgcaagtccagcatgatttgggtgcctcagttttctccattggaatatatgtcatttttttcctctccttcagaacgtttctcaccacaaggcattttatatatatatttgttttgctttgtttgtttctttccactcccctctttttccatcaatttaacaaaaggggtttgaatttatcccagcacctaggacataccaggtgctcaaaaaatattctactgagggccgggcacggtggctcatgcctgtaatcccagcactttgggaggctgtcatttgagttcaggagtttgagaccagcctgaccaacatgatgaaaccttgtctctcttaaaaatgcaaaaaatattagccaggcatggtggcacacgtctgtaatctcagctacccagaaggctgaagcaggagaatttctggaacctcagagatggaggttgcagtgagccgggatcacaccactgcactccagcctgggtgacagagggaggctctgtctcaaaaaaagttactaaaaaatattctggccaggcacggtggctcatgcttgtaatctcaacaatttgggaggccgacatgggcagatcacctgaggttgggagttcaagaccagcctgaccaacatggagaaaccccatctctactaaaaatacaaaattagctgggcgtggtggcacatgcttgtaatcccagctactcgggaggctgaggcaggagaattgcttgaacttgggaggcggaggttgtggtgagccgagatcgtgccattgcactccagcctgggcaacaagagggaaactgcgtctcaaaaaaaaaaaattattgactaaatatattagttagccaattaaaaatagcccctacttcttagcgttgttgggggtatcaaaggaattaatgaaagtgcacatagagagccccagtaactacttgctattcttattacccaactgatcgccagtgttctcttttgtaagtgaggaaggtatattggaagtactggggttttcaaatgctgcataaggacagacagtttaaaaaaatcttttggctgggcgtggtggctcacacctgtaatcccagcactttgggaggccgacgcaggcggatcacctgaggtcaggaattcgagaccaattcgagaccagcctggcgaacatggtgaaaccccgtcaaaaattaggtggatggtggcacgcacctgtaatcccagctactcatgaggctgaggcaaaagaatcacttgaacctgggaggcagaggttgggttgcagtgagccgagattgcaccactgcactccagcctgggcaactgagggagactccgtctcaaaaaaataataataataataataataataataataataggattttatttttattgttgcctttgatttatggcaagttgcttttgacatatcaagaacataattgaactctcagaaggtaaaactcataaaaatgaagcataagtaaatgaagtgtgggaaaccttgtttgaaacacattttggggtgagagtgggaatttattaggtaagccagttcggtttcagagacaccagtttcacttagtgttcaaatccctgtaataatgagtggtgtcgtgtcaagaatctgttaccgtatatcatttataggttggtcattgaacaggtgtttttagctaagttttgattaattgtgcctttatgcactggaccaatcctacagcttaacttcgtctttgtcacttccctgtgcagttctcaaagaattcaaacgtgtgatattgacaatccaagactctttttccaagcctcattttccttgataccctatctgatggctggaaattctgctttctcttgggtttcttcatgcaccttccccgttcttcaacgatgaatgtagcattatctgtaacactgggcctcaaatttatctggtgcctcacatgtatgggcataactggcaatgtctatatcaagggaaaatggtgagaattaaatgagaatgcatatttgaagtgcctggcctagtcccaggcagtgctcagtaaatgctagttcccttttgctctgtatttccggcctattttgggttttttgtttatttgtttttttgtttgtttgtttttaatttattgagatggagtcttgctctgtcacccaggctggaatgcagtggcacaatcttggctcactgcaacgtctgccacctgggttcaagcgattctcatgcctcagcctcccgagtagctgggactacaggcgtgtgccatcatgcccacctaatttttttctatttttggtagagactgggctttgccatgttggccaggctggtctcaaactcttgatcttaggtgatctgcctgcctcagcctcccaaaacgctgagattataggtgtgagtcattgctcctggctttgtttgtttgttttgtttttttaattccatattctccaattacctctgacatatggtatttacaaggttcttccttaaactttttctgaatctacagttcatgaactcctgtgacacttacgcttttggcagatattttccaaatctctgcctctagtagtgctgacctccagacctgtctctccaattgcttcctgaacatctcaactcaaacatatcatgacccactagctgacctcatgcccttccttttgaaactgacatgtcttcctgtcttccctattttggctatagcatctctactgtctctggcatttggtctgggaaacttaagtccagtttcaattctactttttaaaatatcctgtaacatctaaatggaaatgagatcctcccgttgcactggtcttagatagagctttcttcctttccttactcaagggcaggtttggaatgaagttggattctagaagttaggccaagcaataattagttcattgacattcacaacagtaggtaatagagtccgagggttgagaatagggaagaattcttacaagaattatccttgggttaacactatatggtccaagccttgttgtgtatgaaataatcagaatttcataatttctgtttcttcaaaaagtagttttaaatgttgttttctaaaaagcgtcaaagggggcgcaatataacaaaacataagttatagccaatttcaaatgcatgcagatcctaccatggttaacaaaatgcaaatatattttaaagacttattgaatgtgtagtagccttttgtcattctatactttttctaaaaattcatgctaaaagtgcaactggcagaggagtttcatgaaactcttatgatgttaccttatgaaatatgaatttcaagaatgattgatgattttcatttgttcagcgtcaccagctcatagaaaacaaaatcagagattacatgaattttcaaaaataggatgtgggggaagagaaagtaaaattgaaagtctctaaacacttggctactcagtttaaaacttctgcttcctaaagatacatctattatatttaagataagataataggcactgtctgtgtttctctctctctctctctcccccctcttgctctctctctctctctgtgtgtgtgtgtgtgtgtgtgtgtgtgtggttagaggaaataagtcttacactctgggtctaccagttgcctactggataataaagtaaataaatatatgttcaaagacacatatatgtgtttgtatacagaagtgctgtgtatacagaaaacatttgaattctgattccccagtgtagcaatgcttgatagaaaaggtactggctgattttaggctgtgaagagaagataaaatttcattatttgtaggtgatgggaagtgtttaaagaacaatccaagtgagaacaactggtactctgtctggtttgattgaagtgcaggatgtttgagggacaaattggggctggctatgagaggctttgagcttctctgttcttctggttgaatcctgtggtatatacagtggggatcattgagagattttcaatacaggaatgacatgatcagcatgaacatcatactttttaaaaattacacaaaatgggtgtttaaaagttaattttaaattttgataatggtcagtaaacgaaatgggagaggaagcaaaagagaaaagaagagacaccgagaaactacagaggaaataaagaggtctcagtccagagggagagaaagggcgaggctaggactctaggttgcattggaggtaaactgcttttgtttatttgggctgtgagtatagaatgcttctttgccttgcatttgaaaggctgatttggttattctaccactatgtacaggcctttttaatgttctttgtttctaaaccctgagtagctcccttgctaggggatagtaacttgtagggctgactttgagtggcagaggcagaaacattaatatcatccatgagcagagtctcccaggtagcatgtccttacattaggttggttgttgcaaaggtaattgcggtttttgccattgaaagtaatggcaaagatcgcaatgacttttgtaccaacctaataactggagcagaggaaaagaagttctgttggattcgtctgaagagctgaaggaaaggaactgggttttctcactgttaattgcccctttctcatctcaacctggctcctttcctcagattcttgctttggaatcaccatctgttttccactccacagagctttgggaggaatgtcagctctgttgtctccgacttaaggtccaaatgccccttttcagaaactgtccatcatttaaagttcgacgagaaaacttggacttgctttgtggccataagaccctatattttcagatttcctatagactatgttttgttatatcctgctttaaaaaaaaagtgtttaaaactacatttatagccaccctagctgttgcactgcactgttttttggttaaaacatgcacctgctttgttagtaaaggaacctttgccaagtgaattgtatgtgggagggtgtgactaactctgcaaagggacttatctcttatcctatctgcctgagctcccaaggctgcctttgataagatttatttcttcttgcaccagccccacccctccaacctttactgctatctttcctctgaaaattattcatatctaaatattttaacttttcaaaactactctgctctctggtttcatattttgttgagtgatctaacccttcctctgggagacaagtgctcccaagcaagagagcattacaattctgcctcccctgctcctcccaccttttaagtattatcagcagacctgcttgcttacccgtgttaggattgtgctgtttcctttttggcaagcttcagccaagcccataatgttgcaaggctgtttgaagggaaatgtaagtcacaatggcaagaaacatagaaacagaaaacataggaacagaaaaagaaaagtaaatctgaaatgatcttcgtacagcttggttcacagcaaggagtggtctgagttgctttctgtgtctagacatttagatgctaaaggcaactgtgtcatcattcattcattcattcgtatacttagtctacatatttgtggtgagtagccatcgttacaggttacaggttaccaaatgttagagatgtaatagtaaacaggatgggcgtatttgcagctgctatggatctgagagtgtgttctgcaaagggtgatagacatgaaacctcaaaacacacagttcatgactggattacagttgtgcagcaggagcgggtaaagagcggggtctagggaagagagatttcctaacctagactacaggcatcaggagaggattcttgtttcttacaagctggaggtgaggaccattttgcattggaggataaggactgagctcttaaccacagaagccatggagtggggagggggaagcatgaacagtttcagatctgaataaatccactcaatttctcagttttcctgaaaaccagctacctattttctgcctcccaattagatgaaattctgttctgggaggaaacaggaaagtaaagacctcagttgtaaaacaacactgcgctgcccacaccagcagctacctaatgtcaacctgaaacctcataactcacttacttcaatggctgttgacaaactcttgtcagctgcacccttagttccggtttgaatcacgctcaggaagctggcccctcggctggcttcctcaagttagtgggtgctgtcatgcagctgctatcaaggtgtggcccacttgcaagtggtcaggacccagggcctggtggccaagcctcatcaaagctgttgtgatagcacatgcgggtggcattcttgagctgggaagtggtgtcccagtctgcttaagtagatgcagacatgactcatttggaaggatacagccaaggggaaaatcaaaatttgctttgtatgtcacttgtttggaatcttaagtccacttaaataaaaaaaatgccctgcaactgtgaggaagagcagagttagtcctttatgtcacttacttggaactctcgactcccggctcgccctcctccaccctggtccaggtggccatgccctctctgctggatctcaagggcctccttacaggtcccctgcttctaatcatacttcctgtcatccacgttctaccagcagccaaatgaatcttttgacaatttgtatcaaatcatattgccagactgagaataaaaactaaactcctcactgagttaagggcctgtgggctcaggatgaccactctgatctcaatcttggcatgcctcttgcaacatttcctagcatcagtaatcttctgtctgtctaatacatgcctactgtaggccttctgcaactttctcttcttcctggcatgctttcccatgtaatgttcacaattgctggccctttattaattgagatcccctatgaaccaccttcccagccccatcctcagtctctcatattaccaggtttattctcctgtacagttctatccctgccagtagaatatgtgctctgtggaaacacaggccgtgccagtcatcccttccctatgtcaggcacacgtaggagcgctcagcaatacatgtggatgaatgaaccttcacaccatagagcaaagacatttgtttccctcttttttctgatctgatttttaataagtgacaaaaagagcacaggagtgcttgggaatctctgctaagacaggtaagagaaatttcaataaacagtttggaggggtggatttatttggggaaaaaaaaggaccttgctcacagtcctagggctgagaaagtgttggagctcagttcctgagctccataaatgagtctgcaccagtcctggaaggaaagataaacgtgctggactaatgtgctcaatggcatttgaactgaattgtaagtgactttggggtttatcagagcatcctaggttatttgagaatcactgaatctaggtcgggcatggtggctcacccctgtgatcccagcactttgggccgaggcgggccgatcacctgaggtcaggagttcaagaccagcctgaccaacatggtaaaaccccatttctactaaaaatacaaatattaaccaggggtcacggcggacgcctctaatcccagctacttgggaggcagaggcaagagaatcacttgaacctgagaggcggaggttgcagtgagccgagatcgtgcctctgcactccagcctacaggacagagcaagactgcgtctcaaaaaaaaaaaaaaaaaaaatcattgaatctatcagatcatgggaaccgtatagacttggaatttttgaggattaaaaagagatattttaaattatttagtctggtactcttagaggaaactgacccctagaaaccttaaattgttaaatgttaggaatggaatccaggtccccttttcacagagcctggcctcttctcagtcactgtatttcagccattcacttcctccacttctacatagcagggaacggattcctggttgtgtttttgacaggagaaatgtaaccttaatacagccttgaggaaaacatgaaggtgatcatccatctgccaaaatttttaatgctatgttttgtttttctttcttttcctgggggaaggatttatgacttcatcttttttttttttttttcccttcaaatctgagcctctttagaaatgatcctgcctcaaggctagggggaaaaaatcctattttaaaaaataaaatgtagatcttcttatggtctgctttccagacacaaaagagatctatgtcttttattattattatttttgagacagggtcttgctccgttgcccaggctgagtgcagtggcacaatcacggctcactgaggccttgacctcctgggctcaaaggatcctcccacctcagcctccccagtagctgggactacaggtgcatgccactatgcccagctaatttttaaaaacttctcgtagagacagagtctcactatgttgcccaggctggtctcaaactgctggatgtaagcagtgttcctgtcttagcctcccaaagtgctgggattacaggcatggtaagccacccaccgtgtgtgatgtggccaggatctaattttgattgttgattaagagtactttttaagtaattttcaactgttttgtgatatatgaaaaagaagactaattaataatgagatatcaaataatgtttcttaaattgaggtagcttggctggccgtggtggctcatgcctgtaattccagctctttgggaggtcgaggtgggaagatcacctgaggttgggagttcgagaccagcctgaccaacatggagaaaccccgtctctactaaaaatacaaaattagccatgcatggtggcgcatgcctgtagtcccagctacttgggaggctgagggaggagaatcgcttgaacccaggaggcagaggttgcagtgagccaagatcgtgccattgtactccagcctggccaacaagagcaaaacttcgtctcaaacaaacaaacaaaaattgaggtagcatcttgtaaatagaatcctagaaaaggttttcaacttcccatgccttttatagtcatttttgaatgttggtctagagatctgcttgggatgagtaagatttttttgtacatctgagataaatttaggttgttagtgacatgctgttcttttgtatttgataataagcctgatctgtttctcttgctttctttaaatgggtcagttctggcttccagctcatccatgttttacaaagaacagttgttccactttttcttctctcatgaccaaacactttgggagcatgtcaacatcatggtcttgtttttattatgagtaatatcaatttttcacccatcgtttgtgtttaatatttgggatgagaaacggacaaacaaatgagcagattctgacttggtatttctcctgcatgccatttgtgatttataatttatacatggaaggatttactgacctacctgatagtccctcccaacaaagataaacacacttacacgtcatcagggtaagtaagatgcacttgaaagggacaaataattcacctgcaagcacttttggcttcatgccttttcccatgaatttgaactgttgacagagaatgctcaggctgccaaaacacttcccacagaacctcccaaaatccccgaggttgggaccagctccacttgccatgctgtgagaaggactaaacactaaccttttgtgccctacaagagtgcatcacacgaaagcaagaaaatggtccacttcctttgggattcaggtctggggatgtgctgctctcctctgttcccttttgtggatgtggtcctatgaaaggctcacctgtaaggctggacaaactgccaagtcgtccttgtcaaactgggtgcagaggaccttccactgtcacactgtgtatttcggctgccgattcaaaccgatttcttgggacaatgacccatcaagctgaagagttcaaaatgcattaagtagattttcaaaccccccctcccccggcttacaggagtataactgagtccgtgggaaagggtgggttgttgccagcacccttttgtacttttaagaggaagatcatcgtctgttatcccaagcttttggggctctcatctttgctaccatccctgggacttctctgtactgtaccaaaaacagacagtgcaaattctccataaatttcacttagtctagactaggtctcttcagggagctccttgagaatttttattttgtgctcctcagacataagcaatgttgaaagagtcaaacacatatgatattaaatgctggcagaaagttgtgtaaaatcattagtccactacatgcaataccaaaaatagatgtttaacctgatcgtatctgttaaatataaaacactttttaaaaatcttgtgtgctcaaaaactttcagaaaatttttaatatatacactcattttttttaaaggtgacccatcagaggagccaggattaaaaacctcagcagagaatcgtaatacgttgctaataactgtagcattggggaattcagtcttttaaaggttctgctttttgtgtgtgtgattctcaggccccatcaacataacaaaaaagaagaggtgcactgagcacttattactgcagtcatttcagctgcataaatcatgattcctgacaactcaggctgtaaagtcgtttggatgacaatgactagcaatgctgctgccggagttaatcaaataattatttaacatgtgtttctcttggtctggccctggcttcagaacatatttcattcgttcccaggcctctgtagtgcctttacttttaaataaatggaggagctgagcaagtgtaagatatgcataaagttaatgacagaatcacttatgtctcctattggactgtgctctccctcaaaagaggattcttgtctaaattagtttgggtgatacccacagtacccacctcagtgttttgttccaggctagcagtcactattattttagcttcttctgggtgaagccagcttcctggttaaactctttttctccaggtgatactcagggggcaccttttctttcgggtggtttttctattccattacctctgcaagcagacagcctgggttaggtgcatgggtgaggtccccaggaaagtctcaaagcacctctgccagagatcactccttaaaatgtgagaggaagcagtggtctgcttccttcctgaagggaacagcctcatattcccagccttttagctcttagtatgtgctcaataaatagttgctctcattattgccattactgttattatgtaaaggcttaataaatgtttgctaaaacataaatggcccaatgaatgaataaatgcacatacctaataagggatgaaatttctacataatgacgctaatctgcatagacccgtgtattaaattcagacgggctagtgtgaggagaggaagaagaaaagaacagctgcttcctttattcagtgccctgacctgttatctgtaatcaggggatgtataatgagccactcatctttatgtaccccaaatatcaaagggtgaagaaaacaatagcaactcatcaaaaagcttgatcctctgtgaaatgtcctgggcaatcaagttaggtgttagtgtctcctgatttgcatttcatggctgcgatgtgctagcggtggtgaggattgatagtttatatggcagcacttatttaaatctttcaaaagtattttcagatattttcagtaattttaattcaaattaatggcaggggttttcttacaaaatatgattacttactttctacatttagttcatctaaaatatacgcttttcttgattttttcttacatggtggtcattttaatttttagcatccatttgtttctattcctaatataaacttcagcatattaggcaaacaagtttacttggcttttgtgacttaaaaatattattatagagtcattcaattaagttctgcttaatctacttgaatttatatctccaatagaattaatttattgaaaatcaaattaatatttctttaatctcaaaatttactaaagtcataatcatttttatttcaggcatgaggggaaaaaaaggaaaataccctaaaaatttgtagagccctaggtattagtttgtttccttcagctgttttataaggcaatattgaaaaccatattttgtttttcagatagcaaattttcagtgctctaatggaagaattagaacaaaggttagaataagaataagggatctttaaggaaataacatgttttttaaaaaaggaattattgtgattataggttgctgtactgccttctatttttaaattgtcatctcttatcaaattgaaataacatatttgtttgtttctaacaatgctctattgtgattaatcaaaaattcctattagcaacttcagccaaattaaatttaaaggagcttaattgagcaatgaatgatatgtgaattggcagcccccagaatcacagcagattcagacagactcccgcagacatgtggtggaagaagatttatagacaaaaaagggaagtgacatacagaaatcggaagtgaggtacagaaatcggaagtgaggtacagaaatcggaagtgaggtacagaaatcggaagtgaggtacagaaatcggaagtgaggtacagaaacagctggattggttacaggttggtgtttgccttatttgaacacagtttgaacagttagcagtgtatgagaggttgaagcatggctgccgggattggccaagactcagccattgttataggtgcatactcctaaattagattgtcaattttgtctacctactaagttaggttacagttctcccacaaggactcaaatatagaagtacagagtcgttctgaggccgtttttagttcactttaacagggaaaactgcaatgatcaaactaagtaaaagtttctaagagtatttttatcaaacctggcagcaacatctacactttaaaacagaatgcattatgtttttttccaaaaatacagaagcctatcacttgtcttaccagttacttccatggaaatttggtggcctcattgcttttgtatggagccctgatgagagagaaccccaggattatcaactagagattggagctagcaatctttattcccattccctttatacatatatgaagcagagctgtttttaagtagagtttatgacagtggaagttactcttcagagaagtaaattagagagtttagttgaatgtgtttagtttacttactttggaacttttactgtttaagcttactccttccaaactcaccaaagagaaatagctcctcaaataatcagatgatctgttctaaaggcaagaagggaaaataataagtcatctcccccactgcattctttttgtttgtgtttaatattttttatagagttaatttagatttagcaggctttatgtaaagtttcttctggaagatttagtgaatcttttgtgaaaaccatcttcatctgacattttagaattactcacctatttatgggattatactgcattctgttcttgaaagagcaaatccattttcagcatagtttttttctgtcactttttttcgttgtctgtttttctgaaaactacctccaaggtaagaggggaaaaatgggaggagatggaacgtagaaaataggatagaactgtgtcttgccagaggagatgatctgaattagaaactattggttgaaggaagaaacctccaaagccaatacaataatttatttaactttaggaatggtgtttaaattgtctaaataaaaataaatttttacatacttccaatcttgtctatagttactaaactgcagatgctatgagttagacttcaatcttgggttttctaccccatgttaataacagaagaaataaaaacaataatgaagaagttatcccatagtgttttagaaattatatccaatcttattttaaaacaaaacaaaaaacttgaagttttatgaaaatccattggtcatttccatcttcccctcttgcagccatgcactgtgctataggaataatgagttactcttagtgagtagcttatacacagaacacactgtcttttatcctcctgtgtattatctcatttcatcatcatttcagccctacagatgaaaaaattgaagttcagagtagttacatagtttgttcaagttcacacatctaataaggggcagagctaaaaaccaagttcaggcctttcccgttatgtctcccactgcccttgctatcaattattctgcagggcaaaaagagaccaccagacagtgaatatgaatgtcagacagaaaatcacctttgatttgtttgtagtttattttttgcttttgtcattctttacttacattcttgctgttgttgtctgtgaaacatctctgtcctaaatattttaacctttctaaatggatgtctggtatattcctttatacacttgattaaggtaaccaaaattaaatatttcaattttatttcaacatttacatatctactatctcccctacagccattttaaaataatattctaaagcaaccaaagaccaggattaggtcagagccaagcaactcagtacatcttttctgaattctcagaggtttactagagaaagtagaactttgtatgaatgaaataaacttgaatttctggtgatgcaatcatgttttggagtttagtctcctcagagtgcacaaaaaaatctcgaaataactaagtttaagtttttagtaattgttgttgttgtggttttttgaggcagagttttgctcttgttgcccaggctggagtgcaatggcacgatctcggctcactgcaacctccgcctcccgggttcaagtgattctcctacctcagcctcctgaatagctgggattacaggcaggggccaccacgcctggctaattttgtatttttagtaaagacaggttttctccatgttggtcaggctggtctcaaactcctgacctaaggtaatcagtccacctaggcctcccaaagtgctgggattacaggtgtgagccactgggcccagccttaattctttagtaatttttaacaacaatcaggttgtactattctgattttactatccagaaaacagaagagtatcaaataaacaaatacttgaaataaaataagtaagaattaactgtgttatttaatacttgtgaaacacagtatcaaaaaacaacaatgatcagttcacaatattgatgtgagaggataactacttacttgagacagtattagtttggtaagtttcctttgaatttcatggtgtaatttttagcataacagagttctgtgtgagagcttcatctcttttcctttctctttggcagctacccatttctataaggatatttcactccaggctctgtcccataatttggggggcaatacagggcacattcatactggtttgagaaataatttaaattttatatttcaaacatgtcagatttcttttctttcttactctttttttttttttttcctgttttgagacagagtctcactctgttgcccaggctggagtgcagtggcatgatcttggctccctgcaacctcagtctcccgggttcaagtgattctcctgcctcagcctccagaatagctggaactacaggcatgcacaatgcctcctggctaatttttgtatttttcagcagagacagggttcaccatgttggagaggctggtctcaagcttctgacctcaggtgatcagtctgccttgacctcccaaagtgctgggattacaggcgtgagccaccacgcccggcctcaaacatgtcagatttctggcatgccctctccccactccaaaatgaattccaaaaccaattattcttctcctgataatgatttgtccctttagcatccgggtattagagaaaggatgaggtggtttgaacctatttaagatgaactgcattgttaagagtttacttagacacgggtctatttacagttaagcagtggttctcaaaacatgtccctggaccagcaatgttgtcatcgggtccagggacacattttgcctgggagtatataagaaatgcaaattctcaggactcaccagaccatcataaactaggagtgaggaccagcaattggtcttttaacaagtcctttgttaaggtcattctgatacatgctagactctgagaagaaagattagaaactactgatcttccaagattagaagcttctgagatgagaagtttggtattcttgctgaatttggattcaggtaatctccagtttaaaaacttttttttagttagctaatgtccagactagagcttaggccgcacctgagagacctgttacatctttcaaagctcttgaacactttctgttgtctctgtctttatctcagtcttgggattgagagtaaacccttttcacaggcaaaagattaaggcattatttctctacatcagtcatcaacacaaagcatttcaattgctattgtagttgtttcatgaacttagtggctcagaaattaaaaaaaaaaatcagtatcattctttcatttcatagacaaaaacagtttaagcccaggatcctcagggaagaaaaaccctaaaacaatgtaaatgtaaaattaatcataatatataattgcagaaatttgaactgattcaaagaaattgtccccacaatggtataggaatagcttccaaatcaggccataccatttaatcaaaaaaagaaaatcaattgaaaagtggttttacttataatgatactgagtaaaatcagcttttccagtaagacagttgatgaaaagtttactcatttgcagcgatgacaagaacatgcactttattatgctttgtcattcaaaacttggggaggcactgcagagtaacagacgaaccatggagtagaggctcaatcctagtatgctccagaaaggacccgtggacaagttattcatctcaaaaatgaacatgtcctacaagatcactggttggcaaagtatgacccatgggcaaaatctggcctgccaccagtttttatatgatctgacagctaagaatgttttttaatagatgacatttggaattgaattggtaataatgaacattttccttgaaaccaaattaagtgaaatgttctctctccaacaaagaattccattcccctcactaataactctatattgcaaaaaagtacttaatgatttactattatattttgaattctatcactaaaaaaataattgtaaaaatttgttttctatcttattacataaataccttcatcatatccttggtcttcctcttggcctctggctctttacagaaatgtttgcccattcctggatgagatgattttgaaggtcccttcaacaatctaatttttaactatgctcaacagatagcagtcaaaccacttgtagaatgcaggtgatttggacaatatggatttgccagcgtttggctgttcatgaatggaagagagtcagatgggtccaataacagttccaattgtccatcttcaccctgcatgtttgaaaagagaaagcagagatctatagcgtattagtttaagccatattgtctgtgttagaaaatccaccctgccttgggcaaacccttaacctttgtgccttaatattccatctgtactgtggggaattaattggttaatgttcacaccttccccaaagatggctggggcttgcacatattcacaaaaacttcaaaagctgtaatgctttttgacagatattttttctttcccatcattttttcttatattattaacataagaaatagtttaacaaatgaaaaatttattgaagaactaatttaataatggccattaagagactttgatatttctaacatagatgcctaagcatactggatatattatgtatccagtgcacaaaaggcagagttcccatggaaactttttggtcatgtgtgcctagtatcatgcccacaagatagggttggagagacctataagcctctctttgccaaatattgtatggagaccagcgtgcataaagggttcagattctccttagaatcagtgttggaatttctagaccctcaagcgactctatattaaggtgcaaatttgttacctgggaaggtaatttttaaccccccattaatgtccatttgttagtactttagcccaaattaggtttttaaaattacctagctggttgagagcagttcttcaggaagtgtatcagattcttctaagtaggttcagggtaagttttgaaaacaggtccttgggggattgtgatacatcctccttcactttcagcaccctgcgtttgcaagagtagcatgtgtgtgcacacggcagcacacacgcaatacttaatactctagcttctagagcagcattgtctgatagagatataatgcaagccacatagataattttaagtgtttcagtagccacattgaaaaataaattttagcccaggtgtgatggctcattcctgtaatcctggcactttgggaggccgaggcgggcggatcacgaggtcaggagttcaaaaccagcctgactaacatggtgaaactccatctctactaaaaatataaaaattagccgggcgtagtggcaggcgcctgtaatcccagctactcaggaggttgaggcaggggaatcgcttgaacccagaaggcggaggttgcagtgagctgaggccacaccattgcactccaacctgagcaacaagagcaaaactcttgtctcaaaaaaataaataaataaataaattttaaaggtgaaattaaatttaataatttaagtatacattcaaaacattattgctttcaacatgtaatccatatacaaattattagtgatgttttacttttgggatactaagtgtttggtatctggtgtatattttatactcacagccagtattcattgaccggccacatctcaagtgctcagtaaccacatggggtgagcagttattttaatggacagtgtagctctgagggaccttgaactggaaagtgggtcacagagggcaaagtgtggctgcctttgtggctgataaaggcagcaagaggatgggctgggggaacaaatagaagttgggaccagcccagatccttacccctccattatacccaagtcatatttttgctgaaggtcagacctaactctaggtaacttaacctttttcactaaaaacttttagaaaaacataagcactggagttaaatgcttggccttaccacttaactgtatgaccctggacaagttactgaaaaccctgtttcttcatctgcaaagtggggaacagtgataatgcctcaagctcacagaattattgtgacaattaaatgatcaatgagcatataaacaatgaatactcaatgaatacttgatatttattttcacaattgctattattagctactcttaggcactaatttagttttaaaatgaactataaagacaatcagatactatcaattattctacatttcttaaaaagcagaaaaatgacatagccatatatatatatatatatatatataaaattttcaaatagtaggtgtaatcagctcattaaattgggcattatactgtcacgtacacacatcaatgcatcaaaaatccagaagatactacgttaccaagactatcttaaaattcgactttgttatggtagtgggtgagccaatgaaagaagagttggttcttctttttcctcctcctccttctcctcctccatctttttttattcaaagccagcagaaagagataattaaagcaaagctaaaggaattgaatgcaaagtttgcatcatacgtgtgaactaatcttttctccatggcatatctagaagatcaagtaagacacccattcagatggttcattaactagtgaaacttcggtggaaatagggcaggaggaagtagtttcttgctcacaaagtcattagtattcaaaaatacagcatagcagttctcacctaaaatagaaggataaaaaatactaacagtcaatgcttgttatgccaagtacatctttcacaggggttttgtttagaataaaagagatagtgaaagttttcagatgctagtaagtagtgaataaatgcagaatgtacttacacatttatgtaccaaatgctggaaggctgtgcaccacatagagcaaagaaatgtactaaaccatcaatttactaggtcattttaaatgtaggcagcaaaatggctatgtgcgtgaaaagccactactatattttgagagagcctttctaagaatcctgaaatattaataacatggtcttaatgtagttggagacaaaagaaggtgttaagggtagcaaggctgccgagaatagcacaatgacaattttgtattttctgcctgtgttttataaaagcaaaaggaaaagagtgtctgtttaaagaacagcagccttcaattttccaaactggtataaaattggtatttcccaaatgaattcacatatatttattcctggtgacatattaataccagcttcgaggaaaaataggaaaaaatgtaaacttgcaaatgcacttttttcttaaattcacataatatataaaacaggtttttgcactgtaagaaatttaatgaaattgaaggcaacattttccattttgatttttgcaaaagatgagtttaattttttagctggaagtagtcttatcagaatagcttttcaaatatgccatttggactttgtgatgatcagtcactggacagtttcttgtccttgtcgatcttccactcccactgtgagtttttcgtttttgatgcttgttgaaattgaggggtgcatgagaatcagtcagtaatatgcagttttctgcaaacattcagatgtgaaaaaaatgaaagcattttgtgccttctttgcagtcctgagttgccacaagttgcttttgtcgactgcgactgactgagtgacaggcgggacccagtgggtttgtgttcctgttcagaggctcattgtgtttgatgtgagaaagctgggcttgacccccagtccttcttcctgctaaagtcagggtttctgattttaatcaaaaccctagggccatcttaagcatgaccaaaaaagcaccttgcaagttgaaccttatctaattatgcaatgtgtataaacttgagacacataaatctcagtcattggagcaacttgtttttctaagatgctccggtccagtgaaagacgaaagcaaataagggagagattgatctcccagcacttttattgtcagtgctccacacgtcataaagttttggcttgttaaaggaaattccataaacaacttcagttagtaagagtgaagtaactgtgtgccttcctgagcccctgctaaattccctttccgcttgccattacaagagtatgattaagaaaatgccaacaggatatgcgagtgggtggaacagacttcagctggaagccatacagatgcttgatggatgagtagtgacagtgagatgatggccctatctccagagagaatcaagcagtttcatggatctctttctagtactcatttcagtaagatctgctgcgttgctgcatggttgttccgttttggctgccaggctgatggaaaatggctgataggtccttctccccactgctgtttctgatagtatagacaagtcctaaggacatgatgaatgaaaagaaacgagagtgaatcatgctggaaagattgtgggttactggcacattttctttgaacctctggtgttatgaaataactttactcttaatggccttgtctctgtgggtttaatgctgatggtgttggtcaatttttatctggggttgagacagatttgagaggcgatcatgaaaggccatgggggaaggaaaaagagtggggagcaagtagtcattattttttattatgagttttcccagaattagtgagtttttccacactactaaaagtggtccttagtgtcagtatgatgacagtgtcagtgtgatgtttatgaagatgaagtcatggaaaggatgtcaggtgtataaaaaactatatggcccgtgttctctacaccaggctctcgggaggtgtgtgcattgcaggggaagggtgctggaaaaatggaaagagggaaaaacaggagggttttatgaacttgaaaatagacacaaaatattcgctgatcaaaaaacaaatcttagcatactatattccaaaatctccagttgatagtttttgttatttcaccctgaaactgtgacccgtgccttacaagctcgtcttttttacttgcttgcctttgttgatctttcgatttggttctttctgtagttgtaattgggaaataatcaccacccggtttttttgtcagcacttggatacacttcccactggttggctaaaggctacactctgaaattccatagcatgtgactaagcatacaggctttgagggcagaacacttggggtcaaagctgggtgctgacacttagcagatgtatggtcttgtgccctcaattaactgctcaaagctgaaattcctcacttctaaggtagagataatgcctgtcgaaaaggggtgctgtaagaattaagcagcataatgtgtataaagggtatctggcacatagaaaggcgttcggtaaactttgctgtgcttttccttgattctgccaggtttaagaaaatttcttcctttggacttcttgacacctgaccaggaatgttaatggcccttaaagagcgactatactcaatgaatgcttttggttgcatgacctgcatttcaagccacatgatcgctaatgattagcaagaacgtctcccttcttctgaaacaaggaggtggctttgcatttttgctttggtctatttgcagtggtttctatttgtttgtttttttcttcttccctgcagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtaagttgtatgcttgtctctcattcctgtgatgccaacagctttcattaccacctagcaaggcactgccaggtcttctcctgggataatcattcagggggcacttgagatcaaacattcatcctttctcaatcatagcaggggaaatgcttgtaaaaagaaagggtctttcccactgcttctggttgccttcagtgtgcacagctgcctacagactacttggtggagaagagattgagtgttcagaggttgtctgacagtgtaattagagctgagattggaatttattagtggctttgccattgcactgaggactcagggaagcttgacaactggcaggagaaacaggtagacggcagggtttgggaatgtggtttcagtctgtaaaggacagctcagtgtgcactgagatcattgcttaggttgtcattacacctcttccttctctactcatagttttgtgttcataagacttaggccccaatcctaataaatgcttgtttaatgattgcatttaataaatgctgggttaatgaatggatgaggctgggaagcttggtatgaagagcaggagtgaagaaatattttctcacactttatatggacagtgttcctaggtgttaccattcctttcatgtacacttgggccttcacagaccctacaatggctgtgaccttgatcggaatggggagcactgggcccatgaatttccattaggtgaatctgtgcttggagggctagcctcatggctcaggtcagacaccttccacagattttgagtttgtttcccagcctgttgtgtagctgggtggctgttgagtctcttcagtctgtttcctcacctggagaatggagttaataacagtgcctcctaatggttgttggtattaaacagcctcatgttgtttatgtgctatgtacatcgcataggatgatgccatttcatatattttagctttggccgggagcggtggctcacgcctgtaatcccagcactttgggaggctgaggtggacggatcacctgaggtcaggagttcgagactagcctggtcaacatggtgaaaccccgtctctactaaaaatacaaaaattagctggcatggtgggtggtgcctataatcccagctgcttgggaggctgaggctggagaatcacttgaacccaggaggcagaggttgcagagaggcgagatcgcaccattacattccagcctgggtgacaatagcaaaactctgtctcaaaaaaaaaaaaaaaaaatatatatatatatatatatatatatatatatatatatatattagttttagttatcattatgactattattattttgtttcctaactactataaatggtattttggccaatctggagctaacaaccctgcaaataaaaggtttttgggtatttgagcactttgggccactgggcaatcaagtcctgtctttaaaatgagtggagtgagtctccaggtctctctgactttatattcaaattgctgtaacctccagagtttctttcataatgagagataataatgatgatgatgacaattttataattatgcccaggtaatgtattaggtacttgaaaaaaatcttaatacgtggtttataagaaatctgttaggtaggtataatctttattttatagaaaaggtaactgcaagctcagagatgttaaggaacatgctcaagatcacaccctaccttggacagagttgtacaacctgaagactcacctagtttctattttatattattattatatttatattattatatttatattttatattatttctattttatattattctattatagagaatctgggagattctcttgctggctctcccaagtcaagcataaacattcagagttagggagaatcctagggtcagtctcagatgtaactgttaaaaaggttagatgcagtagctcaggcctataatcccagcactttgggaggccgaggcaggcggattattgaggtcaggagttcaagaccagcctgggcaacatagcaaaactccgtctccactaaaaatacaaaaattagacaggcgtggtggtgtgagcctgtaatcccagctgctcaggaggctgaagcaagagaattgcttgaaccggaaggcagaggttgcagtgagccgagattgcaccactggactccaccctagatgacagaggaaactctgtcgtctcaaaaaaaaaaaaaaaaagaaaaaaaaaatagccaggactggtgcctttcacctgtggtcccagctacttgggaggctgaggcaggaggatcacttgagcctgggaggtcaaggctgcagtgagctgcattcacatcactgcactccagcctgggtgacaaaaaaagaccctgtcttagaaaaaaaaaaacgaaaacagaaaaactgtaaataggcaaggattgtttttgctttctttctttcctgttcctccatagactaagaactttctctgcgtggccacttttgtttgaactcttcagtcccaacctttttcttttccaatgtaaatattttcatgctatgttccatttgtgtgattagtttaataataaactccccatctttatccacacctgctaccaacaattttcttgtaggaatctggggcacaatagtaaactcaaggggaagtgtttgaggctgacattttgaggatggccctcaatttgcatcatgtactcccccacttactttccatgcagataaatccttctctaggttgagatttgattgtattatgagtgtcatgaaatgtatctctgatggcaggaggtcctggctctttctcccaggtatttttcagtctcatgatgctgacctgtttagcatttaaggggaccatgtgcccatcactttattaccaagtcttgctacttgggagtttaggaaacctccaaagatggccatatgtctgtgttgctggaacatttgatgtatgtgtaataaggctgtggtagttgagcccttggaattgtatttttaactgttagctttatcttaaggatgcaaaggggaagaagagaaaatttgattttagcatatggatggaccaaaaagtctaaaaattaaagtaacatttgcatgtttcagaagtcattttccacaaggtgaagggaaggaaggctggtggctttttgtgtcattgttaaaaggtccatgaaaatacctgctcttggaactccttctcctacactttactacttcaaggtcttgtgcattactttacttacttattttttcattttttttttgagatggagtctcactctgtcacccaggctggagtgcagtggtgtgatctcggctcactgcaacctccacctcccgggtttgtgattctcctgcctcagcctcccgagtagctgggactacaggcgcccaccaccacacctgtttttgtttttgtttttagtagagacagagtttcaccctatcggccagactggtcttgaactcgtcacctcatgtgatccatggacctcagcttctcaaagtgctgggattacaggcgtgagccattgcactcagccttgtgcattactttaatggttatcacatcccacttactttatatgcagcacttcagttaagaggaaacaaagtgctgatggcgacgccatcaacttgctgatcggatcgccttggctgtaaccactgaccaacactgtgatattcagagagagtttaccctcaccaggccccaatttcctcatctgtaagttggaattctcaccatctacctctggggctgttttaagaatgaaataaaaaaaatttgcaaagttctggcacctggtagggatctaatcaatgtttgttctcttcctcttttatttccagctggtcacttccttccccaaactgcctccacagcaggttgacagctatctcactgcctctctatcagtgatttttacccttgcgtgcataattaaattacttgatggctgccctgtaccccaggatttctggtgggggggtaggactcaggcatcagtattttcaaaaatcagtctgttaatttattgtacagttaaggttcagacccctccaatggaactaaattttttttttttgagaccgagttttgctcttgtcaccctggccggagtgcaatgacacaatcttggctcactgcaacctctgcctcctgggttcaagtgattctcctgcctcagcctcccaagtagctgggattacaggcacacgccaccacatctagctaattttttgtatttttagtagagatagggtttcaccatgttggccaggctggtcttgaattccggacctcaggtgatccacccacctcggcctcccaaagtgctgggattacaggcatgagccaccacacccggccaacagaactaaacttgtaagtatttttttaaacttaaacattaactgcataagcctctgaagacttcctctgagatagggataatcagggaagtgactatactttgctgataatagatatagtcgtaagtcaggcagcagaactggattctaattcttagcctatggctcttcctttcgacatctcccttcctagtgaatataatggacctgtattgtctagtactgtagacacttgacacgtggctatttaaccttaaagtcattaaattgaaatttaggttcttatttaaacttggcacattttgagtgctcaatagccatatatggctagtggagactataccggacggcagacccagagaacgtttctatcaccacagaaagttctattggacaatactgtagtagacgttccaacagagaagacagtaggagtttctcaaagaacctcttgttcagatgatccacagagtaactctccccactcgcacgctgcccccagctttatcggattctcttgacaagatgtggggatgggaagcagcataaacatcaggggtcctttcaaactgattccagcctctaatcagttcttcccagttggttaagccaggtgacaaacccaattcccttgtgctgacagccatgataatcaggcaccttctttgttcattatgctgtctttaaccccagcattcttatgcagcctcgcatttagtgatcgctcactgtgacggcacactaatgaagaaataaaacacactatctgagcctcattcttctagccaaagagagactgtgctccactggcttgtaaaatcaggtttttgttcacttggagaacaattagaccaggtgaataaaagtagcattggctaatttagaaggaaactgcctaggaagtttgcaccattgacgctgctggagagcttaagagaatttaatcgtaaacaaactttacctttgggaatacttttgctggagcctctggttaggttaacataaatggctgcctgtgagatgtgctgagatgtttctatggaagcaccatcggaacattttctggaaaatagcccataactatttagaacagggagtttagaacagagctttttaaacatccacatgcacaaaaatcacatggaaatcacctgcggattaggaggagcgaggttaggcctgagagtctgtttctgacaagttcccaggtgaggctgaagctactgatctgtaaaaccgtctttaggcagcaaggatttagattcccagccccacggctgtcaggagacaggagattctgttttgatgcctgtaactttcagacctgttcttcagctcagtggtgactctagaaaggtatttcatggattctgatcattctcccttcatggaaatggaatacttcatctgtctcctgtatgaagaaaatccagcctgggtagaatcatacaaccaaatgcactcactgtggaattatttttctttttaattttgctgttgtttgtttgtttcttccagaatcctcaccaagttattgccagagagtagaaatgtaaatgttcaccttagacacctgtatcagtcaagagaggcaagaagtttttttttttttttttttttttggcaacattgccaggacaagcaccattatttctgcacattcagggctgccattaaagctgatgtcaggattttgattttatgaatcttttcttaacagggattttgatgtgatttttattaatgaaattaaagtcctttaactctacgaatgactagctctttcccttctccagatctgtttctccttgtttccctgccccttctggaatgcagtctggttatcagcaggactgggcgtggtcaacctcacacccctgcaggaagacttctgatggtcttagtcatgtacttgcttgttcaatgattgtagtgagcaagatcttcttttcccccactgggaagctaaatcaatgttatatttaaagtaactttctttttttgttttcccttttttgagatagagtctcactgtgttgcccaggctggagtacagtggcgctatctcggctcactgtaactgccacctcccgagttaaaacaattctcctgcctcagcctcccaagtagctgggatttacagacatgcaccaccatgcccagctaatatttttgtatttttagtagaacctgggtttcgctatgttgaccaggctggtctcgaactcctgacctcaagcgatccgcccgcctaggcctcccagagtgctgggattacaggcgtgagtcactgcacccggcgttaaggtaactttcttttccaaccccttattgtatttcaaaatgtgctagaaaagtaccttgtaaaggtagtaaattggctttgcatatctagaaaaatgtagctcatctgtcattttgccaccttgacttctgagcactgttaccagagtagtttttcgtatttttcaattggaaatctgtccctgtgcttttgggtgctctttatttaacttgtttgatgaaacttcttagagcctggtgattgggaacactctgtaaatgagagattattattttagattgccaacttgaagggcctttacgaatctgtctccaagtaaacagcctcgaatgtgccaaacaaacaaagagtgattgattgatacttagacgtggccgaaaatattccaaaattgcagctttcaagacattttatactaggagagctcagagctaatgagggcagatttcctaagatctatgaccagaggtcctgatttgaaaaaactttctccaggtttacgttatcaagaaattgaaacagccaagttccaaacaacaaacatcacttactttgtctctacatttgccttttctaattgaatttagtgcgctgctgtatttcctcccagaaagtgtattgttttaaaattaccatttcagttctattactcaaagccctcgctgctaatgctttctgacagttatcaacataatgagccataatgaaatgatgagcaatcttcggtggaaacccaatgtcgattcgaccggtgctgtgtgactgtgttgtgaaaatttgaatgcaaattaaaataacatcgtccttacttgtttccaaggtcaggagaagggagggactcttttccttttttatttttttattttttatttttttaagggctttaattttgggaatctcacatccattttcaaacaagctcttgaaggtgcccctgttattctgttcaattctctaccccaaagatttacatgcttagcagtctggctaagggatttggggagggatgtctagagcgaggctttgatgtataaaccataggataaaatgcagccttcagtttcaagtaaactatatttttttttatctacccgaaagcatatttctttttgctttagagctgcaagtaactaatcatataatgatgggggaggcatacattctgtgaaataggtcagtgagggtgcagttagctctagtgaaagactagttagaaaagtgagaacaaaggccaaagattcccaaagtgtcgtaaatgaaagtgtttcagaagattcattggttgatctctagccattttatcattcatgcaatcaatcattttcgtgaacatatttttatgaaaaatctcaaatccaagttttccaggggaatttctcattccatgtcatttatcaaatttgcaatgtaatagtatagtttcatactgcattccatttgtcataggacaaaaactcagattgagacaccaactcctccactgccagattacatagttggtttttagttcagaacatatggtcctgctgcctgttagttggtaagccagctaatgtgtctgtcccatggactgtacaaactgatcaaagcaaccaaagacatttggacgattcagatgcagccgtcaacgtatgctgctgcttcagttagagcttagtagttcaacatctgatgttagctagtgagtataccacatttttgtttcttcctttaggattgcctttcagcattttagctactaaaaggaaaaagtacctctagacaaccaagtggatggtttttgtttgaagaaaattaaagatagagggagaaagatcaccaggtgagcttcaacgaaggcactagatagaccccagactgatcatttgccatttggttgtttgcaaaattttaagagcctcatgatatttcataaagatcaggtatcatctcactgaattctttttaaaaaaatgctgttttagcttcctcttttttttccccacatactccccattttatagtcataaacagcccattatggattccactggaaaatgcaaagattcgagggacactaatatatgcccaagtggaaggcttgaataatctgccaatgccatttagccaggttattacaatttttctaccaccctgaataattaagagtggcttgtcattgaccgagtcctgtcatttctggatgccatttttgacactatgcatggaagtcatacagtggttattcacagcatgcttctatgaaacaaggttaattacacatttttctgagatcccctggggtgagaacggggtatcttctttttttctttttttaagacagagtctcactctgtctcccagtggtgcaatctcagctcactgcaacttccacctcccagctcaagcagttctcccacctcagcctcccagggtgctaggattacagaaacgagccaccacactcagcccagggtatcttctttgctatcaacatttagatttatgagagattctgctatagagatataattgcccctcgccctattcctatgatcttccacctagaaaaagaacctttaatagaaactcctagccactctcttgcacagaaggtaggaacaaggcagaaaagataatccccatgaaaatgataaaagaggatcatctgggaagtagtactagctagccatcatcatcatgaagggcagggaagtgaggtgaaattgaactctggggtgaactgagaaagttggaaactttctatccaattctcaaaaagaatttgtaattatgggttattattttctttatattatttgtatctctatgaaagggaagcagggttgtttagccttggagtcagggtttctgatcacagctttgcgcatgttggctgtcttaattttggcaatttgcttaacttatcttagtttttggtgatcagattgttgtgaacaataaatacttttctgtcagatttgattgcagctgttaaataagatacaaaaaagtgctttgcaaggaaagtaaattaatgcacaggctagataattttaaaaatgaaatactcaattctacttttcttggtctttggcgtggtagctttcttgtgtataactgagaatttataaggcacttcagccataaacaagtcatcctaataaaaagaaaccaaacccctaattaacccagtaaaaaaaagacaaagatcactggagaggagaatgggaaaggagatagaaccagaaaaataggttatgggaaagtctcacaacaagaaatgaacctctataggaagccaagaatttttcatgacagcagcaagtgattgatgcatccaaaaggttctggtttaatcatggacagccctgcttggctgtctttgttgtaaaaacacataaaccaccatgataagaggttatgcactgttcatatatgtcaggagggatgtctttaaaacagccatctttatgtaaactaacccacagcagataggactgggagaaagcaattagtggtggcaacatatacaaatgtcaggggaagcatgggctttatttcagagtcaaaacgtaatgcatcccaactgttgactcttccttataacctgtctttcagctggagagagattaacaacaaaggcttatctgaagggttgaagggttttacagctaagacgctgaagtgctattgacagtccaaaagttgtacatgattaatgaagccttaggaaatggaactacagacccaaggtgctgcttcctccaagatatgtgttggactggttgccttagcattttagtgaggtgacagcagtgcttaaatacatcgatcatgggagagttacctttctgcccatgctcttgggggatgctccatttcccatccagaatgaatttcatagcccaggcattgaattttaaaatggcgattaaaaatcagttaagtattagatgtctgtgatagctctggaaactactctatcacatgagaccagagactttggtttttctatcaactgtcttcttgccttggttgcagacttgattttctttctttcttttctttttttttttttacattttagcatgtgattgccattttttctctctttattattattattattattttgcttagcttttgtgacatacaaaagtgctatggcagtgggttttttttttttttttgagacagggtctcaattcatcactcaggctagagtacagtggcatgatcccagcttattgcaacctccacctgccaggttcaagcaatcctcccacctcagcttcccaagtagctgggactacaggaacatgccactacaactggctaatttttataatttttgcagggacagggtttcaccatgtttcccaggctgatcttgaactcttaggcttgtcaagccttccacctaccatggcctcccaaagttctgggattacagtcatgagccactgtgctcagccatagtgctatggtagtgatgcttctgattagtgagctggactgggctaaagcatcatcattcattcatttgttcatttagcagatatttattgagtttctaccagatgtcaggcattactctgaaggctgtagatattctcataaacctgaaaaagagaagattccttttctcctggagcttatgttctaatgggaatataaacaaacaaatgaataagataattgaaggttctcctaagaaggaaatttttaaaaatgtgatgcaattgggtgcattgggacagggaaagggaggatttcagtttgtatggagtagtcaggaatgagaactattccagggataagaagtcagtcagtcaaagggccaggagtgagaattccaagcagaactaccagctccaaggtattttgagttgcatgtgcaaaattttgctaacaatgtgagttttaaagttgacttacttttttccacagttttgcattctgttggcactttaattccagtcgttacgagaaatagaacttttgggtttatatggcacgttacaccgtatatccacatatatttaagccctttggcagaacccatttctgccaaacccatttcaaaacgcaattatcatagcaggttttcatcttttactgaagtttcagttgcttcctgtaagaataaagaaatgcattttctctgactttgggtgtgaggtagagtacatagggtacctggactttccatggaatggtttataccaaacttatagacacactggagacatttctgactttaggtttagtgttggctgacggcttttaaatgacattattaaggctcacacagatttcatgtggatatgtaaatactggcttgtcctaaaggggctactttaaatcttgacataagccagcaactgtgttctctaaactactcaagaattaaattttagtctaatccatgggaggaaagaattaagatatgtggaattactggaattttcttttatgcttggaatattgccgttcttaaatgtcacattgacagtatgtggttcatttccagaagcttgttttttttcccagagaagagcacatggttggtaaaggaagatcaagattccttttataatacaacatgatatgacgtgatattttataatatgatatgatagtcctttgtatctactatcatgtggctatagtttctttggggcttaatgctgtcaaactcctgtcaactgaatgtgaggtgacatcccactagaaaataataattacccattgtagcacctttctctggtacttgctgtgtgatgcagaaagtatttcacaccagtgaagtgaatggatgttcattaaatgtatctataatggcaagaaattcagtgcccgtttctttcagagcaatgagaaactcaagaaataagccatatgtctcattttattccctccttagtcaataaaggtaggtctaacttggactttagcagccagagttgtcacctgggctatatacataggttaatcaggggttcctggactgagctttttagataggctttttagttcctagaattacatgcagaattctgagggtgccagagagcatcttcctaaaaagaagatgccttgctttcatcatattttcaatagcacgaaatggtctgaaggtcaattttaacggccacctatttttgcaaataagttttcttggagcacagccatgctcatttgttaaggtattgtctatggcttctttggagatagaattacagagttgagtagttgctgcagggagcagatggcccataaagcctaaaatatttattttctggccagatcataaaatttctttacagagaaattatgctggtccctgtgcaaaagatttataaactaaagattattgcatttgacttctatttctgggattaccattaatatctgggccactaaattatattacaaatgtaaagggcatactaaatatgaaaactttaaaatagttgaacatgctattttcatttttgggtgcaggcacagagagaatcctgggcttatatgtgaatttcatgggaaatttacaaatacaaccaaaaacgtgaaggaagggtgtttatgttcccttaaatacacctcagcatttgattaatttatatgaggttggtacaaaagtagttaccattaaaagtaatgacaaaaaccaccattacttttgtaccaatctaatattttagaatgtcttgatttgggtgaaaaaattaaaattaaaggcaaaagctgttgttccataaagactaatatggaaaatacctgtctacctttagaaatgttaaaattaagcttcttcagagataaagttttccccagagataaagctttcatgtctgagtaaatcacctcctgaaatcaaggtggaggaagaaaagtgtaataaccaatcccaatttgataaaaccttatttgatagaacccacatttcaaattcccagccgtcgctggttacacagctgtaaaaacaggacaaggcaggtgcttgctctgacatccactgcacatataatccctatttagtttccttgagtctctgcctttttccctaggttccctatccattcctgcaactatctaggcaactatcaggaagttatcaaaatgaataagaatatttttcctctctcctctaaagcaggtgataaacactagatacaccataaatgtttttgaataaatgaatgattcacaatctctcccagcagaagtaaccactaatattttatatatagccctttctactttttccaaagtaattctaaaccatgaaaaaaagaggcaattgaaacaaactagttacactgagttactacttcacaggtataaagctaatgaatctgtatgtgaaaagttgactagtacagctttggctcggagaaggctgcatagttcacacacttcataacactgggtataagatgcattaaaggacttcattagtttttaattcattcattcattgacttatcaaacattttttgaaatttctgaacgaggaaccatggtagaaaacaggaagtgataaagacatcaattattattattattattattattattattattattattattattttgagacagagtctcactctgttacccaggctggagtgcaatggcgcgatctcagctcactgcaacctccgcctcccaggttcaagagattctcctgcctcagcctcccaagtagctgggactacagacgtgtgccagcacacctggctaatttttttttatgtatttttagtagagacgggggtttcaccatattggccaggctggtcttaaactcctgacctcaggtgatccactttggcctcccaaagtgctgggattataggcgtgagccactgtgcccggccaagacatcaattcttgaggagcacatatactggtgatagaaacagacatggaatggtgtctaagtagcaagacaccattatatgttacaaacaaagcaggaaaggaaataaggaactgaaatgtcaaacaatgacataagcataaggactggtgttatgccagtcctgtattgaggctagtagtgggtagttttgaaaacaaaatcttgccattcacaatgaccctcaagctacccgatgggtgtatgtactcagtaggtcgattcagatgtggagactagaaaattagaacaagtacaacagttagcccttttttgttataaacctcatatttgtaattggagacttactcgcaggtggacatatttctgatgacaaagacaatcactctgtcagaaatttaattgcttctaaatagccagacacaatacttacataaatgaaagagaaaataatcggagttaggttttttacttctggatgccttgtatttattaaaagagagctcagattactcagaataccagttttctcttctttttagccatctctgtaggtaattgtttactaagatgctgcagttcggtataactacaggcccagattggcttttggctatattcaagcccatatttgtttctcaatgtcttgagaatagaatacttttattctcctcctcctaaagaggagatgggccctccctttaaatgagaaacacacttatatatttgtaatcttttaattggcagggaaacaaaaaaaaagaaaccacaatcccacaagcacagcataccacattatgattttaatttgtaaagcgtgtgtcctctcccaggtttttttccagaccaacatcatagtcatattggatggattttctatactttgttttcccctctatcatatgacttcgttatactccaatttcgaggcagcgacagtgtccccacaaagctgtcactctctatgatagcaaagcataaaacatacgcagtacgatttaccagcactgaacttgaatttgcctaattctcagtcttgagcatccaacccagagccttccttcagaatcgctgcccacaggaagaaggctgccctagcttagcacgtgttttcgtgccagccctccattttgaaatcctgcagcatctttgtcatttttttttccacgtggaagtgctatatctctgagtcctgaaaccatttagttttctgctccatttcttctctgtttagacactgccgtgccccgtcctacatactaattactgactttttgcttctgtggtgcttgattcattgtgtcacattttcccatgtgaaagtggaccaggaaccttggcaaggaggttaatggatttcagagtcactcttatttaaccctggaagtcacagcaaaagaagaaccaatgactgacccatttgataaaccaagccctggtcagcttcagctgcagactagtaatggatttcactatggtggcaagcattacagaattaaaacagggctgaagatagctcactgccacctccatgtttgccttctcaaactggctgaaatttttccttttgttatcattatacctttagtgaggaacacatggtggaataaaaataactccaaatggcagatagtacttttggatttcagtcaaattctgtcactaattagattgcatgaactttcagtattattagatttactttccagatctcagcttcctcgtctttaaaataagggtatttgtccaaatgattttaacatcctatgtagctcttagagtcggtgattttatgtacttcatttattcaaaaagcattcatttgtcattatattccagttaccatgctaaaaactgtaaatgcagttttgaaatctaaacaagaaagaaatttgtattttctctctgaggacttatgtgaagtaatcttccctttaatacaaattttacaatacttttgtgaaatgttttaaaggtttgcatttttctaagtttcacaggatggggagctgatcttaatgcttaaagaggttgttggtaattagtcctgaggggagtttgggaagtcctgcttaccttgttaaaataaagtcttcaataagtgggataaagagaaaaggagagtgaattacccttattaaatgttaccactaaaaaataattggccattaatcactgcaagctatgtaataaatattgaatatgatttcttatttataggttacctcttccaattctatctcgacagccattttgaacagtatgtttcattgtggtagactaggtaaagctcatccaagttcatgcaagcctcctgttaactttcttttcctgagaaacttgtactaatttcctgcaaagtagccatctcaattacattagaagtagtatagataacagtgatctagaaacctcaaatttttcttaaaactcattttgctcatctcttggaagactgaaatgggaaagaaatagctttccaactgtcaaactgagtagctatgtctcgtttgagtgtggcagctaccttttaagcctttggaactggttcagaccaagaaaattccctctcccttctcccagcctgattcttccacttgaaagcagtttgtgtcacaatttttttgccctattaagaccaatcatggccgggcatggtggctcacacctgtaatcccagcactttgggaggccaaggtaggccgatcacttgaaatcaggagttcaagaccggcctggccaacatggccaaactccgccaaagatagcaggtgtggtggcacacacctgtattttcagctacttgggaggctgaggcatgataatcgcttgaacctgggaggtgaaagttgcagtgagctgagatcacaccactgcactccagcctgggtgacagagcgagactccatcacacacacacacacacacacacacacacacacacaaatctacatcaagaaacaagagtttcatcatgatctatagtcttattttttattattaatattattttttaaccaaccagtatgttgtcggtaatcagttgttctgtttcataacaaccactgccatcacccatatttcagaaactctttgatgttgctgggaatgcacgagttaaagggcaggaggaggggtctgggagccttgaacaaaacccctgccatctcgccacagctgtatcttcaacatctctgcaaccgcgttaaaccagttcgtactaattacccataaacagcttaaccctccgctgccatgttgaactgcagaggcacatttctacagttctgttaattttatttgctattgatgacatgctgtacttaggaattataatttaccttcagaagtggtatataactattaatttatcagagtctcacaacggccctgggaactagaatcactttcatttttttagatgataagatggaacagataaattatgatatttttctgccacttcatagggaaagcctgggcttggagcccatttgctggagagttgctgcacatctcaaagtgacaaccgatgccttgtttgtttgcgcgggaaagagaatgacactcacgtaacagccttctattatattgttcttttaaaagatcttttatgctggcttgatttgctttttgctttctttgccaagtgggtttgccttgctttggagagctgcagaaaataatacaaactctgagagattccaaaagggtatttcggttcttggtgtgatgatgtggttttctttctccaggtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcaggtaggaattgaatctactttattgtatgatctgaatgtatacagagaaaaggcttaaaataatgaattataataaattgctataattgaaatagaatcaatcaagcctgggagctgcgttataatgtaaaagatacttaggggctgggcacggtggcttacacgtgtaatcccagcactttgggaggccagggcaggtggatcacttgagcctgagagtttgatcaagaccagactgggcaacacgatgacaccccatctctacaaaaaaaatacaaaaattagctaggcatggtggtacaaacctgtagtcccagctactcaggaggctcaggtgggaggattgcttgagcccagcagtcagaggttgcagtgagctgagtcactccatgctggatgggattcatctcagtcatttgaattatgatgtccatggctggacatcagagcacttatagattatgtacaattataaaattgatttttaccaatgcagagtgctcttttggtatttgttatattttctaacaaaagcattagcagcaatagttttgatcttatgctttaatgtaaaatattataaatgatctaggtggacctatactagaacctccatgtacatctttgtgtctatagttaacgaagtttactttaagacacttaatagttttgcagctacttttttctttttttctttttgagacagagtttcactctgtcgcccaagctggaatgcagtggcgtgatctcggctcactgcaacctccatctctggagttcaaccaattcttctgcctcagcctcccgagtagctgggactacaggcgggtgccaccatacctggctaatttttatttgtatttttagtagaaatggggtttcaccatattgaccaggctggtctcgaactcctgacctcgtgatccgcccaccttggcctcccaaagggctgggattacaggcgtgattgcagctacttttatagttgatttcttgattgacgtgggggctgggagggtggggcggagggtggggcggccagtctcctccaattcctacatcactttctgctaatacagatgactagaaaacatttcctgttcatgaagtgtttctactgagttaatcgcagaactgtcatgaaatcttgaatatcaaatattttgaaaatctaggtttctaggctttcgcttctgacttactcatctgtactccttccctgaaaaagttaccacccctccaggagttttacgttgccggcttttttatttctggagagttagagaggagaagggaaacagagttagagtggcttattctttgtgaggctcttgggatagaaaacatagccagaaaaggattataaattgccaacaatcctatcgcctctaactgcacttttcttttaaatgaatgtttcagtaagtgcactcaatagtttagtaaaatatctgtactaattgatcctataagtgaaaactattccagtgtcccaatccaaagccattatttttccattttgccctgaactctttggaataaataaaaagttaagacttggggaaggttttgagcaggggctagaatggcaagtcttaccggaatgtatcttcagctctgcaaatgtgaacagtcttttaaaatatctaatgtgaacgggtcatccagctaggcctttgtcttttaattctgaatttttaggttgtgaacactgttcgcagtcattagttttatttttctacaaagactagtatgatttaggagtttttgatagaaacatgagtactctgtgattgccaacagtttattagttctcttttggaagaatgcaatggaaatattacatacagatcctgggaacacgcatcggtgctgctggtctctctgaattaggagctgatgcaatgcagaacgatttctgcaccgtctggagaatctggttgatgatccaatcagtattcttacatgcagcccccttctacctttttggctattcattcgcaagcactacatcattttcttaaccgaattataagtagggatggacttttggagcctcatctgtaaaaggtgaagtcattctccttggcagagaaaagcctgtgggagatgcgctgaggacaggcttggctcccacagattttgggggagacttctatgaccccctgtacacgtagggatttgagccaagaagttatgtcaacacctactggggcaaaaggtccagagagcacaaagaagacacactaaaatcctccaaaagaagaaaatgcaaaaacatttccgggggtggggtggggtggggtgggatgaagttttattttaaatgtaggtataattcttctagatttaggagaaaagcagacagagaattactctgacacaataaggttttctttgccatggcatgtagtcctgccaaggaggtttgctgaacaggacaaaattccagctccttattttaattttcatgaagggtaatgctgggaagctgttcaaaattaaaaataaatctttcaataaggagacctcctatgtggccagccagaaagctttcacttagtagagaattgtatatgtgcagagcactgcttcattatcctatcataatttgaagttctctaattcaagtcatcaggatagtttatctttgattaacaaaccctttcttcatagtagtgcaaattaataatgtaggccaaaattcgggtgaatgtagcaaccgtaaactctatcgaagctcccctaagcatatttacatacacacaattatgttctaattgcaattgctcctatcatttcattaaattaaattccttgaggaccactataggcaatggtgtctcactctataaggaatacatagaattaatgaacgttagcatttagcacctggaggctacaaaagttagtggttctccatctttgctctgttttcacagggttctttctctcatcagtaatatgttagaaatgataaatcaaatcaatcacgcaaaacctgctagaattcttgggtcctatgttcaccacctttgagactttaagagttgaggagcagctccatgaaggtgaggtgactcacccatgctaatgtcagagccagtactaaaaagcagggagaatcctactcctgaaagtagaaagttgctttcctttaaaattaggagataatgaatggcattcatgtattcagcttggcattctccccatttatgagaccagattatgtgagtatctgggcatggagatggagattgaactgggctttgatcatttaattgtagaatgtggtgtgaatgggcctgtgttctcacaaggttatttaaacaatcctaacccaaatcttactcctggggtcttagggggttaataaacacccttttgctccccttctgggttgaaaaccagttgacacagaagacaaaggaaatctgaatgtctgtcagctttttgctgataagctgatggaaggatgtgagctttatatctgtggccaaaagggcttgcttcagtgacacttgcagcccagcggctacctgcagcctctccgcctgccctgctaaggttgttggaaggacactgtgcaggcagacaggtaggcagataggcagataggcagatagacaggtctgagagtgggtggagctgaggacagagtacttttcccaaattctctaatgagatgagtcactcccagcctcacccccatgccagaaacaatgaagggaagaggtgggaaaagagtaagggtgggggtgttacttttccagctgaagtcgtacccagtaaaattggagaagaggaagctcttggagctcccccaatagttacttttctacattacaggccaaaaggaggaaaatgagattccagtttccttcatctttcatcctgtagcgactgttttgtcttttgtttagaagcaggtagtcctgatgtttatgaaaaatggataagcaaactgctgggtgatttgttttctggatggctttcctttggtttactttcacttaagtggaccatctcaggcaaatgaatacaggatgtgtcactaggagggagaaatactgtataaatgaaacaaggttttctggccaagcaacagacctgtgaatattttttttttgttaaaaaggctgtgatggcagccagcagtagcttaatatctctgaacagttttttgccgttcatctcccatcgcctttgcttggttttctagctgtgaggctggaccatattctggcgttttaaatcattatggacccaacccccatgaatggtgttccctcctcaccccaaattgcacccagggccggtgttgtccattttttatttttactttgcatgtgatgctattctagatacttcataatggaaagatctggtcatctctctctagcacagctatggtgtcctagtgacaaacaaacatctgtagcatgcttagtttggaggagttaaaatatttgatgcattacgtaattatttaaaccagctaatctctaagatcttttccgtttcaaaattctatgattctaagtatgtaaccctgagctgtgggctatgaacctgaagaagtaaggcttattcttctaacatgtttagaaatggtctctcaatgcaattctaagagtgggaaaacattctccaaatgcttcagcagaattatcacctgaattctgcctgccctccttctctctaattccttgccttgccaagggatttacgttgcggggggaaaacagtaagatagtgaacagttgttctaaattgggggtgatttctgctcctacccctaatgggcaatgtttagaggcaatttttggtgcagttgcatctagtgggtagaagccaggcaggctgataaacatcttataattcacaacacagcatccccaatcctccgcaatgaagaattttctggtccaaaatgtccatagggctaaggctgaaaaactctgttccagcaatagtttttaagaacagacttcatagcagtgcccaccatttcagggttccatagccaagtggcctttgcttgagctggcctgtggctgaacacatagggaagattccacatttctctggctccattgccccatgctgaaagcatgatgctcccgttactgttctcagagaacaggcagttgtaaagggcctttcaaggcccctcatgaatcctgttgtagctgttttgccatcagatgaacgggcgctgcttgttaggctgaccttgttctctagggttggacaattaagcattaactgcaaaataataataataataataataataaaataaagtggcattacacctcattataatgccactgtgccacatgtagtcattgtacagttccatctgtttgttgattaacatttatttacagtaaaatcaaatcagttaactctctttgtcaagtaatgataaatttaataaaaccaaaataatgaataaagaaaagaaataactaagtgtaagaggcacactgtcttttattattcaactggtaagttcccattctttctctctctgccatcttttaattagacatattatgttatttgagtgggataatggagaacagtgggaattctcatccccactgggtataattgctacctgtcttctagatagtaagaggaaagcttcaagaaaatggtgggagaaaggggaaaatcttacagcaatcaatttaggtaatatgctgtaggcatggcagagccagactttgtggagtttaaagcttaaacaactattgtgtgattaagggtgaaaacataaaaccctacaaaattacaaatgtcagactagtaacagagcttcagaaagggtccatacaaacttctttagcttcggtaaataaaaatctgcctctgactatgttgagataaatgcaattgtcagacaacaagactattgcataatcatccctaaaaacagaaaggacaagggagaaagatgagatgttgggaagtccagtttggcctgaaatgaaggtgttgaaagacaggttgtgacagtgagtggttctggcccacagttaggtatgaggggcacctctggagtggacctgagttgtgatctgagatcaaagggacaagcagaaagcacattcctgctgattctgagaattgttttggaatactaaacctaaatgagatgatgtgatctcggttcatgcaaccactgcctcccaggttccagcgattctcatgcctcagcttcctgagtagctgggattacaggcgggcgccaccacatccagctaagttttctattttttagtagagatggggttttccatgttgcccaggctggtctcaaatacctggcctcaagtgcatccatctgcttcagcctcccaaagttctgggattacaggtgtgagccacctcacctggccaaatgatgatatttttaagacacaaatgtttgcttcctttagtgccctaaagcaggggtcagcaagctatggcccaagggccaaatcgaatcctccagattgggacaacccacgaatattggcttttatatttctaatgggttcaacataataaaaaacagaataatattttgtgacatttggaaattatataaaattcaagtattggcattcataaataaagttttactggaacaaattcccactcatgtgtttatatattgtgtaagagtgttttcacgtgacaatggcatagttgagtagctgcaacagagggcaaatgtccggcaaagcgaacatgggcactatctcactgctgacacaaaatgtttgctgatctgctctggagtactaaatcaagaaaggagaccagtaagagcaaggttgagaagctattgaaatactggtatcatttgtggaatattgttttggcaaaggatgtgatgggtaacatttaggtaaatctcacatttgaaacaatcttcaagacaccttattttgtaaaggttttgactcagaaaaaaaattaactaaaataattaggatttcagtcataactttgctttcttgaaccacaaatcttttcccattggcactcagatttaaatggattatgtgagacatgcttcactgatattctggttctctttaaagtatgcattcttcacactattgcctaggtcctatagttgctgacagcaattttctttttaaataattctatgttagcctggtgcagcggctcacgcctgtaatcccagtactttgggaggctagggcgagtggatcacttgagcccaagagttcaagaccagcctaaccaacatggcaaaaacccatctctactaaaaataccaaaattagacgggtgttgtggtgcacgcctgtaatcccagctactcaggagactgaggcacacgagaattgcttgaacccaggaggtggaggctgcagtgagccgagatcttgccactgcattctagcctggatgacagagtgagactcgatctcaaaataataataattctatgctctgctcctgtgccttatcttctctccgagatgatgtcatgcttgcctttgatctccagtaaatcgtgttatttttccttacccctaagaaatttaaaggaaaaacaaatgatggtactagtgaaatcgagaaaatgaagaactccttctagagattcattttaaaatccttcagacagacaacaaagcaattccactgagagattttgctgaaacgttgtttgcgcatcctcagttgttagtagggaatcggtagctggttggagagtcctttctgtgcctggtaattataggcccaagcaagcacacaatgagcttcagaggagccaggctgtggttttctcattaatagctctggtctagccatgggatcctggtttacttcataaggcctatgaaatgcacatttaaaaacaacatgcggtactttttttttttttttttaagaaacagtctcttgattctaaccttatactgagaagaatttcatttccagaatactgttgctaccactataattaataagcatactcactaattatgatcgtaattaaaaataaaataaaccagcagatatacaatggcgcagcctcttgtgtgtggcaccagtgtctgtgaatttgtattcggggtgggtgccacaagtcctggtgaggagaaaaaaaaataaaagcctgccaaaagagcctactaaattatccaacttttcaaggttgactgaatagcacagacaaatagtatgtctatagaacatagtggtaattattgcatataagcaaaagttagattgcatttttttaaaaaagatgtgaatattccactctaagaaaatgaagtctttatttatacacccaggactgagaacactatttttcctgagtcctttccttttgctcctacagaaagatatatgcatgttcatttgtaagaagagaaattcattcaccagtaatcacttgacagcctaattctggtttgtttctcatctctcagtgttgtgcttgttccatcgaacactaaccaccaacttttacaccctctggagaagccatcaagagatttaaaaaataagtgcctggctgagatgagaaatgggcagggcagggctagcaagggtttccaatgggcttctaaattatctagttgtcactccaactggctcaattaattactgtctccccagaggagccagatgggtctccagaaaccagtctgcaattgaacatcaatgaaaagatccagagaaactttatcaaagcttccattaaccccctgctgatgtctttaaatagtttttttttttttttttttttttcctttaaacaccttgaaaacccaaaagccatgcacaggacttatcttgcattaagagatcttaaatctacagggactaattgaaatgcctgtccatgtcactcaaatacatagagaattcttctgagtctcaacatccctgtggcatttttgtgatgtgggtatacaataagagggtatcctgtatattttcttcaggtaaagactggtgaggatgttttttagggtttacatgttaatctgtcaagataagcaaacctttggtctatctgtcagtattaaaaatatctctcttatttaatgaaccttcttctggtgtccacctttccacccgccacccccacaacctgtactcatgctttctcattctttgcttctgccaaaattagaaatgaaagaggttccccaggctcccctgaaacggcaatgataaaaacgagagatggtgccagtcagtgtggtcgcttgcctagtgaaccccttggcttcctcattgggaaatgtcactaatgattggttccataggtgagggctggcacccagagcactgtgggaatctggctgaatggtcatcaaaatgtccgcctatatagacacagagttgaagaaatcactcttagattccatttcttctttctctattctgacaaattggtaggcctgatctaaacgaactgtactgtggttctcctctgaccatcttttgggttttgttttgttatgaaaaagtacagggaccactccctgaaatctatctaaaatactttatgtgtaaaattatagagacacgaaatattttttctattactattctattcttgctgttactcttgggaggggcaaggggagaaaagataaagaactatggtccatccctttttgattcatatcttccagtacacaattttttcaggcagtttgtttatcactttcaaaaaaatccttttaataaaggctgtgggacagataagttttttaaaaattcttgtctaggaaccttttgtctgtgacatgtgcatacaaacaagacttaaatatgtagcttcaacttctcagtgggtgctaaatagtgacctgccaccaatagactcacagtgtgttccaagcttgggtaagatccatccattagcacaaacactgaaaagggggtagcttacaacggctccctggagaatttgtgtttttctagataacatactgcaagctggaaatctgcctcttgaatcaaccctaatttttttttttttttttttgtaaaataagtgcgtattttgagcataaacctgaagttaaataggagcacagtttcgttcatgtttctttttcaaagctaggaccacacatataaacaagccagggatttttaatatgtaaccagcagaaagcttgatcaagtgttctctatactctcaagtgtaattaaagacttctttttatctaaagataaagaaataagataaccaaagacttttattttatctgaaaattattgatgaggctcatgttgaaacccaatgaatctaatcccaatcctatagggttcccaggagggtgtggttttaggaaacttcttaggagacttggaaatccttggagctaacatcatctcatttctctccatttacagtaggagtagggttattattaaggtttgtgataaaggttcttattgttttgttttatattagaagcaaggagaacaactagcagagccttaccccctctgaaagtatccttttgtagccatgaacagtggacagaaaatttaagaagcatacactgtgtttacagccttcattgtacactccaatacagaacagtcaactaattcaggtgcggctccaaggggctggtaatatatttaagaaacccttatattatgtaaagatgtattgtttggggagaaatatcaatgagagccctttctatctcactgtaaactcttcaaggattcaccttaactgtacgtgtttgttggagggtagcattttctctttccctccacttctttttcctctacctatttcagaaaacacaaaaataatttccattaacttccaataacttcctccatagtgtgcaggagctttcctccagtgtctttcttagatatcatgctgtggaactatttctaggtaagatgcaattctaataaactcctccagtatttaggaatggactaaatactgacttctttgggtggagccagttatgctgaatttctcacttcagcaaattgagttcatgagagaggcccctgtgacatgctgtgaaccccctggttttctttctttcttccttttttaaaaaaaataaaaacaaaaacaaaaaacaagtcctaaaacagtaatagctttcgtaatacattctttattatttcttatgactacaaaagtcatctcaattctcaattctcaaacacagatccagttgaagatatctactgaccttaataacattttaaaatttaatagctcagttgtttctgccccattcttataatgcctatagaaatttaaactatctagcacatagaacttagtttctagctgatactctaaaaataaaaaataaaataaaaatacaattctagggttacagatttccaagcttaaaacctcttctcctaaatgattatcctgttcctaacctgtaccatagcttttgagaaaattgtcaaaaagacagattttcaaatatgaggtctgcaagaacataattgcatggccacattttcagagagcatagcatgtggtgaccatttgtgtaagatgcattctcaaaatgttctgactgtaatttaacccaaaggtctctatcccacttctttccactcaccaggtgcttccttacacttgtctacatagcaagcaagaaacagggcaggaaagatttcttctttataaaaaaggttccctaaagtgatactttagggaaaagcagaggttccctaaagtgatactttagggaaaagcagaggttccctaaagtgatactttagggaaaagcagaggttccctaaagtgatactaaaacccaccttctcagcattctatgggtcatgaatattgtcctcagaatattttgatcccctgtgtttggaacttccctagacttccatccagtagaaccaaactggcaataagaaacatgaggagtctcagaacttcaccccaatggccttcttcctgtttctctctctctctctctctctcccccccgccctttctctctctgtctctctcccctatttgtaacattctagtttatactgtccgtgatcatcacttctcagtccttagacattgtgctttaagccaagcaacacttggacttggaaaaattccaaatagcacagaacacattgatttacaactgaatttttaccaccatgtttcctctgactctctggccttgtcaggaatcattggtagcctatgatttcatgctataatttatactttgtcaatatgtgtcattttttcctctgttctgcctgtgtgttttaagtgcaacaagagaaagaaatagaagttgctaaaaaataatttcatagatctaaaggacagtggctggtaacaatgctaaagagcatctatcttcaatttatggtcaccatgacatgttttggagcagctcacgtgatctttttaaatgacgattaaaaaactaggtatcccattccaacagtatatctgatggagaattggatggcttggaagatgactaatgggattctggacctttctgtctttaggtcacctccttgaatggggactatatcataagtggtccaaggcccggccatttggcagccgtagaatgactatgttaatggaattggtctcagtccaggtcttagtcgacaggtgctcatatcataagtgacgtttattgactcccaactctttcaacttagaagacagtggaccatcactgagatagtgatgaagacggagtaatttataatatattcaggctccattgaaagccaaggaattcagccccttgagctggcaccttgcaaatattgtacttgtctcatgggttctgttagcttgagaaataaaaaatagaaatctaatttaaaaggatttctaataactcagaatagctaatgttggtttcctctgaggtcatatgagcctctcgtgttggtgcttttctcttcattgtgtattatagtgattagatattggctatgaaaattattacttttcatttgtttgtgtgtttggaggttgattacctagtcacttgtttataacaaaagctgtaaatgatactctttgacagagttaaataaggctatcttcatgcccttgtgaaatggaaattgatgaaaatgtaacactgagtaccttttatcaacataaatttcaaaacatggaattcagaaggattcatccaacacatactcttttctattatctggattaatatacctcacttcattcattcactctaatcaggttcatgacctgaagatgatttggcccctgttggaagagatcgttagtattactagtatattaatgttttgcccattgatgttttctgggttcatccactgactttttctttaacttcacagatgatttggatttccctatagcaagtggcaaagccacaacacttctgaattagttatcacacttaaaaagtcaagatgacaacaaccatagtggatctatttattgaagcagacaggctcttttagcggaatgatcaatgtcttacctctttctgaaaggcttttcagaggtaggaaatcatcaagcatctgatataaagtaatgaacaaggcttttgattggtcaagtttctggagcaggcttttaagtatttctgcctgtaaatgtagaaatctgagtgtgaaaagtaaaggcaacagcaaagatttactgggtgcatctatcaccctggcttttagagtctttgtgattaatacctgtttaattggggactgatctagatgctttggacgtcagaaagctaaatgttacagcattgtctcatgggttcctaacacagcaggacgattagcagctgtctgagtaacaaagagaacctgaagcctacaagcttagctttttattttccagatttggaatgcttgaagctccctggtggagttaacagcaaaaggaatagaagccttgatgcatagcagctaatcctttcctttctcttttctgtattctgctcagtaaaaatgaaccttttccttacattgttctccatattccaaattaattttggagagcattttttttgttggttatttgtttaaaaaataattttggggggccttttttttttcctctgatcttccctaggaagtgattggagggcattgtaggtcatggagacccccatttggtgaaggttcaccatcctgtctaaccaagttacacataaaataatttcaactaagagtggaaacactagataactgtcaacactacttttaggcccagtgagaagattcatctcactagaagcattcagagaaaaaaatgtatatttattttttgttgttgttgctagtttcaccccattttcttaccttaaaacaatcatcttgctcaggcaaattcttctaaactgccttccagtggaaagacttgttttcctgtttgcctcaaactggcattcttacttataacaggaaacacacacattgaatcctgccatgtttctgttggcaagtgttgagctatccttgtcagaacctgccaacaaatttcttagtaagcaagtagaaagtaaaacaagcagctcccagacgaaacacaggacacacttgaactgcagcaaagacacttgggtgcccctgaggttagttccctgctaattctggtggacatgggccttggtttccagttgagctgttacccacttataattttataaccgatcctatgactgtacctgtaataatgctaattcaagatactagctaacttgtaaaacagacattaaagtaatgcattttatttactacaaagagtaaggattgctgtatgtttcagtataatgattaaaaagttgcaaaagctctaatttgcaaaaccttacatctttcatgacatctttagggcttaacccaggaggtatactaaatattgtgtttggatctttctagtaataagtatgatacttcctttttaatactcctaacatttgtgtttgttttataacctttttattgtgaaatatacacgtatggaaaagtgggcaagattcgaatgtatagtcattgaattatagcaaagtaaacacctatgtgaccgtcacccaggccaaggaacagaacaatagaacattgccagtcttccagaggcttgtcttgtatccttaccccttctctaattccaaagactaattattttatttggtaattgaatttgttttgttttattcttgtcttagctctttagattagttcaaatgtgagttcattctgcaccaaaagttttaaggtttgtctgtgagcagggatcatatcgaacttacccctgggtttctgacagccgacaatgtacacagatacccctgtacctaacagagcagactttagaaagatttacgctgttgctgctgccgctactgctgtgggaaaacagtcacttaaaccttcaagtctcctatttcttaccatggaaaggaggggcagagatcagccgctttctgtagatcagtggttgagaatgagggctctaggaccagatttttgaattatgaccacatataagctataacttggagcaagttattcaaactctctgtaccttatcttcttgatctataaaaatgaggataataatagtacctgtctcatagagtttttgtgaggtttacatgaattaagtcctgcaagagatttagaacaatgctcagcacatcataattactcaataaatgctagtttcgtgtgtatgttgttacagacatgtggcatagagggaggatcacatacttttgagccaggtggacttgagttttaaatctcattttatggctttggtcaaattatttaatttctttgtacctgagtttccaagtctgaaatgtaagggtgatcattataactacttcagagagttatagggatgaaatgatgtcaggtgtgcgtgtatgtgcaagtgccttgcccaggagtttactggcatctgatttgctcctttccccattctttgttttgtggcaattcacagggcctcagttttcatctgcttaagcagttaataattcagtgaaaactaaattaactcttttctacaaagaaaactcaaccaaaccattttgagaaccccaatgtgttttcccatttagcattagcataagatcagctgaatcttttggctcagtgttttgcgattctgccgatttcattcactgttagaagactagtggccgtgattgtggccgtgattttgtccgtgggaagccacgcggcctctgtcactggctttgctgacctcagggcagcgcattccagtttctcacaaatgggtggatatctgctcatcgtgcatgaccagctggagtttccgggagggaacccaaaggcctttcaggaagctgcaaaaccacagaccaatcttctgtgggccacagtacttctacagtttatctgagttagttgtgatatgcaaatacctcttttttgccagaaggctccacttcacttgaatgagtacctgttttaaccccaaatgccagttcaatgggttattgcaatagaaatttattttcttgctgaaatcgcatccagttggtggtgatgggggttgttgggtgtggggcttccaagatgggcctgggtcattaacctccctctggcttgtgggttcaagaaaatggagagtcacagggagctatttatgggccagatctagaagaggggaaatcacttcaacccacattccattacccaaaactcagtcacatgaactaccgtagatacaaaggaatctaggaaggtagtctttggctgggcagctctatctagaagggaagggatctcacagttttggatgccttagccaaagaggccaacccaacaccttcaacttccctatgcaaacaattaacgtgaaggctaagaatagcatcacattctatcatttaaaatttaaccaatagctctctgtaaaggatttgttgaaaataatccgttgcccatctctctggcataaagaaaatgacgtgccctcccatctatctgggaaataaaaaaggcttataaaattttcgtcttctattaaaccaaaagtaaaaaccaaatcacagactttgcaaagtcttactctggaatcatttagttcaagtatttatagtgttccaaaatcagactcttaaaatcattggcagcatgagtcaattgtatccttcagtaaatattgctgaaggataatgtggctgtgcactgctttattttatagtatgtgtttaaaatagactctggtctgaccttggaaatcactttatggaaaaaaaaaatgcatctctcatacattctaaatttaagcttaataaatatgaatacttacatatctaaatataaatgaacttcatttaattcacagtcttctgaagattttggctgagaatttggttctatgtttttgtgtcaaataaggagaaaaatcaatgtcaatttcagaataatcaagttgtttttctgtaccttttgccggtttgttttaaaaagtttcactttttgactatgagaaactgtgcttgtgtggatgcatgatgtagcaactaaaagctgttgggggtggagctgactttttactttgatgatgagtccagcgagggtggttggggattttaatgattttacctaaaagatggcagaggagttgacctggctggtcgaatgtaccgcaaacaaaatcatgtgtatgtgaaagcactttataaactcttgtactataaaatactgtaatgatgatagtaagaaaaaggacgtataaatattgctaagtgatgtttgatgccataggtattgcctagcttgagaggaggaatccttctctccatctggaatgtagaagaaaacaattaatattagcaccagagctcttagcatctcagagacgcgaaacccttaatcacaaggatatcattagtgctctgaagcatttaattctgatgcttgacagcattttaaaatgcacaaacctttgataagaagcaaatcagagctggggtattgaattgagaaagaaatgggaactaaaaccaccttaagctccaagtaattaaatttaaatatgctatttgcattaagcagagatatgtataaatggtgggtttatatttttctatcaatgaaagaccccttgagtaaatatcatctgtttaaatccagatcctggggaggggaaaggtaaccctgctgtggttaagaagccatctctcctgcaaacactggccattgtgtaccactgacatccatggcttcaggtgtcttgactttcataaagggctgttttcactcctccttgcccacaggctggagacctttcattgcatctgtttatttcctagctcacctcctccaccctctaatttgaaccagtaatgaaatgcagtcagcctacttcagctgttttctttttcctccaaagttccccccaaactgtttttaattcactgcttgtgatactggactcaagaaaacaattttctagctcaggaaccatgtgaagctttcctctctttcttttctccgtatctcctcttctcttctccatcccatttgggtgtcacaaggaccaaactgctgcagtaaaatgacttgtaggtgtttaatggcaagtcattgaggaagtgaataaaagaaaattgcagcattcacgtcagtggggagcaaggagaactgctgagctttgaaccaaagaaagttaaatttaccattttcttaaagggagccacctctgtttgacatcaaagcatctcctgtaatttctccttgtgaaatgcaccactgttagagagtcatgatagagccccctaatctgtgctgtttctgtttatcaaaaacacacacagagagaaaacccacatgtaccttctcagtgcattgtggtctgctctcaaaccaaatgtaaccacaggtacatagcaaatggggattctatttcgaaagcattctcagtttctcagggatttgtagaactgggaatacaacattctttgggagtgaaatttatcttggacctctattggaaagctcagatcattcaactggaaagctttggtgaattttttcctttcctcctcttttggtttttgcttcatcgttttttaaaaatggtattttgctacaatttcacttgtgtccatttggtatgtggaaaaacagagtctgttcctaataatgctgctcgcccacactatgactgcaaagggctctccaccctattacccccatgtttcaagtttatgtccattggtggctgttgcatatgtagtaactaatggcttctgctggcagtgactggctttgccctagtccatctttggaggcttaggatcctttctggatttatcattatgacttgggagtctcaccatcactccaccttggcagttaagaagtcaggagaactatttgcatatgccctacagatacagaggagaaatgcagagcaaattgtcaacaccttcatcagcctaaagagcagaagctcaaaatgctgtctgtaacaggtgcagtgatgcctagttttaatgttaacttacatttgaatgacattttacagcctgtgtttgaaaaatgttcagaagcatcacacagaccttagaaacagagactccatttataattagagttgtcatttgcttcaccccaattgtcaatatctcagttaacctaaatagtaaaaccaaccccacaaaaggtcctttgaaacaggtgcagatggaaagttgttttaaggatggcttacttctggtactttatgtttagaaaatgtttgatatctacagtaaagattttttagataaattttaatatgtaaaaacttttattcatttgacataattattgagcaccactgaatgcatgtgtcaccatgatttgtaggttaaaaagaagaagaaatgagagacaagttttgggttaaaaactgctgaaatctccttaggggtaataaaaaatgatggtctcgggggtaggcaccttagaccaggaaaattgacatctacgagtcattggagattttgctgtaaaggtttgaaaattaaggactccattgaattaaatcacacatcttttttaaagagctaccctttaggagtgcttgccttatgatttttacatagtcatctttctttaaccatgctactgtcaactagcatgaccagctctcattgctatgtgtcatgtctgaattctagccattaaagaatgcctgcatttgtctggaggcacaaaactgtccttaaaacaagtatctcctctatgaaagaagtccgtgggtagataggaatgcttttcaatctatgatgcatctctttcttgtagtaagaatgtaaaaaaaaaaaaaaaaaagaatgtgttcatcagccccccagcttcttcctagctttgcttctgacactcagcaggtgtattgagtgtctacagatagaatgtgtgagaaagtgccctctacttactcctccccatcacccatgagagaacttgaattagaagaggggcagtaggaatcgtctcctcttaaattctagaaaaatgggccctctgacttgacattagaaagtgttttttctttaagactactataaaaatttcccaatagttcttttagttaagaagaggctaaagtatttggtggtacttagtctgataccaacaattattttctatctggccatgcttacccattccccctctcggccttgttccataggtgctcattaagtatgtgtctagtggccgagttgatgttgaggaagaaccttgtctctatgagatttcagaatgtaaatcaaagaactgagcagccactgagaatctttttttctacttggtctttttatgctgaccaaattttctactatgattagaaactctcttgaacttaggcattgattggtcagagctcttattgaaccatatatttaagggtgggatgtacaatctttttaaaaaaattctattatctcctcttctaattctgtaagcaaaaggcagagccctggaatattgcaaatcaggattcaagacatttgggttaggcattgtttaccaaagtgtggaaacataccaatggtggcatcagagatgattttagggaacacaccgatgagatgttatgtaatattgaattgccctgtgtacagtatagttcattttcaattctttctcagtaattctgagtactccaaggtcagaatctcaagtgggtgcccatatatcctttgtttctctagcactggctaatctccatttttaacaatccttggagaagtaagagtgtccagcaaacattgataacattgttttatttacatgcaatgttcatttaatttcaagtaattatagggtttcattgataccagtaaatgggaaatttctttcaaatacaactgttgaagttaaagatactgcatttattaaagaaaatattacttaaatcatcttacaagctgcaaagggatgtggcagcaaatgtgtggcatggaagtctgatgcttgggaaacactgcggtggggggaaaattgcaaaatgtcattggcaaatgcctcatctagggaaatgacccataggcaggcacacacagtagggtgatgccttctagatgtaaagttgaaggctgttttggaaatggggtagaaagggtgagggaaaagcccatatgtggcttatgatgtggagaacatccaggttgcctcctttccaaagtggcagtatggcaaaacccagattttctcaaactccttcttactagagaaggtaagctctccacatacaatgcagttgtatgttttaggtacatttcccaacctcacttggtcatggattgcttgtgtcattgtgccctgataacatgctcttctgaagaacatctgatcaataaagaatttagactttgcagccatacaacacaatactttttgtgaattagatctatgtattctacttttccttggttgaattgatctctccagtaggtatgaaagacaaatgtcaactcagcagttttctgactgtcctcagcctagcattctattttcatttaatccttcgttcttgcttgcatttctctttcagtctctccttattctccatttttatgacagctgtgtcaaggtacactctgttggtttattttcacatttatgcatatcagcttcccaagtagggctgcattagaaatactctatgagttaacgtgattatattgctaactccctgcttgagattttttgagcaccttagttgagttcatattccctttaaatggtcacaggaacacagctactcaaacttctaaaatagaaatcaagctcatttcccatatgcagcagtttaatgataacccaaccagagagaagctgtcttagttcatcagtgcactccaagggcaggcaggcaattctttctcaaggaatctgtcgattatcaggatctgaccaagaccatttccgagagaaagttcattttataattttatgatttttctccctcctgctttctttctaatgacctcacttttctgtttcatttctcaatcctgaacatcagaatttaaagagctcctttttatggagtgtatgctaagtggtctgttaggcaatatatttattacctggagtgaaatgactttccacagccaggcagttttcttagcctccttgctacctctatattttacaaagtcactttttgcattttgttggacaatggctttgtgtcaaccaggaaagaaagagtaaatgtgagtgtgtgtgtatgtgtgtgtgtgcctgtgtgtgtgttgggagaagggggccttaatgaatgtaatgagcacatttccgtttttcattttcctcagatgttcagtggcttccatatgtctgccgcatgcagctttgttcactggggttggtattactaaccttgggattgcctttgatggaggacatgtgtatctactgtatctttcccttgtgtttttgcctgagatccaatctggaatagctttgggactgagagagaggaaaaaaaaaatagaggggtgtgtgtgtgtgtgtgtgcgcgcctgttaccatccctaacagagatgctgggctgtcaaataaccccctccaggagacagtctctactgtactggatttagctggaagactcccttgtgtgactatggtgtgtctgcttggcttccctgccatcagtatactcgtcagacatggtcaagcaggtttgaagcttttcccataccattttcagtgacaatgtatttcactttttatctttgttccttggagttaggggttggcattcatacgcatgtattgcaaaagggcaggaggatgacccagcactaatttatccttcctcagtggccagtttttgacatttgtttccccagtttgggaataaaagaatatatacattggagttaggaagctccctaatctctggttctccagggcagctttgttagataagattaaggatttcatgaatgctttctcttctccctggagattgtgcatgggtaccagccattgtcagtgtcagcagagcctgataacagctggctggagatgcgaccactgcagcggagaagtgagcatcgggcagcctgggtgtataaatctaaagtgtgccctccttccacccccataacacacccactagagggctgcctttgtgtccttcgcagtggaaagagcaggcaaaggcaacatgtcagctcttgtaaaatagctgcaaaatgccacgcatgttcagagagaccagcactgcttgatttgtattcactatttacatggttgtgttcagactgaactcttactgtgattaagcagtacttttatttatattggaaagtatgtaaattgtttcccttttggcattccctacagtacttattgaagacttgtacattctcttgcttgcatgaaattaaagtccagtaagatggcactcataatactgggaggtaggattagatgtagctttactgagcttaaaatgaggtcttccaaaggctgttatggcttacaaaaggttaaaaaccagacagccttctctgtacctacagccttttatgagaaatgtctctacgtgctgtggaaatggtactacaggcctgtgagcccactaggcttttacttcagagattctctttttaagacaaacacatgcaaaaatatactggagagaaggatgaaaatgatatgcttctatactgaagagtaaaatggtcaagggggagacaagacaatctttcacacttttcttaaataagatgaaattatttctggctaccaccaaaaccatttattttcctaaagaaaatatcttttgtcttttgtttttttctaacagcaccatcatccattgctttggtccaggctaaagaagtcacaagatacagtgtggcactggcttggctggaaccagatcggcccaatggggtaatcctggaatatgaagtcaagtattatgagaaggtattacttgagtgaacaacactcctttcctttcttccttccttccttccttctttgttttcttctttcctttctccttccctccctccctccctctcttcttttcttccttctttcctcgactccttcccatcctcctttgctccctcccttctgtttaagggttagccagttgtaagtcatggaataccagtgaatcctcaaatcaaatgcattttgcttcccaattaagtatgattatgaaatttatcatttacttagttatcctgaaaagtagaaaataacaataatgataatacattgtattgtaatataactatatctttactttctagtaatggaaatcaagatagctaagaagttctaatctatgaaccttctatcagggagagtgactcataacagttgaaataatgatctgtttaagtagatcactgctattcagaataaagatgtgggttttgatgacttttaatagaaagtcagggaaggaaaatcacattcttcagcctcttaaagttatagaaaggcattatttttacaaataacttgtctctcttacaggacagaattttgaagagagctatttgcattcaaggttgtctagaaaatgaacagttgtcttctttttctttttaaagataatcacttattggcttccttattaaaagtagaaaagggacaggattttcccattgaaaccatgttacaacacattttacattttctagacagaaaatagaaaaagataagggaccttctcacagttatttcttttaaattgctgggtgtggaactagaaaagccaccaaccatcatttaatgttcctttcaaaaaaaaagagtaggaggaaagatctggatatggtcagcgtcaataacaatcatacctgaatttgcatttctttcaacaagtaagaagtaacaatagtacttataacatccaagagaatacaggctccagagagtttattcatctccatttactttcagtttctgagttgactggcttgactcctttaatattgcacctagtaagtaagcaggagatttattttgccaccttccccaattttatcttgccatgatgtaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacaggtaacaaggaccacccagactcagtcacttctgaggctatttttataatacagctgaatcccattacagtgaaatctaaggagttgtctgtaatttttggttcagcagacattttgctgcaatgaatatgtcttgaaataagttagccaatgtctgtaacttagaaaacttcatgtgatttagagaaaagcattttcgaaatactgatttgtcttttcctatgaatgaaaaatgttgcctatttttctcttgttttgagccttctagaaagcatgaaaaatgggattactaaactgacaaattgagggttacatagctaccctacattaatatagggaattttctccctgagaagattaaagaaggcgccaaaaatattttttacctacttatttttaagaatcatttaaatcaagttacataagcttttttttttttttaaagaccctttggacaaacatatcaaatctttaagcattgcgagttggattgactggttgactaaatttaaagtgcttaagaggggtctacccatgaacaagcattagtgtcagatacctccatcccggtaatcaatgaacccaaattgggcatgtttgataaaaagatgatagatttttgacttcaagaaagaaattttgttcacaaattattaaataagaataaaaggaaaagcagaagagaaagtagagttgaatctgaaggggattgacatcctttgaaattatccagcaagggtacaaggaggaagtggcttttgaactaggcaaaaataggcaggtttttgatagctctcggggaaggaggtacattcaaaactgctgccctttctgaaatgttcaagtgtctttctctctccaagtggcttcagaacactgaaaactgtgacccattcagaagttctacctcctaagactttcccaaaggtgacccttatgcaattgtcattcccagtgccttcccggatcattggagatggggctaactccacagtccttctggtctctgtctcgggcagtgtggtgctggtggtaattctcattgcagcttttgtcatcagccggaggtaagcactgaagccactcactgtgcagcccccgaccttcccagtgtttatgatggtttttttctcttccacacaaagctaaggcttttgattgcgtcataaacttggcatctgcatcccaagtttcctccttgttgctttgatcttcccacacccctaccaaagctgctagctgtaccctggtggcaggctgagaggtccggaaggacccagctaattgtaggaaacaaagctgaagagcaagccagtgggagatttctagatgctttaagctgccaggtgttacgtttatccctctcttaagcctggactcactgccaaaggcaagaaaaagccctataaaacttgggccccaattttgagctctgccatttgccagctactactacataaacctttttgagtctttatttctattctgtaaaatagagataattattatctgcctcaaagggttattgacaggagaattttgatacacaaaatagataatacagcacacaggaggtgcttcagcatgattttggttaacagtaatggtcactaaagcaaagaaatgggtacttcacactcagtcttcccccaggaaaagccatcagcatttccagacaatcaagggatttctagagattatcccttgagcaaatctcgggcatggcattgtcttggaaatgaacctgaaacatctgagcccttatcctctaagtacttacaatctgacttgatacttaaaaaataacctaaaaaggagagagaaataacaacagattggcagcatcttcttttgaaccagtttttcttactgtttttgtctccatttactcactcccatcgtctgcccagaggctccagaggagtagtcattgatatgtgccccacatctgggccttctttgtctttgatgtgtaagaatctgcctcttccctgatcggcatccccatataccatcaactgtttcacaagatggggctgttggtgaaaaaaagggctaagcctggggatgtcaaaaggatcctcttaaatgtaaagcttttcattctctagaagagggaagtagtcctaggaaagaagtaattcttgcccaagtttgtcgcattgccatagtggtaggctgagctgcttctggccccaccagtagctgtgcttggccctcaggccagtgtctgttgcattgtccctctctgcctactgatgatctcaccaatgtcatagcaatgcctttggctatttccactggcctgggcaagccactatgcttttactttcctctgatatacattataattagagtggtgaccatataatctagtttgcctggatggtcccagttggtacatgtatttatttaatttattaatttttttctgagacggagtcttgctctgtcgcccaggctggaagtacagtggcatgatctcgggtcactacaacgtctgcctcctgggttcaagcaattctcctgtctcaccctcctgagtagctgggattacaggcacacgccaccacacctggcagctaatttttgtatttttagtagagacacggtttcaccatgttggccaggctggtctcaaactcctgacctcaagtgatccgcctgcctcggcctcccaaagtgctgggattacaggcatgagccaccatgtccggccatgtatttcttaatatcatgctcccatcctcactctctaaagtgtcctggtatacagggaccaattatgttcactctaacataacacagtatagaaaaacacgttctgtacaggcatctgttttacaccgtgttcattgcttttcatgcacaatctatgaataggtatgtttgattagagtgatgagtcaaatcttgagatgttaaatccacaataaattctcatttctgtttctttaatacacacacatacaaaaacatatagacattggcatgccctctatattctaaacagcagaatatctcaacctttggaaacttaaggttgacctgcatagattttgaattcccactgttctttccttccctggtatttgattttgaaagccaatcaagatggccctctttcttgtacattgccatttagttttgtatatgtacgcatgctgtgcatataaccaccgggaactgtaatatccatctgatggtgggaagcaaggagcatgtgggggagtgtataggaattatatgtgcttttttgattttataattacatatttctatgtctgaaatgttcacagtatacagaaataatcttggttgttagaaaataaagatgtttaaaggtttaaaaacagatacaattcatgaaatacctccacctctaaaaatatttgataaaaattcagcaccctaggatgctcagagcacttctctgcagaaagtaggccttgccttgtgtcttgaccatctctttgacttgactggaaacattctctagttgtagtccagctttgctttagatttactttgcttttttgttttttggtataagtggccctaaatacagcagtcaaactggagtaatgagaaataagttacctcattgtaagtttcctttggatgttctgcttaaaacattggctttgatgaaaagaaaggaaaaacacatgaaaatgtaatgcggggagacaagtttattaaaagccgtgactacggaaaatagcatccttaagcttgatgacttaatttcctctctgcttttattgatcactttattatataaggcaggattgatagcaggatgcatcggatttccaattatgagtccccaccttagagaattgagcctgtcgagttacctagcgatgattcctgtcccttctcccccattaaaaaaaaaatgtcacttcccaaggctgataaacagtgcttggtgattggtcctcaatggatcactttttagaaaatgaaatgtcaaccccttgccctcatattgattcttctttagtgtcggccgtaaagctgtcatgggaaaggccgcccggagccaggtagctgacaggcttgcagcggctcatgcacactcagccaattcttctcctcacgcaggttgtctgctctgttatcttggactataaatgtttaaatgggacaagaacaggtgaacagagaggagacaggtagtggggatgaaagcctggctggcccaggcttttcgtgagaggacaaatgaaaggtggtacatggtactggcgaaataatcttgccagacttcagccagtagtatgagaaagcaacagattaaacaccctagcctatgaaatctgagtcatgtcctttgacgatggggctgctttgtgcttcttagaatcactgaatgtttatgctggaatggatgctacagatagatcccttatgggggtccccttgaactgactcccactctgctgatggcatgcaagattcctaaggaagtcaatggacagaaactcacgtagtgagaaagtttcagtccttctgatgacctcagagagaaaattgtcttggtgctaatttgtcatttaagaaagaggaagcagcctcaggctcacagttggtatcttgctagattttttttatagcaattgtttcatttatttcattgtacacatgcagcttatagggagaagcctgagcctaaggcaagccagaataatctacacttttttcagcgagatctacttttttcttttggccaaatggaacatgtaagcatttagggatcgcggtgaaagaatcaaactactaaatttataaaatacctaaaatgagatgttatactaggcacattgatttagctatattgtatatttttaccacccacatttatgttaagcaacttaattttatattttctgtaggcatctttgatctgtgtctttctcatcactcaagatataatttcagaattctttcagctttccagagcacataattgtacttgttatctaggttagtttaaggcagaacacttcttgtacctatatgatgctgtccctataaattttatttcaaaccacaaacaaatctctatttgtacattctctccagcaaatcaacatttccacatgtatatatttatatatttgtgatctccacaacataaccacttttctatattgtttttttaaagtgatctttaaaaggactgttcacagtgacatcctaaaatacaattataaggtcataacctccaagactaatgactgaatctatgctaattttctctgacaccctcttcccttttatagtaatgatttcatcaggttatctccaaaagcatcacaaactagtattaattcagattattttagggcagtgttttttccaaaacagtattaccgtattgattgattgattgagacagagtctcactctgttgcccaggctggcatgcaataactcagtctcagctcactgagacctccgcctcatgggttcaagtgattctcatgcctcagcctcacaagtagctgggattacaggcatgtactaccacacccagctaatttttgtatgtgtagtagagacagggtttcaccatgttggccaggctggtctcaaacccctgacctcaagtgaactgcccacctcggcctcccagagtgctgggattacaggcgtgagctaccacacccggccccaaaacagtattttattattcaaatgtgaaaaacaattttaagaaaagtctagaatacaagaatagcccctatttcttaaaggataacttggtagtgagggaaagtattactgataaccaggcacatgctgtttttatacgaaccttctaatgattgctagtgacagtgggtttccatttatgttagggttataaagtaccccttttacctggataaggaaaaagaagtgaattgattttaagaaaaaaatgaagtggttatggcaaaatttatatatatatattaggtactggaggcctaaagagattaaacaaataaacgaaggtcacatggtgagttagttgctgatcaggacaggaattcagctctcctgacttccaatactgggatagatatattattttaatatcttcttaactgacaaagttgacctacataaaaaagctgacattggcagttctatggaaccaaagcttcaagactctgctagtgatgttggtaagatttgtaatctgtgaattaatatgcaaatctgttgcacaatataaagtcagagtttgcaagttaattttctcctcctattgaaggttaagatattccactttggagctaagagttcacacaatgctgaaacagttatggttcagcctgtgctaccacacctggttaatttttgtatttttaatagagatggggtttcaccatgttggccaggctggtcgcgaacccctgacctcaggtggtccgcctgggccctaatttccttccctggaatattacaatcatgtgaaaatgaaaacacttaaatgttagcctaattcagctctgatgaagtcatgtaaattcacacaagtgggggcagatgatacctcgggaacatttctaaacaacttgcgtgcaaccatttcaacatgctactcatgaacaccatttagacatcattcggtgcaagaataatgacagcttaaagaaggagaaaaagaatggctgctgtgaatcttcatgggtgatgccgttcagtgctggaaagggacctcctggagccatgctagttacgttgctttatttttaatatgcactttagctgaataaattacttaccttttactaattagttttggaacagtgaaccacatcaatcaaatctgtccacttgaccagaaaagtcagtaatttagtaaaagcatggtttatgctgggcccctgccttgctccccctctctattttgtttgttatattgaatagtcaaggtgccaggaacagcacgttggttgagagggctcacgctgttctgcaacaatgtctgctaatacccttattaccatgtcccttggactgcaggagggcttagttcacactctttcaaagtttcacctgcaatgtgggctcttttctccaactcctgcggctgaaagggtccatgtttccttctggagcattcactaacaaaacactccactccttcccagttttaatcagcttgtccacatctctgtaattagaaaaccttcaacaaagttttccttctgtcattcaagtgatcagcctgagatgtcagttttgagttaggacttcttcaggcagtgtggcttcctgcaggctggctgccccagtggtgaacttcaatgggctttctttcctgggatgataatgggccacactgtcctacactgagccaaggcaaaagggccatcaggtgttaaaggtagaacaggacacaggcatttttgttttccaggtatttctaaaaagcaaacagactactattagcctttcaacagtaatccttgtggttttttttcagccatttcctgcagtcttaagggtcctctcctccaaataacactccacgtaaaaaaatctcatttaaaaacacaccttcaccactaatttaattcctccttctatgtttagaagtctgaggaagggatgggcgtgtcaaccttataattaatgacccctgtcattttgtatttcctctggctttgcacatatttaatgaatgtgcttgatgtaaaacagataaacgctttcccgggcagcttcaggccatgggtttctatggtatattccaggtttttgtttcattgacaattttaagttggtaccaaagctttctcactctatgcatttgtttttccttcttcaaaggaaagaaattcaaatcagtgttcgagatcttaagtggtttaaaagagatactagtaattttagataatgcttttaggagctctgataagacacaatgtttcaggctggcaggaccctatcactcccttgggaccaatcgatggcattttcctgacataaaatgttattttagtagtccctgacctaacactcttatattcctttaaaagaagggaaaggacgggggtggagggagaggaagaagattggaggagacttcatcttttatagaaagttgtttggcttcagggtatttaaacctgtttagttacttcaatgaagcaatggattttaagagcaattgaattcactttaagtgaatgtactgatataaaacgtaatactacttataattaactctcaccaggtatccttatgtaactaatctccagtaagagaggctctatgaagtcgtgggctggatcagggctttcacaaagtcctgtacttgctaggagagcacgtggtgatcctcttgctccccaccccccaccccaccccagctccatgtcctcatctacagggaatctgagcatgtgtgtctgcctggttgctttcaaagggttgtcatgaagatgcaattaaataatagattctggctgggtgcggtggttcatgcctataatcccagcactttgggaggcctatgtgggcggattacttgaggtcaagagtttgagaccagcttggccaacatggtgaaacgctggctctactaaaaatacaaaattagccgagcatgggtggcgggtgcctataatcccagctactcaggaggctgaggcaggaggatcgcttgagccctagaggtggaggttgcagtgagctgagatcatagcactgcactccggcctgagcaacagagtgacactctgtctcaaaaaataataaattaaataaataaataaataaataaaaatagaccctttgaaaagttaaatgcaaaggaaaatgcaagcttatgatttgggactgaaatactgtacttcacagttagctgtagtcattggggtctctgttttgctaagttggttcctgctttgcaaacagttagggaaggagataatatatgagatgagagcactttgaaaagttaaatgcagtgtaaaagtgcaaggttttattatttgccagggaattatccccacggagaaacatctgtaggctctgagggtctgattgctgagctggttcttgcgctgctgacaattaggagaggaatgtgggagggaaggttggagcatgtgaccgggatccgctgcctctctggttgcactgcctggctcctttaggttctctgttattctctctttttcgtaatcatctgcctttctacctgttcaaagtttaagagttcagggtataggattttgacaggaccacactgccaagacacctggctttgcgggaatttttacttatctcagaccgtgtttctttttctgtaagagtcttgccttaccttgtctttgaagctctaagaaaacatagaatgtaaattccagtgtaaattgtacctttctgacagaaacataaatgtatacattttatttactaatttggtctcaacttcccaagctttagacagctgtgatatcaacggagttgactttctgattcctttaagtgatatatattctcctgactcactatgtatatatattcaagatttttgatttgcaaggcttgagttgattttccagtttgtataagagagatatatacatttctgattgaatatttatgtgtactgaagatttctaatccacaaagctttataacaaagccaaatttaggctattaaaagttgtaggagcagaatgccaggtttaagacaatgcaccattttactgaaagtgaattaggcaaagcaaaacaaagctcatttttacccttgctcatttttttacaaattagggaacataattcagtacaaagcaaatacttacttttaaacattttgttaataagttgggaatttgtatgcagcaactgaaaccagtgaccgcaaaagtattgtttcaagagtatcatgtaatatgataatgaagttttgtggtagtagttatctggttatagcaataatatttactattacctatcacatactgaacattactgccatttgatttacacagaattactcatggaaatttaatttagaatgtatatatacatatacacacatgtacatatatatacacatgtatatttatataaatggaaaaatagccaataaacttatcttcaataagataaattttctctgagagattttaaattataattatattataaaatatttgctttaacctattgtaagacacctcagtttaaaattgtggttcagaggtgtctgtgactgcttgagcttaaaaccatgactcactacccaggtgacaagtatttcatctcttgtaagtctcagttttctcatctctgaaatgtacatagcatacctgcctgacttacagtagcaaagaatttgtcttatggcatgtgttaaagcttaggtgtttgaggaaaataattctcttttttaaaaaaattttaatagacggagtaaatacagtaaagccaaacaagaagcggatgaagagaaacatttgaatcaaggtacaaaaaattggattaaaaaattctatttttagagcatgtcacacgttttctagtttaaacatgttcaaataatatttacgtggctattaatgttatataatataatatatttattccttatcccaataatgtacttcctaggtatcaaactgaaatgggtgatttggatggtgagattaaagatgtgggatgaggtagagaagtttctttagatttttactttttcttattttatcctctaccctaagaaagttatcagtctagctggctcattgttgtagctgggtggcaaaattaaatgggtattttttttaatctaagctggaaatttgaggaggaggaaaagaataagaaatgtaacagtaattgctacttcccagggaatggctatatgtgatatagaattagtgactgtcaataaatttttagtggattctaattttgatgttccaaagaggtcaaagaagacattaaaagtggctctagagtgacttaagcaaggtagaagacttttttttttttttttttttctgacggagtcttgctctgtcggccaggctggagtgcactggcatgatcttggctcactgcaagctccgcctccctggttcacaccattctcccacctcagcctcctgagtagctgggattacaggcacccgccacgacccccggctaatttttttgtacttttagtagagatgggatttcaccgtgttagccaggatggtctccatctcctgacctcgtgatccgcccgcctcggcctcccaaagcgctgggattacaggtgtgagccaccgcacccagccagtagaagacttttaaatggacagtggttggtgactatccaggagagctgtccactagaactttctgagataacattgttctatatctgcactgtccaaaatgtaagccaatagccacacaagctattgaatacttgaaatgtagctaatatgactgagaaagtgatttttaaatttaacttatttatatttagatagcctcatgtaacaagtcactcacatattagtgcagaaagatagaagaaagattggccgggcacagtggcttatgcctgtaatcctagcactttgggaggccaaggagggcagatcacttgagatctggagttcgagaccagcctagccaacatggcaaaactccgtctctacaaaaaataactaaattagccaggcatgataatgcacgcctgtaatcccagatactcaggaggctgaggcacgagaattgcttgaacccaggaggcggaggttgcagtgaaccaagatcctaccactgtactccagcctgagcgacacagccagactctgtctccagaaaaaaaaaaaaaaaaaaaaaaaaaaaagatagaaaaaaagagagggactgggaataacaagactcatcttgaagattttcttggctatagcatataaagtgatgagggatatgaagtgtctaacaactttccatttattcacctcgtttcctcctaaaatcatgttttttaaatttttacatggaatatatgtttttttaaaaagctgatctattaaaaagaagtagcaagaaattgccaatttaaggagcttattcctaaccaatggtgctgggatgaggacaagacctacaggcttggaaagtcgaagggactgggccaactggtgtccttcataccctctgtgccccagtgccccaacagctccaggagggagaggtgcaagtgccaggacaaagctttttacaatgacttctgcctcttggcccagatatctgtcactgggctgccggcaaacacatctaaatttagtttatgggtagtatgagatatggctgaatcatacttcctgatgtctaggctacaatgcttatctccagctgaaactttctggcaaacttgaatatcttagcttatgacaccttctttccaaaccagaaaagaagtgaggtccactacagagtctgtattctcaaatcaactagctgatattaaccttattgtctactttaacttaggtttaatctaattttgttaattgttggtcacatatttaattcatccagatattgggcaaaatgtgacaccatgtggaaagagctgtttgaaattaaaatgcttctatttccttccctaagggaggataactgaaagtagtgggtaggacttcatgcaaaggcaagggagctatgagcaactgcttgggacaatagtatttagctaacacaattcaaatttcctccatgggatgggttgttttaaaaatcttgtccttgaagtgtgaagacattccaggaagtcagtaaagctgcagcctcttaagtagctaacaatattttgtttacccactaatgaaaaccagagcaagaatttaaccattttcatatgtcaagaccgtacagctaacttgacttttcctatgtttggtaattttagacccagactatttatgtttattagtggttccttagaagtattcagccaacttatcatgtttatcactcaggtgtaagaacatatgtggacccctttacgtacgaagatcccaaccaagcagtgcgagagtttgccaaagaaattgacgcatcctgcattaagattgaaaaagttataggagttggtaagtgtctgagtgtccgtctgctaatgagtctgttttcttggtggatgttaaatatgtgtgtggattacataaatgcttttgtgagtatattatatgtgtgtatatacatgaaatttccttttttgagtataaaatatcatgtgttataaagaactctagtacaaattttgattttattcttagagagaaacttaatgcaatctgaaatcagattgattgcattcaaaagatttactctgtttcttactaactaagattttgtgtaggttttttgcattaagccttagttttctctaataaaatggggctaatagtagcatctacttcagggttgcatggaggattttgtgaaataatctatgcaaagcactagcaaacagcctggcgtgtaacaagcactcaaggaatgttagctgttattctttcatcttgaatgtgtttctggtccatcgtagattctttttctctctcaaaggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtacgtgggtcaccccctttacaaagccaagctagaagttactgggaaattaaacacacattttctttccagggaaatgacagatggcgcagacccactgattgctaataggaggaaatcagtgcaggacaagtcattaatcttgtagtcagctctaaatgggtctttggttttggctggataccctatctccaaggcagcttgtgtgagattttagagaaattaatattgcagatttttggtatgccatgccatccttcagatatttgctaggccaaactgattgtcatagggtgggctcaagcagatggtaagcaaaataaaatttaagtacttttcctataaagcacaacaaaacctggccacaccttgtgctggaatctttggttccagatgcagagagtgaagcttgggaatcttgaatatattgcgggatttgcttgtctgctctgcctgatttatggctgttgcagttcagcacctatttacagtaacacctggttgaactttccttttttagtccattagcattcgctgagcctatgaaccacgcttcagttaaaatgcgacacagctcaacagatgcattttgtgaagcaaatcctgagtaaatctgtaaggctggctaagaccaacttataaagtgccacatagacagcacagctgaggcagtccctgtttaaggtggctgtgttccaagagccctcatacacactacagttactacaagtcaaggatctcataagcctggggctgtgtcccctggaaagccaaggcttttcttctttgattcaaggtgtctgtggaaagcatcttcagtcagcgtgtgcagagtaatggcaatatagccaccccagtgtgggggagcagtcggaggagggtaggttaaagagaaaaactgatgctgggtgtaatcactcatacctgtagtcttagctacttaggaggctgaggcaggaggatcacttgagcccaggagtttgaggctgcagttgagatgggtaagtttcctggacccctcgtgggacttgtaatggggtgtgacttgttttgcttggccaccgagctcaaacttcttgtaggagggggagcacacagtttagcacctgcaggagcctgggcgagtggttgccagtgacctctggagccccaggtgtatgttacaaataatgctcttttagcagttgtcatccacggatggctaagtgttaaccagctcagtggagagtcggggtgacagcctttttcaccctcccgtcttggtacctgggttcctgtctggtgtccaggaagaatcaggtcacatggacttgaaggatggtgaatgtgtaggttttattgggtgatggaggtggctctcagcgggatggggagctggaaaggggaaggaataggaagataatcttcccctggagtttgactattcctaaggtaatgcccacggtttccagtgttgaaggtggggcctttgcagggaaccaccctcttctacccagtatttccctgccgcctgtccatatcattcctagtgagctacgatagtaccactgcaccccagtccaggtgacagaggcacctggactctatttttttaatagaaacctgtctctacttaaaaaaaaaaaaaaaaagaaaagaaaagaaaaaatgagacattaggcctggggcaggtggctagtaggacacaaagtacaaaatctttaggaagaagaaatgaggtggttactaaaatgggagagaaagtacacactatacagttcaggggtcctcaaacataagaatcttctggaaagcttgttaggacagtttcttgggcctcctgctcagaggtttgattcagcaggtggtgtgcggcccgtaagtttggagtgcaagagagctcaccacaggtgaagccaatgctgctggtatgggaatcacgctttgagaaccattggcctggggacaaacgaccgcataccacctctgctgcttctaaagcttgtgaccttggactacttgttcaatctttctctttcagttttctcatctgtaaaatggaggtaaaaagagcatttgccttataaggttattttggggatgaaatagaatacttagagtggttaccacaatagcaaattttttcagaaaaaacctcgtacgtgttcagtggtgctattatgtcttaagaagtaggtacatctttccccatcttcagaatctttcaaaaaaaaaaaaaaaggaaccttggtgagaaggatatataattttccgcataaggtgaaggctataattagcatagaatagctctatttgctttttgagattagttttacagacaggatatttttctgttgcctgtggccttcagggccgcccagagcccttcactactttaattaaaagataacattccctttaaatacttttgcaggtccgttttctaaaaaggaggctctgttcagcttagggtgtttttcctgtcgcagacagtgattttcctagcacctctgcagaagagagaagaaacaggggatctttgtattaaagtcccaccgcgcctctaaaacacgtagctattacagctgtaactgttataaacgactggatgcatttgcataatgcagttgtcactgaattaaaatgatttaaaatttctattggagaagctattcccttcccccacccctttcctccccactgcatccctgcctactgcagggaaggagactcctctatccaagagcccagcccaggcctattttataagcccctttgcttatggagacattcatctttgtttcccttgtagagctcataaaggatctgacaaatggatacttttaataaacagaaaatggaatgcagaaaatttgtgaagatggtgccaagagtccgactagggaggtgtgagggtgaaagggtagagtggaagcgtgtgaattcattaccagcagttacttgagtaactttttaaattggcaggaggaccataaattctccgcatgaccctcacttttggatcctctcctgtcgtctccacagctccagagggatctggtgaaatgcaaggaggtgttaatgcacagccatgagaggctgccctttctcgttagttgacaaagtatcttttgattgaggcaggttgattaaaactcatttaggcacatttgttctgtcagaagactatggtcacaagctgggctcggtggctagtgcctggaatcccagctactcaagaggctgaggcaggaggatcccttgagcccaggagttcaaggctgcagtgagttatgatcatgtcactgtactctagcttgggccacagagccagaccctgtctcttaaaaaaaaaaaagaaaagaaaagaaattcacccaggcttgagtgcagtggcacgatcttggctcactgtaacctccgcctcctgggctcaagtgattctcctgtctcagcctcccgagtagctgggactacaggtgtgcaccactgcatccggcaatttttttttttttttttgagtagaaaaccctggtcacatatgtagagggtaaatgaatctgagaactaagcatttcctatttgtattgatagagaatgtgcagacacacccctgccagcgtagagaaaagacttaaaagtggttttatgcacctttggtctgcaccaagattcccactttttctaccagccttctttcctcacttgaaaataaaatgtccatggtaccattttctaatgcaaaagtgtttgcctctgagtaatttcttagacacaacaccaaaaactcaagcaatcaagaaatatcacaaattgatatattggacttcatggaattaaaaacccactcttcaacacttttgcccctaaggtgaaaaatttccccatgccctatatgccagaaattataagctgatggaatcactgggtggaaaatgtatttctttagaataattatgggtgcttttcagcggtgaaatagttcagcccatttttctagactgaagtctaaataatcagccaatgcagcaataaaaagtgtgattttttttatttttatttttttagaatgactctcactctgtcacccaggcttcagtgcagtggcatgatctcggctcactgcaacctctgcctcctgggctcaagtgattctcttgtctcagcctcccgagaagctgggactgcaagtgcgtactgcacccggcaaatttttgtatttttagtagacacgaggtttcaccatgttggctaggctggtctcaaaccccttgcctcaagtgacccacctgcctcggcctcccaaagtgctggaattgcaggtgtgagccaccgtgccctgccagtgtgaatatttttggtatatcaaactgacattttattttcttccaaaggaatattttagggacctgttttatcctgctcttagaaaaaacaaaacaaagcaaaaaaaaacacctcatgattcccaccctccacttgccaacaataaataccctttagaaagaaggaatttcagaccttgagcctattgcctgtgatcaagaaggtaaagaatggttcttatgtcctaaagtcctcagaaagcggacttttgtgaaaatcttatttacacctcattctgctcagagcttaaaatcatttttatttctttgcagaaaaaaaaaataggtagggggaatgggggaaataaggatgttctagtattgaatttaaattcctgtctcagatgaaataattttctgaacctttcctgtgactgttctggggtttttgtttgtttgttttttgaggtaggcagtttaaggaatcagaccaaagcaagtttattcatagctagggaaagtgaagagaaagacagaggccctgagctgagcaagacagtggagagaagtcgcatgcttgtttttttgtttgttttttgagacggagtctctgtatcgtcgccccccaggctggagtgtaatgacgcaatctcggctcactacaaccttggcctcccgagttcaagcaattctcctgcctcagcctcctgagtagctgggattacaggcgcctgccaccatgcttggcaaattttttttttttttttgtatttttagtagaaacggggtttcaccatgttggccaggcttgtctcgaactcctgacctgaggcaatccgactgtcttggcctcccaaagtgctgagattacaggcatgagccaccgaacccgcctgcgtgcttggttttaaggcttgtctgggtaaggaaggattcaacatagctactgctccctgaaacatggatttctctaaataaagaagtttattgcctattgacctccttagcttcttacaagtggctcttctgaggacaaaataaattaattatcctaaagattatttctgcattgaaacaggcctccccatttatcattttccccttttgcttgagagagcaattatccattcatatgctccctggataccagaggccactttagttaaagaccttgtcaacaagccacccaaaggtttaactatccagatggaatttaaacctactcgtccttttaatatttcattcctagctccccacagctgaggcataagcttggcttgttttaattaaattagatcacacaagacaggtatcttggcagtaaaattgtgcgcagcccatttttatctcattaagtgcagcgctcatcaaaggtttgtgtttttctttctgaaaactctaggtaaaccagtaatgatcataacagagtacatggagaatggctccttggatgcattcctcagggtatgtgactactttatattaaacccaagaatgttggtatttagaaaactcctaacagagtccttgtgtttgttgtgttcggtggtattcgtggatttcttttaatgggcaaagaaagaagaggagaaatggagaatgatgtgatttttaaggctattaaataatccatgttcaacgagggtagtttttgatttattcctgtaatgtggagctgttggagccgtagattcattacagttggataatttccatctatcacaggaagcaaacccagctcctagggtacagtctactagtgaattagcgactttggtcagaaaggcctggaaataatgttgagtttcattgcataccggatacagatacccaaaaagattcaagtaataaatgcttggtgagaattaacttggcctaatgctaatgggattgttcctcactccttttctatgcagaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccagggtaagaaagatcggtgacatctgggctttcactctggtgaaactgttcctctcttctcactttgagattgaagccctttgtaatttttttattttttaagttttctcatcccttgaagcctcctcatattcctgcatccatttttaaaccatgtttccaataaaagagggattttgaagctgactgtagatgtatgaccatattaacagccacaaactagaagcaaaatgaattatctttccctctatgtttttttttgggagggcagggggaagaaagtgctaatgaacaataagacggtgtcttaaataaaaatgagctgagaagcaagcattaaggatcagtttacacaacaaatgatcaattactgagaaaatcaggaggtagcttcacttatttatttttttgcacttgtatttgcctgcctgtcttcctgcctctttcttcctttttttttttttgttgttgttttaggttttgtatttgccttttttctattctttaaaaaaaatccttattctaaatgagacaaagcaatgtttctagttggttggctaccaaatctcagaatgtatatacaggatttataaaacatttataccatgcaaggttttccagtatctaatggccttcattttaccactggtagataagcggggattaggacacagtgaagagttttaagtacacagttaatggctgtgctatcttagctcgactatctgaatataaaatactaatggaataaacacagaatcataaaacagttattggccattaacactgacactgttaaaatcaacacgaagctgacagttaccagccattttccccttttaacactcttcattttgcatctgcaatcccaagcaatgggggttttttgttgttggttggttggctgagctttttttggaggggggcaggggggtatagtattctatttctttggctccagttttgattcttatgcttgtcctcttttgaattccaagtccattcgtttagaaaagaatagatctttgtgaatgttgaagatcttttattttttcccagtagttggagaaagaaaagttaaaggaggcttctagaatgatacatttacatagataaaaccttagccaaatatttaagcaggggggaatgcagtacaagtgtccttctgtgcgtaacaaggatgaatgcaatacactgggttttcagagtttactgcaatgtatcaaagcaatttccagtacaatttattgtcctgtttcgtagccctacctaagaaagcaaagaaaccttttaaatgatagccctggggatacctcaggggtctgaattagacttgaattaatttccccaggtggaaccctaggacattgaaaacctgactgaaaataccttatacctaagcataaacaaacaagacatttgaggcagaaaaaaaagtgtgttttgcaacttttcctgggtaatattcacttgctttaccattttacaagtctttttttttaatttaataacaactaatatcctgcccttactccattaaagtcattaatagctctagtatctggtattatttggctttctctaaaggcctatttatcatatcatcccctagctattggacatatttctcatgctgtataaggggaggtagacttgtgtgatggatagaaatgttcatatttaaattccttcattcatgatttttgaagcagtgtaagcattgccttcctttgtgctcctgggtgagagaatccaacaaaaaatcaaacaaatgtcagctacatatcactgataccccgtagataacacgtattttgtaaaacctgagatttctttttttctagaatattgccttaagcagagctcagataataggtaggctttaaaaacataattagattacttagtcacttccctgtgagtaaagaaaacataagagaactgtgttaacctggaagacttgcgttaaaatgaacaagtgtcttattgttttgagagctatctcaagaatgctgttgtcctgcttggctagcaggaactacattcagaatctaaaatggcacatcagtgatgtacttaaggaataacttatggctcaaatgttcacagggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtaagtctctatgttctgaaatatattttttcacattgagattcaggaagttctgcattactgtatgatggagtgggcacggggtttgaaatgatacattaaactcaaatttcttaatacagatatatctagcaagctagttcaacattacaaccaatgactattgatttcaaggacaagaattaaatggcctacatggtacagtatgggagatagatacatacgcacatagattcatggataaaaaatatgggatagtatttttacttggtgaactttcaaaaccagagtaaaacaaaattaaactttgacttttaagaaaatgcaaagattatgaaaaaataaatttcacatatgataaaacggacatgaaaggcttattgaaagaaaactagtgaatattttaaagctggcatcgttgtaattagagctcaccccttgaggactctaaaataaagcttcactcaatgacccttggtaaattatgcacatccctttaaatgtaccatctggactacttcgtaagggagtatccacaatgactgcaatttcagaaaaggattcaataatgacactaataagattccagagtaatagaatttaattacaaacatctccagtgagaaagaaagaaaaaaaaataaaagaaagcattgatcaaggggtcttcctagaacacgttttagctaattctggaaaagtttacattagttctggtaagattgggaatcatattaaaattaaatggccacctatacttttcgaactttcctaattttttatgtatgtggtagtccattatcagagagtgtttacaaatgcaaggtattcagtttatcagttataattatattttggaaacttcttttcaaaaattctctctgtggtggaatgttacctatccatctgccttgtcttcctccaacaacaggcagttgcacagccttgacagttagagccacgtgcacttaagaaatgggatgcaggttgccttatcaattaaagaatgttcaatgcaggccgggccctgtggctcacgcctgtaatcccagcactttgggaggccgaggcgggtggatcacaaggtcaggagttcgagaccagcctgagcaacatggtgaaaccccgtctctactaaaaatacaaaaaattagccgggcatagtggtgggtgcctggaatcccagctactcaggaggctgaggcaggagaatcgctagaacctaagaggcagagattgcagtgagcagagatcacgccactgcactccagcctgggcgaaagagtaagactccgtctcaaaaaaaaaaaaaaaaaaaaaaaatacaaagatttgctgggcgtggtggtgtgcgcctgtagtcccagctactcgggacgctgaggtaggctaatcgcttgaacctgggaggcggaggttgcagtgagccaagatgacaccactgtaattcagcctgggccacagaatgagactctgtctcaaaaaaaaaaaaaaatgttcggtgcaatagagaaatgcactccatgtctggtggggcaaaaagaattctctatgctgaccaaccagattaaggggaatggtagtgttcacactgtattatctgtggattataacagaagattcatagcagatgggaagaaagcagctagcctaagtgatagtaattacaggttggaagaagactatggaggggaatagcatgtaatctattgtttatgtgattatgctgtgcagacagcttctagtagcttcttgtagccacatttggattcaggttagagactctcacagggacaaagacaaaaaacctaaatgagcaaatagtaaatgtagttactgtaattattcgatacttaagctttctttttcttccgttgaaatcatggccaaatgttcgtaagagcagagtatctaaagatgtcagtttttctaccctaaatatgttcagatctgtaattttggcagtttatatatatgtattttatatatatatacacacatatatataaaaaaacaatatatatatataaagaattctgttgttttgaactttcagttctctggctttatccacgaaaaggcatctgaagccatttcttgctcacaaataatattgatctattatttgtctctgtgttggattctatgtagaacaggaatcaataggaaatgtatctggggaattactttgatgcatagaattaatttggcatatggtaaatggagtgaaagtaactgttgaaaatatgtcaaacttagcaagttttttgtttagtttaatcctctgccccccaaaatatttagtagtaaactgagaaaatatgctttgctaacctatgagccatcttccaagctggcagtggatagggagcttatgaaagagcattaatcagtctgaggggttataacaatttatgttccgctggcatcagcccagtgttgctttcattctcctcaattcagtgcaaaatgttctcatcaagtctagagtcaacacgatgcacctgggaagataaaagaaacccaggtgatcaaactgacgtagtgtaattgctagaaacaaatagaataaggttcaataagacagcatagagaagtctgctttacaaagaaaagtaggtgatactgatacatgatattggcaaaatacataggagaaaaaggatcagagggcttaataaatcacaagatgatttgttaaactgaaacggtgctcttattaaaaagatcacagtcatactaatccatggaccctggacccaacagactcttttctttcgaaggccaatttctgagcagtcaatagacccaccacagggtgagtccagtgaagtcattgggatggctcaaccactgcttatttctctggcagctatcatgttgatagaaagaaaaataaatggagtgatttaaagcaaataaaacttttagactcccaaacaaataaaagcacctccagaatctcagaggatatccataaacaaaggtaatgagtagccaaaaaactgtgaagtagttctcctctataaatttggcatgtcctaccatattattttcttggaatttataccccaaagcagggggaggatgttagagaaaaggctataagaaaataatttaatgcctgtgaagacagattagaaaaattagaattagcaaagagactgttgaatgagttatttatgacttactaggcaaggagaccactctgggcactctggatggtcttggccaataagacaattatcatgtaccattataacttccttctttagatgtgcgagggtctcctttaaaatgtaaatgccccaaaagaaggaatttttttaattgttttttacttttttaaaaaaaatctacttactaacacctttaacagggtcgactgacagccaactgagaccaagaaagaaattcagagttggtgtctaggggtagagtaatccaaaagaaaaaatggctgggcgtctggacttggactctggtgttgacacactggctgtctatgtaagaggacagggccttaaaaggaggcaaagaaaattccattttggagacagctattaattgcttcccaagggaggtctttggcactaagtcagagtctcttttgcgaagagtgtttaggtgtgctaatagcagaatggagcggggcaggggactggaggcagggggcagggggcagggccacatgatctctgagggccgtcaccaaaactgacaccacattgtggatttgactgggctctagccacttgagaacattgatgcatcttccctttagagtacacctcagtgcaacagctggcttccctctcctgttgccagtgatactcaggtctagctttggctcatgtgaaggagttggagctgttcccaggctccagcttgctggcagcttcatgcacaagaaacatgccagtcggaagggtgaaccttgaacagcagcttgcctggcagcttaacataccatcctgttgtcttccataggtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccaggtcagccatgcttacttaatagtgatgtatgaaagaacacattagaggaggcaggcaagtggtgactcacttaaattcctgccttttcatcagaggccacttcatggctctctgcaacctgggtggcttctttctcaattagtagagtatttcaggtagttctattcagcattttgaataactaatacctgtcaggcatcaaatagttataaggaaaaaactttaaaaaataataatagtaggaaagaaataactgaagtgcctattttaggatgccaggcctgaaatttaggaagaggggtgaaatgtacttttagaagacgttcagatcagtaggtgctatattttgaaatggggcaggaacactggaatagtaagaaataaagattagaaaacaggtctttaagcatggcaattttaagttgatttataaagtgttaattgtaagaaagagattcattaggtttcagttcttctggtttcccttttctgagtctttcagagtaggaggaaacagggccaagataggaaatgattgagttataaagcatgcagatgaatgtttgggaaggattttaaagaccaaaatgattggaccacctgaaagaggtagttattttcttggaatgagcaaaatgaagaagtatatcagtctgtagagaacataaagatactataagtcctacaagttcagtgagaactttctacatggagaatggactttactggtataagactcaggatacctacatatcagtagtctcatctgaaagggtgtggaccatctttatcagttaaattattttagaatacaggcataatagaccaggtgactcaggcctgcgagaggtgagacactcactcatctccaagtctgagcttctcacaggcttctgtttcatcatgatcctgtgttaaaaataggaggacattttctcccgtaatatttaagcccttccagtctttgcaggccctgtggtgttctcctctcatctttctcctgaaaacttggactaaagattctagaaaagaaggaaaacacattacatgaaaaaaaagagaactgtggaatagatagtagagataccctatattctccaccaggttttcaaatccctgtcattagccactacacaaaatgctcaatggtctatccagctcttttcaaataacactgaaaagggctgaattaacatttcacctctgccacttggtcactatgtgaactaaaaaaaattaaaagtctcctactattgtgaggctatttcttgttcttctgttctccaggagggtgaaatagatgactataaggcctcctttccagatctagctgacttctcttccaccttttagatcttcagcaccagagcccatgtattttgtctgagggtccattcaaggccagttttttggtgtttggtacttcttctgttagcataagtcattcaaccactactatcacatagcatctgctttgccccaaggtacagaacaagttgaggtattagatacactattatcagttctaaattctttttgctgatggtacttaaatagctttgaagcttattatggcttacctataatgagatgtagtataacatggtatgtgattcagcacaaaattaggctaacatcatggtgtgctaccaagagcacagaggcttccagaacaagcttaagaaccacccttaaagttaattgacatcgagtgaagatattttcattgtaaggtcattttgaccttgtcggtgctcagagcctacatcttcctcattaatgcttttggcttaaagtcagaagtaaatgcaaactattggcttttgtctaataacaaatattattgctatatatccacactcaattaaatgtccaaaattctatgtggtaacatttgttgttgactcaaaattgaaagaataattatatcttgattatttttgctgtaaacatttacagaattgtacttagaaaatcaaacttatattgaaataatggacacaaaagaaaggttacaatggcaaggtattatttggacacaaaactgactgataaaacaaatctttgttaaaatatttatataaaaaagaaataatacaagtcaagtcaatttagataaaaatgaaaattttaaaaatcgaattggattaattctgctatgtagaaaagtaaagcattatatcgacttaattttgtttttacaaggaaagagttttttggttgaaaatttagtagtaatgatataattgtgatttaaatgtttgtacttaaacatagtatcacgttgaaaatcaggtcaaaatgttaagatcaaacacattctgtgagttttaggaaaaacagaagttcaaaaactatgacttaacaagtagcagtatttttctacaggttattataagtaaaggtagtataaaataaccccatgaaggcctgctctatggttattcagcaattgggtgatgaagataactaactataattctcttaatagtttttattagtaaatgattttttatatgtcaatatcattaggaaaggcagaattccagcctgtaattgcttgtgacagtgacctaatagaaaacacctggcctaagaaatgagtaaactaataaataagttaataagaagtgctttgaatttgttgaaatcattattcaggaaccccagcaagggaatacgagaagcacattccacaatccaaacagtgatcaaagtggccgttcttctgccagccttggcactcgtgctggtcaggcatggattgattaaagaggggattaactccctgctgtcccaagtttgtttgaatgccccaagcctgcctgtagactaggctggaagcatgctggacttgaattcttgctgttttctctgcttccatccagtctggcaggtggcaagctcgcagttttccttactcatccttcactagggtttccatagttgctgaacgaaagtctgtaatattcagtactggcagagactggactctttctgcaaagattgaacaggtttcggccatgagggctctcccagtcttcaccccaggctagggtgttaaaagacctgctatgagcatgaatgccctcagagggccacataaaacaagcgcaggaaatagaattaagaaaaaataggatgattgatacatgctttagcagctttgtgaagttaagagcaaaatattgcatagttacatttaacaacaattgttccatttaaaaccttcccttagcttttcagttctccttgcctatttgaggcaatcagatttctgagtcttcttgtctcactggtagctccgttctgcttatattttcttgttctctttctagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggagtaagtactcaacgatgtaacacgaaagggtaaatctagatttaatagtattttctttttttgctttgagctgcgtaatcatcctactcatttaaaaaaaatctggaatgcctctcattttgattgagtataattttacacagcctctataaagtatctacattcttgcattaaattgcttaatgaaacattttaatacacctgccttgttgtgctgtattaattgtggctgattcaaacgtgtgtctgcatgaagcccaagaaaagagattgtcagtccctgtgacttcttctgtcccttttttgtcgccctatgtacagggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaaggtaagtccaacaaccaagaatgattttttctccagtgaaaactccttttgtgctttaaacttgatctcattcgaaatactgaaaacagaaaaatactctctcatgtctctcaggttgtgttgatgtttttcaggatttcagtccttttttgacagcgaaagaggagaccaaacacagtgtggtttccctgctattcttccggggagaagtgacatatgacccagatgaggtcaggctctgagggatggtcctagatgctcactggctgttggctgtgtgctttccatcacgaagggctcctcctgtcctttggtgccattcattcatggtacacatatttattatcttctgggcaccaggcagcaagcacaggaggctttctctctaaccttgttaggtcatgggtcccgtcctttggagagtttacctcaatggagaagtactggcgagacttttccattagcctcattttctgtcctgctccaggaaactccatccccaaacagggccaaagaggattcaccaagatgccagtggtgagacttggaactcgcctcggctttctcatgatcagaaagttgaactactgaaaaatgcactgctcatccataaacctattagctttcaatgcttctatttttatataccagcattgagtttgttcattcctagaaacaaaggacataactttggactggacacattttaacttttcattctttttttttttttgagttatttcatttttatcacttttaaacaagagttgctgattttaacgacctttctttccccttggttgtatcctgaaagctatttcttatagagcaaggaatgttaaatttgatgctgtcaaatcatgacagtttagtgaaaaccttttttgcaacataagttgtaaaagcttttctgttcagaaggaatgtgaaatttgtttttaaaactactccaacaatttttgttttatcaccacttttgcagaagtctaggagttctggatattcacgttaaaagctgacaaatgtaggacttttttgtttcttttgcttgcttggtaaaaaaaaaaaattattattattattattattactatttgagacaaagtctcactctgttgcccaggctggagtgcagtggtgcaatcttggctcactgcaaccttggcctcctgggctcaagcaattctgcctcagcctcccaagtagctgggattacaggcacccaccacccaggcctggctaatttttgtatttttagtggagacggggtttcaccatgttgaccaggctggtct

SEQ ID NO: 13043 - DNA, 4889 bp, Human
actatgtagtctatatagtaatctgttatgattgttttatgtctttctttccaattcttaaatctttcatttattgttcttgcttaattgcactagttagaatctctagtataatgttgaatagaagtggtgatagcaagtgtttttgtcttatttcttttttttttttcttttttttgagatggattctcgctctgttacccaggctggagtgcagtggtgcaatcttggctcactgcaaactccacctcatgggttcaagcaattttcctgcctcagcttcccaagtagttgggattataggcatgcaccctcactcccagtcatttttgtcttattttttaatcttaggggaaaagcttttaggattttactgttaggtgtgatgttggttgtaggtttctggtatctataaattaatagatgaagaaggtccccttctaattctattttgctaaaagattttattgtgaatacatatacaatttatcaaatgatttatctttgtttattaaaatgatcatgtgatttttctcccttattctgtttatgtggtacattaaattaattgagttttaaatgttaagttccctttcttggaatatgcacatctagggttgtgatgtattgttatttttataaattgctagatttgtaatgctttcaattctgttttaagagagattggctcgtgattttcttttcttataataaccttgtcagagtttggaatctaaggttatacttctacatagaacaagtagggaagtgtttcccagttgctgttctctggaaaagtttgggtgtgactggcattatctttctttaaatgtttggaagaattcaccaatgcagttatctaagcctaaatcttttgataaaaggctttcagatatgtgtttaatttctttaaaatgtatagtacaattcaaatttctatttctttttttcttatgaattcattctttctatctaaatatgtaaatcagtaaatgtactgacaacagattacacattattttcacttaattttctttttaattcccctttccattcctgatagtggtttcttgtgccttcttttttttaatgattaattttttccagtgatttataaatttacaaatctcattcaagtgttcaaagggcaagccttgattttgaactctggctttcttgatttttctctgttctgcatttgttttccacttcattaatttctgttcttatctttattattttctttcactttgagtttaatttgcagttctttttctaacttcttgagatggatgtttagagccttgacttttggcatttcatcttttctcatatgttcacttaatggtaaacagtttcttctattcataactttaactgaatcccataaattatgatatgtcatattttcattgccattcagttccagatgttttctaatttcctttgtaactttttctttcacttatgtactatatagaagtatactgcttaacttctaaacatttggaaattttctagttacctttttttaagaagtgatttctagcttatttccattacagttaaggaatatactttggaagatattaatttcttaaaaattgttggtgcttgctttatgagttagtatatgactgattttggtaaattttcttttcttttttttttttgagacatagtttcactcttgttacccaggctggagtgcaatggcgtgatctcggctcactgcaacctccgcctcccaggttcaagcgattctcctgcctcagcctcccaagtagctggtattacaggcatgtgccaccacacctggctaatttttgtatttttagtacagacggggtttcaccatgttggtcaggctggtctcgaactcctgacctcaggtgatccacctgccttggcctcccaaagtgctgggattataggcatgagccactgtgcccggcctgattttggtaaattttctatgtgcatttgaaagtaatggtatgccttttggctctctgaccagcaccatggtggttgacaagaacaagcgccttacgaaaggtggcaaaaagggagccaagaagaaagtggttgatccattttctaagaaagattggtacgatgtgaacgcacctgctatgttcaatataagaaatattggaaagacgctcgtcaccaggacccaaggaaccaaaattgcatctgatggtcgtgtgtttgaagtgagtcttgctgatttgcagaatgatgaagttgcatttagaaaattcaagctgattactgaagatgttcagggtaaaaactgcctgactaacttccatggcgtggatcttaccagtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccagcaggtcctgagaaatccggaagacctcttatgctcagtaccagccaaatccggaagaagatgatggaaatcatgacccgagaggtgcagacaaatgacttgaaagaagtggtcaataaattgattccagacagcattggaaaagacgtagaaaaggcttgccaatctatttatcctctccatgatgtcttcgttagaaaagtaaaaatgctgaagaagcccaagtttgaattgggaaagctcatggagcttcatggtgaaggctgtagttctggaaaagccactggggacgagacaggtgttaaagttgaacgagctgatggatatgaactaccagtccaagaatctgtttaaaattcagacttcaaatagtgtcaaataaaaagtgctatttgtgggaaaaaaagagaaagtaatggtatgttttgcagtttaggttattgtattttatatatgtcaggcgatgtatactaaacatgttgtttaagtattctcatttttaaatttttgtttatttactctttcagttatggagagaagtatattaaaaatttcacactacagttatggactctttttttctcttaggtttgttaattactaaattatttattttaatgctataccattaggcacatacaaatttatattttttcaattgtactgattgttgactttttgataattatgaaataccccacattatcacttatagcatgttggtcctaaagttcattttttttttttttgagacagagtctggctctgtagcccaggctggagtgcagtggcgcaatctcggcgcactacaagctccacctcctggtttcacaccattctcctgcctcagcctccccagtagctgggactacaggcgcccgccaccacgcccggctaattttttgtattttttagtggagacggggtttcaccgtgttagccaggatggtctcgatctcctgacctcgtgatctgcctgcctcagcctcccaaagtgctgggattacaggcgtgactaaggttcattttgtctgattttttttttttttttgagacagagtctcgctctgtcgcccaggctggagtgcagcggcgccatctcggctcactggaagctccgcctcccgggttcacgccattctcctgccttagcctcccgggtagctgggagtacaggcgcccgccaccacgcccggctaatttttttgtatttttagtagagacggtgtttcactgtgttagccaagatgctcttaatctcctgacctcggcatccacccatcttggcctcccaaagtgctgggattacaggcgtgaattttgtctgatattaattactacagtcataccagctttctttaaatcagggtttgtatggtacttttttaaattttactttcatctttttaatatccatatattttgggtgtatctcttgtaaaaagtatataatagttgagttctaatccaaataataacctttacctcttaattggaatatttaatttgttttaaatataattactaatatatttgagtttaaatctatcatcttacttactttttttctattggccccacctgctctatatttctttctctttcctttcttgctttcttatagattcatcaaatagtttttatttattccattcttctctattagtttgataggtttatctttttttgcagttttaaaaaaatggttaccttagattccagtaggcattcttgacttattaaagcctagcaaaaatgatcttccacactctggtaattcaagggctttcaagtacttcgtgtatctcttgccttttgtactatttattctcatgtatcttaaaaattgcacgtctgtttttaaaccccgcatgacgtcataattattgctgtttcatacagtcagtgttcatttagatctctgtgtgtgtgtgtgtgtgtgtgtgtgtgcgcgtgtgtatttataatattctttctaatgcttttactttctttctggaaatctatgattccatctagaattgtttttcttctgcctgaaaattttcctttagtgtttagtgtttcaacatgggtctgttaggttttgattatctgaaaaaagtatctagtttgtctttattttgaaggacataaaagacttttatgatggctacaaaatttttagttggcaattattttatttatatgtgtgtatatataaatagtatattatatataaaaatatataaataaatatatattccattgtttcagacattctcccccttgtccctattgggtatcagcagccccatttctctttgataattaggagcagggaacccagcctgtatagtctcctttgttacttgctaattcagtggcatgtggagctcaaaattgccaagtggaagat

SEQ ID NO: 13044 - DNA, 9319 bp, Human
  misc_feature (1)...(9319): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgccgcctttgttccggggccgccttttgttggcgccacgcggcggggggaggggcggcggcctggcccgggtcggggctggtgcggcccgcggactgtcgccgctgcgttcgcgggccgggcctggcgctgccactcgcgctggagtttgcgggagtttgttgggtcgactttggcgccgccccggggccgctcgcgcgctgccagggccagggccagggccggagccggcgcaggggcgggcggatggcccggaagagggaaagcgctcggacccggggcccggcggcgtcttgggccgcgccgggggctgcgtgggcggagttggcgcgagccggggcccggacctccctcctccgcctctcccgggggcggagtcacggtctgaaccctgggcgggcttggtccccggaaacatcgagttccttgaaacgagttctcaggagttggtggagacgctggccctttgctacatggttgtagaacacatgaatttccagttatgagtggttaggtcccatacccctggtgaggtggtcccttctttgcttctcacaggctggggctgcagagccttgttaagcctcgttagggtcctggttgagttcaatttggagggtagtggagatttaacatctttctaaggtgctccttgcagactctaagggtagctgtagacttcgtgagaactttgccagggccagtcctttccaaaatcacagcttgcttacaagacttgttgccgtgtgtctcaccctaccatttcagaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtaagctgggtactggatttcagcagtctcagtggaaacgatttgaattctaagaggacacctttcttaaagcatgactagtttgtgtggtctgcatgtgatttaagtgctttgggcaaaacccaaagccggaggttatgttccggtttttgaggggatgaaaatacagattaagctgggagtgagagaatgtgctggagtggttcgggaagatgacagttgacattcattaccttttatgtgcctattctgggtacggcgctaaacatctgggaggattacaagagagtccatgattggtatgataggcttttagccccattttacaggacaaaaaccaaaaccctaaggctcagaaatgtaagtagaagaggtcacagctagtagggagtggagggaggattccttcccctgtggcccatcttcagcctatgctccgagtccctgctgcttcgcttctggagatgggcctcacgctgggactgcttgggcaggaagagcatgatcaaaggcttaagtgtgaggactgttttctaggtgtcgaggtaaaccagctgtacttgaggtttgatgaaaattgggttgggaggttaagctggggtagaatttggagggggtgaaacacatgtttgtatctgtactggtgtctttatggcttagagagaagggccttgtctggctcgtgctgctgagtcagcctgacccctttctgttggaacaggtcctagaccagaaggagcacaggctggatggccgtgtcattgaccctaaaaaggccatggctatgaagaaggacccggtgaagaaaatcttcgttgggggtctgaatcctgaagccactgaggaaaagatcagggagtactttggcgagtttggggaggtgagtgtggctctgggaatagcccatcagctgcccctaaggctgccttctttctggtccttggtatccttggctggctagaccctcccaggcagggcttatttttcaccctctgtcttcaatggggtcttttctcctgtgagtcccctatatgctctggggtagggaggtattgggcctgagtttgcctatgctttttgcagattgaggccattgaattgccaatggatccaaagttgaacaaaagacgaggttttgtgtttatcacctttaaagaagaagaacccgtgaagaaggttctggagaaaaagttccatactgtcagtggaagcaaggtaaggtgttcccagctctgcttggcctcctgtgctgctggagagctggcccttagagggatgggttaggggttgggcctcatgcaggagctctccaggttggtcagactttactatttctctgaagcgtatgctgccctgattggggcagtgttccaatccttgaaagacttcccaggctgggaggactgccaataaacaacacaggatgtgagggaggtaggagaaggtggcctctgtgaatagagcaggttgagtagcctctttagctcctcacttaaagctagaggtgacagttctagattcttgagtccaggggtatgaagcctgcagtttaaggtctcagaagatcctagaacttctgcaactcactgattctcctctgtggtgaagtttttcttattccagagcctttctacctccttctacaaccaagtctttgtccacttccatccactttgagcacttttttttttttttttttttttgctttgagacagagtcttgctttgttgtccaggctggggtgcggtaacacaatcatggctcactgcaaccttgacctcatgggcggaccggatcctcccatctcagcctctcgagtagctgggaccacaggcatgtaccaccatgcctggctcatatgtttttttaaagcctggtctcaccatgttgcctgggctcaagccatcctctgccttggccttgtaaagtgttgggattacaggcatgaactgcctcacttggtcttctgggcacctctttaagttaaccctaaacccaggcaaaaatccttccaaagatctcccagggtcctggccagcttaaatccagggtcagttgtgctttcaaatgagtggattcatgtgcagggaggtgtagctcttcccctcctgaactctggtcagggaaagggtagttcaggcttcaagttggcagttgggagttgagggtgcggcctgcagtggcagggtgtggcaggttctgtttctgagcaggagttggcagccagataaggtgggacaggtggaactcctggaagtctctatcctggctgggagtttggaaagagtggattaggatagtcttaaattttctataaaatgacagtctttgaggcagttaggggaagcagtggttattactccagtggacagtgatagaggcctttttctctatgtgccataatgggaaatgggtgggaagagcctctaaggcagagtttaagtgaaactactggtagtgagtcttaggagtaagtatatttagttggttatattcagtatttttaatttagtaggatagaatatatcagattgcattattttaatttgccaattaaaagtatgactgggacactgtaaaatgtactatttttaatgggtgtgcatgtcaggattttctttagaaatacactggtctggtctaatttatttaagcaggagcactttaaagtatcccaccctaccccattccacccccagtggacagaaaggaaattgactgacttgaggggatgcagacatctgggttattccaacagaccagtggttaggaggagggggtgggtagcattatggcctcgggcaggcccccccaccctgagcctctgaaagctgactttatctgtaagagggaggtcaggctcgccttctcaatagcgtgtatttggatgagatgagtttcttctgtaaagagaaaaagatgttaaaacctcattgtctaaggcccctcatctgagaagtcttgtctgaccctctagcccagcaggaccaaggtgtggtgcctggtcccagcctgtcctctgctcccctgggctgcagttggcccagttgcctgcctccattagatacggagttgctctggggctgagatgcccatctcaagtgcattctgtcggaagggttctctgctggaaggcctttggttttagttgggattccatgagctttagcccaaaggtggcctcccatactagcatattttgtttctcagcaaatggacctgatccaccatttgatgtttgtcgcagtgaaggtgtttgggcagtcactgccctgagtttgtcctactggcctgaccactgtcctcttgacttttagtgtgagatcaaggtggcccagcccaaagaagtctatcagcagcagcagtatggctctgggggccgtggaaaccgcaaccgagggaaccgaggcagcggaggtggtggtggaggtggaggtgagtggaacgtggatgaagataggtcctgtttccctgcctacatggagccttccaagcctgtcttggggctccctctggtgctgtgcagcaggggtgggcagattgtgtgaggttggggacgaacaggaataggaacggctctgggtcagggctgtatgcttgaggctgttgcctgctgctgccccttggaatggcttgggtgcccagggcagagagagcatttgtgttacactctgggggaggggatgtgatgggtgtcttggctttgtggatgtcctgagtctggtacacctgtgagcaggtaggcagaagggtgggtagggcagagctgtgccaggcatttatccccttccatcccaggcccctctgactccaaagcctgaactgcatctttttaaaggctaagctgccaaggagagtgggagtgatcagagagtgactgagtgagtgagctgccttgtttgccccaagtaaagttagcatcctggtctctgatcctctgcttgggtctctcagatgcagggttgggcccagggcccttatacaccagaacagcagccccttggcttctgcctgagttgccacagtaaccctgccaccccaaagggcaggatttcctccatcctagctcctgcgtatgctaaatggtccacgggcccctgtgccctgctccccccacaggtcagagtcagagttggaatcagggctacggcaactactggaaccagggctacggctaccagcagggctacgggcctggctatggcggctacgactactcgccctatggctattacggctacggccccggctacgactacagtaagtaggagagagggaggccccatccgctcacccctcgtccccaggggaggcaggacagtgtaggagccactggcagcaggggctttggagtcagacaggcctggctcagccatgggagctacttgattttgagccttagacttcggggtcttaataacatgaggaaggcagtctctgctgtcacggctggtgagggtcctgggaagatgcatatcaagcgcgtggcacagggcaaatgcttgtaaatagtagctgctatggttgttctcgtccctaggtcagggtagtacaaactacggcaagagccagcgacgtggtggccatcagaataactacaagccatactgaggcggcagcaggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgggaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccttttgggaatctaatgtattgtaaggtattttacacgtgtcctgattttgccacaacctggatattgaagctatccaagcttttgaaataaaatttaaaaacccccaagcctgggtgagtgtgggatatgctgtgtgagacctcttgctcagggtcgagggaggcggggggggggtgccaggtgccctggacttggggctttctcctgcagcaggctcttccagctgcaggcccagttgtgggggtatcctttaaggactgccctgcctagggctgagccccccttcaaagaaaggaatgagaggcctatggggagtgaggatggggcagtgatgagggcttacatccccagcaggcatgtcccctcctgggacaccttggaacaccaaccttcttggctgatgaatgaaaaaatgggattctttacacactagggcagtgccagggccgtctgaattggggcacaatagtgctcctcctggctggtgaagaaaagcctgctctggcaggggatgtttattggctggattggagcccaactccaggtctggtatttagggcataagactaggtggttacaagaggcaagggtgggttggggttccacgtggatacagccccataggtttcaagggaggatatagctgttcctgccatcaagtgcaagctaagcattggagaatttccagtgttgaagaaactaacctttgggaaggagcatcagtcagaacaaaaaaaagtcttaaaaaaaggctcagcttgccgaggctgcttgctgctgatggtaaggaacccgctgtgcatcttcaagagtaagaagcaaggcccactcacctggagtacacttaggcagagcagggctggcttagggctggagcctcagcgtttcacaacttctcaccttctcttccatgtctgaaaaagaccacaaagcaatgccgactcagtcacctttctctgctgaagatgccctgttgacttcagtgtccaaactggaggacagtttagagattgggccctctggctatccacacccatgtcccattccccaaaggggtggcagcagtttcctgaaaaacaaagccagccctcagttctcctgagatttgtaggctctgtccaggatccctaagcctgttctgtggccagcctttgctctccacaaacacactcctattcatcatatccctaccacttccaatttgtgtctagcagggatgggcctcccccagctccagagccctgggattaagcatacctgtgggtagcagtgatcacccagaggtaggagggcacaggttgcttggctggcagttgtgatctctactgtgagatgcaactgtgcctatttagggtctcactgagctgtaaatggcaacacagccatgagatttccttgtaagtggatttagggggaaccctgggttgaccacgaccatcctaggtgatggggaatgtggggtagagttttcattttgagttccgtcagtcctcagtggtaccaatctttcagccacccagcagccttgtgtgacctgtctcatgtacagaatgaaactcctgccatctctacatcctaggctggcggtaatggggtctcaactcccactgtagttcttatggcctgtttctcaggcccagtactgctttgtcctgcatacatctgatgcctgctcaggcaggctgggtggtggctcaccttccacctcctgacagcccaggaagctctcttaggtacaggcaggaataggagcagattgggccatgaaagaccctctcttgctccctgccctgtccagaggacatgtgcctctgctcttggactcttgtcccctccctgttccatgctaggaggctctagttgctggcttcaggctgagttctagagatatggccaagctcaggcttcaagctcaccagtcagaatggcatccagctttgccaccacctgccgtgcattgtccaggctgaagcacattgggggcttaaacttcaggatgttcctcccagggccatcagtgctcagcaaaacgtagttctccttcagcctgtgaggacaggacaccccttcacatggccttcaaggccttcctcagcctggccttg

SEQ ID NO: 13045 - DNA, 45300 bp, Human
  misc_feature (1)...(45300): n = A,T,C or G
gtgtcttgtgtgtacgtgtgtgcgcgtgtctttgtgtgcatgtgcgtgagtgtgcagtacacgtgtgtacgtgtgtgcgtgtgtctgagtattcctgtgtgcacgtgtgtgcgtgtgtctgtgtgcgtgcatatgtgtgtgagtgtgcgtgtgtctgtgtgtgcgtgtgtgtgtgtagaggtgggaggggaggcagcccccctggatgtctctaggtcactaagaggttagggatctcacacggagtgattctgccccccaggggacccggggcagtgtctggggacatttgtggccaacacatctggggggtgctcctggcacggagcaggtggatgccagggacgcagctcaccaccctgcagagcccaggatgctcccgccccggagaacaatccggcgctggtgtccgtattgctgggtgggaggagagaccctggcttaggagaaggtgacctcagtcaccgccttcctgcagctgagacccgggagcctctgggaaagccgggactcggcctccccagctgggctgcaaggtgaggaggcttcccgccgacctcagcttccttggcctccaatgcagccccggggcgcagggctgctgagaaagtgtcgtgtgtgggtggcccggactccagcccaggagcagcagccatgtggctcttctttgtgtcggtggaaaaaaacccattggtttgtggaaatagcaaatgtttgtgacggaagaggggcctggccggcttcagagaccacaggggcccttcagggcaggagggaaacagccttggccacgtgaacccggcccagcccggcctcgagcagctcaggaagctgggcctgggttgggcccggtgcaggggcgtctgctgacctcgccgggcaagcccactgcagggtgagccccgctaggcaggacggggcctcccctagagctgacagtggtgcagctcctggcttctccaagtggggctgccggctcagcagcagagcagtggtggcctaaccgggagacacagaacctggcatctgggttcattgtgcgcaagtcccggccccatgacctcggccggtgtagacgctccgcaaggcaggggcctttgcctgcctcgggcctccttgtccacgaaataggaggctgccgcgaagctggagggggcagatcgctgcctggatctccctccagaccttagtgggagtcaggaaagaccacggaaggtggtccccgtgggcccccctcgcgatccgtgcactgtgcattggagacggccgtgggccccccctcgcgatccgtgcactgtgcattggagacggatacggggcctggccctgtgcagggtccggcttggaacagaggattccgttccatggaaaaccgcagctccaaaggccccaaccgccccgacccccggagaccaatcaccggggcctggagacgttctttccttcctattgacctcctggccctgggcggctcacatgagacccccggccttcctgccccccgtatacctgtcacttcctccattcggggttaattggtttgtccccagtttccactttccacctctccctttgcccggcacgtggcttacataaaagtagaaatcagagatggaaaaacaccgaagtattccatgggaaggcgccgtgcctgggtattttgtttttcttgcactggtgtgtctgatggactggactttgactgtggggttggggcttccttgttctgaaatggaataacacaagtttctggaagataatttgccctgttgtccagcaagagaagcatccaggtcttctccgcacggatcggtggtaaagaataaagtggattctgcccccgttttctccggagggcacggccctttcgaattcccatgcctcatttttggggacagcaacgtcgttctccgataaaagctggaggtagctctgtgagttccttgtaagtaaaaaatatgtaaccatgcttttctctttctctctccttttttaaacagggtgtacagcaagctgtgattcctgggaaaactaaaaaaggtatgtggcattttctcttacttcatgaggttggaatctcttgttttttagaaaaaggaacaaacaagccccagtcttttatgtgtgcctgacactttgggaggttgagtcatcccataaaagggctccgggctcagagccaggaaacctgagttcaaatcccagatccccttttaccagctctgccccgtttgggtgggttcgcgtcaactgtctgcagtggagatgacgttctccgttttgcaggaaggttgcaaagattaaacaagcatatagatacaaaaatataaaaatagccaggtgcagtggctcacgcctgtaatcccagcactttgggaggctgaggcaggtgggtcacctgaggtcaggtgtttgagaccaggctgaccaacacagcgaaaccccgtctctaccaaaagtacaaaaattagcagggcatggtggcaggtgcctgtaatcccagctactctggaagctgaggcaggagaatcgcttgaacctgggagatggaggttgcagtgagctaagatcatgccaccgtacaccagcctgggcaacagagtgagactctgtctcaaaaaaaaaaaaatatatatatatatatagcatatatattttatacacacatatacctatatatatgtatacacagtggcgtgcgcctgtagtcccagctactcaggaggctgaggcaagaggattgcttgaacccaggagttcggggttgcagtgagctatgattgcaccactgtactccagcctaggtgacagagtgagacccggtctcttaaaaaatatacccagtgtggtggcacgtgcctgtcatcctagcattttgggaggctgaggcagaaggatcacttgagcccaggaggtggaggctactgtgagctgtgattgtgattgcaccatgggactccacgctgggcaacagagtgagaccaggtctctaaagaaaagaaaaaaatatatatattatatattatatataatatattatagttcactgctataatatactattatatcatagctcactgcaatcttgaactcctgggttcaagcaatccctttgcctcagcctcctgagtagctgggactataggtgcacgccactgtgtatacatatatacatataatatatacatatgtgtaatatatattacatataatatatacatatgtgtaatatatattacatataatatattacatacaatatattacatgcaatatgcacatgtatgtaatattacatagaatatgtacatgtatgcaatgttacatataatatgtacatgtatgcaatattacatatatacatgtatgtgatataatatattacacatgatacgtacatgtgtgtgatataacattacatgcaatatgtgcatatatgtaatatattgcatgtaatatgtacatatatgtaatatattatatgtaatgtgtacatgtgtgtaatataacatattacatgtaacgtgtgcatgtatgtaatataacatattacatgtaacgtgtgcatgtatgtagtatgatatattgcatgtaatatgtgcgtgtatgtgatatgatttattacatgtgatattacatatatgtaatgtgatattacatgtaatgtgtacatatatgtaatgagatgtacatataaaatataatatatagtatataatatataacataatatattgcatataatatataacatatatattgcatataaaatgtatattacatatatatatatgtatatatatatatgctcagcaccatgctggcatgtcagtatctaagagatgtgagctgaacctgaaaccatcgctgatctgtttcattcgcgtttttctaggaatttgtccatttcgtgtagattacctaattggatgtcacacactggttcataatgctaccgtgttctctgataatgccttttatttccatacagttggtagtaatgtcctcctttcgtttctgcgtgtagttatctgcatcttatttcctctttttttttttttttttggttttgcttttggtcagccccgctagaggtttgtcaatcacctagctcttttcaaagaaccaacttttggtttcgtcgactcgccagtttttctcatctctgtctcgtttatcgctgctctgatctttacaatttccttcctcctgctggcttggggctgccttcgttcttccttttctggttccttaaggcagcagtcctcaacctttttggccccagggagtggattcgtggaagacagtttttccacagacagtggggaggtggggggggtggagccgggaggatggtttggggacgattcaaacgcattactttttttgtgcactttgtttctgttattatgacattgtaatatataataaaataattccacaactcaccataatgtgggatcactgggagcccggagcttgtttcctgcaactagatggtccctgggctgggtgtggtggctcacgcctataaccccagcattttgggaggctgaggcgggtggatcacttgaggtcaggagttcgagactagcctgaccaacaagatgaaacctcatctctactaaaaatacaaaaattagccaggcgtggtggtgggcacctgtagtcccagctacttgggaggctgaggtaggagaatcgcttgaacccgggaggcggaggttgtagtgagccgagatcgcaccattgtactccagcctcggcaacagagcgagactctgtctcaataacaaacaaacaaataaaaactagatggtcccatctggaggtgatgggagacagtgacagatcatcaggcattagattatttctgtttgcttgttttgagacagagtctctctctgttgcccagtctggagtgcagtggcatgatcttagcttactgcaaactccgcctcctgggttcaagcaatttccggctgattttttgtattttttagtagagatggggttttatcatgttggccagtcgaggccattaggcattagattctcataaggagcgtgcaaccaagatcccttacatgcacagttcacaattgggttcacgcttctatgagaatctgataccactgctgatgggacaggaggcggagctcaggcgggaatgcaagcgttggggggcagctgtgaacacacaagcagtcaggcgccgtggctcacgcctgtaatcccagcactttgggaggtcaaggtgggtggatcgcctgaggtcagaagctcgagaccagactggccaacatggcaaaaccccatctctactgaaaataaaaaaaattagccgggcgtggtgacgcatgcctgtaatcccagctacttgggaggctgaggcagaaaactcacttgagcccgggaggcagaggttgcagtgagctgagatcgtgccgttgcactccagcctgggggccagagcgagactctgtctcaaaatatgtgtgtgtatatatatatattttttaaatatatattttatttataaatatgtatatgtgtttttatatatttataaatatatatttgtttatatatttataaatgcatatttatatattatagataatagataaatatatattaataaatacatataaatatatttttatataaataataaaagattgtatgaaaatataatttaccagcacggcagggctttttggcgttccctagattttgcccccaaggtgagtgccgcatggcctcaccctagtcccggcccccacacaaatgacactcaggatgacgacgaagacagtgatgatttaaaacctggccgatggccgaggggtcgcatgtgcccgtggtgtctggtctggatccttttacgtccttctccatgaatatattctccatggagaagtccctgccctctctcctgttttctgaccgggagaccagacctcctttgctggaggtcaaacggccagggtgaggtccctggagcctgccctgagccccgtcctctgggacacacaagtgctggctgatggcagcgtggctggacggcaggtggcacggagctgcctgggcaaggctcaggtgtctccaggccgcaagctcaagctgccagccatgtggccacgtgccgtggggattaggtccctatgctgcagcatctgctgggagggatgacaagaggctccagcaatgacatcaggcagctctcgtcgggccctggctaagtcccctggccctgttcccagcagccgggccatccccaccactgacgcctccctgatcctcagctccccctactcagcgactcagcagatacctctcccgtgccccctgcaggccaggtccactgctccaattcctttagttctcctaggatccctggggagcagggctcattgtccccattttataggtggggaaactgaggctcggcaaccaaaagatgtggcaaggcccgggggctggccagaggcagagcgggattggagtcacgagacttgccacagagcagctggtggtccctcaggctgtgtaggccacctgctcatctgcacaagcccctcagagcccagcagggccatggtcactctccctgggggacagtcacagaagctggggcttggtgaggaggtgagcagaggtggccgggagcggtggctcctgcctgtaatcgcagcactttgggaggctgaggtgggcggagatcacttgaggtcaggagttcaaggccagcctgaacaacatggtgaaaccgcgactctaccaaaaaataaaaaaattagccgggcttggtgttggatgcctgtaatcccagctaccagctactcaggaggctgaggcaggagaatcgcttgaacccgggaggcggaggttgcagtgagccgagattgcgccactgcactccagcctcggcgacagagcaagactccgtctcaaaataagccagcaaggagggtcgccacgggggctggatgagagagtgcctcccagccgctccttctgctgcattctacccacttcctgtgagccagtctcaacccaaacactctttccccatcccacagggattctgagaatcagggcaccccagacccaaggcagccacatttcccttttccactgagagcggaaagaggcctcggcacttcctggggcagcccaggatttggccgtgtttctgcattagcaagaaaaggcgtaatggaatttggatagacaagaaaaggggatgtaagcgtgagcaaaaccacacactccatttcattgttagaaattccatgcgtgtcatcaaaacctcatcttgggacagaggccaagacgaactcactgtcacaaggaactttgtgcacaacaagtgtgctggctcccctgtcacccccgccctcacccccggcctgctggctgaccccagacacagcagccttgtgtttcctccctcctggtcagctggtgcctggtagctgcagcggtggtagctgcagtggtgtctctccagaaggttctgggggagagactgaaattcccatgcttagccttacaatgccccggccccgtgcaaacctccagatgaaaacacagccccggccagtgcggtggctcacgtctgtcatcccagcactttgggaggccgagacacgtggatcacaaggtcaggagttcaagaccagcctggccaagatagtgaaaccccgtctctactaaaaatacaaaaattagccgggtgcggtggcgggcgcctgtaatctcagctactcaggaggctgaggcagagaattgcttgaacccagggggtggaggttgcagtgagccgagatccgccactgcactccaacctgggtgacagagtgagactccatctaaaagaaaaaaaaaaaaacacagccctgtttaagccctccgtgcatgtcctcctccacctccacccccacggctgccatttttgccaaaacgtatatcctggacttgccttcttgccgtttgctgtgtttgagcgtcgagcgttgagccagacacagttgggttggcacaggagtcagggttctctccgggggtcctgacagtttgctgccaaaccttcatgtccagacctagtgtcccccctggggtccctcgggtttgcagttgccttggcattgaggattcaaggtgtgtggcaggaacagggacccaggaaaccctttggtggcctcagcctgcccagctttgtcacttgaacctgtcgggatgcaaacaacatgcacagttcacgagaaagccgctcctggctggaacatcccttcgaccagggtctctgggtatcagcatctctgacattagggtcagattattcttgagagggggttgtcgctgtttgtttgtttgttttgttgtgttttgttttttgagacagagtctcgctctgcacccaggctggagtgtagtggcacgatcttggctcactgcgacctccgccacgtgggttcaagcgattcttctgcctcagcctcccgagtagctggaatttcagacgagcgccaccaggcccggctaatttttgtatttttagtagagatggggtttcaccacgttggccaggctggtatcgaactcctgacctcaagtgagccacacacctcagccacccaaagtgctgggattacaggtgtgagccactgggcctggctaggttttttttttttttttttttttccagacagagcctcgctctgtcgcccgggctggagtgcaatggcgcgatctcaacccactgcaacctccgcctcccgagttcacggcattctcctgccttagcctcccgagtagctgggattacaggcgcccgccaccacacccagcaaatttcttttgtattttagtagagaccaggtttcaccacgttgcccaggctggtctcgaactcctgagctcaggcaatccgccctcctcggcctcccaaagtgctgggattacaggcgtgagccaccatacctggtttttgttttttgatttttgttttccattgttaacatgaaaacatccgtaatgatccctagccctcagggagaagctccctgggcctgtagttttccgggactttctaacaacaccagggctggagtggggtggccctggagatgtcacacatgatactggtgacctctagccattctgatgatgtgacctggagcccacgggccacagcagagaaccccaggctcgaggtccatccttggccatgtgtgtgcccggacgggccggcccctgctgcagagcccagaggggtgggcctaccaggccacgtgtgcccatgcacagcagcagcacctgctatggatggaggtggggcaggcacttcacatccgagggctgcctgggcctgggagcctctgtcctgggaaggagatcggccctgggaacagagtgggttccaggaagtaacaccctttgtgaactccctgcaccatggcctccagccccttccatccaagtggcatctttggtacccagcgtctgggatgtgctggggttggcagaacaaaggcctcaaagacatccatgtcctaatccctgggagctgtggctgtgtcaccacacatggaaaaagggactctgcaggtgggattgagtgaaggaccacctgagtcatgagagcaccaccgtggatgatccggggtgggggggcgcagtgacctcacaggatcctcacgagaggaggcaggagggtgagagtcagagagagactgaagaggctgtgctgtgtctgtgaagggggaggaagggtcccgagccgagggatacgggcacctctaggcgaaaggcaggaaagagattctcccctggagcctccaggagggaccagccctgcccgtgccttgattttaacccagtgaggcccatgttggactctgagcccagagctgtgagatgagaaacatgggtcgtgtgcagcagccacaatgtcacaggacacaacgaacgtccagggagctgccagtgtgcggagaaggggttttagtgcagcctggctgtgcatagatggttgcaatcaggggcttctcagaggggatgacatcggtggggctttgcaggatgtgtaggagttttctggggggggggcatgcgtggagaaagacccacctgtgctgaggtgggaaggcccggtactgccctctgttctcttcctaaccctcctgcccttcagctcccgagcaccaccgtcacgaggccggcgctgccccttgccctggcccggggccagggtgacagcatttcctcagccgggaagcccagaactggagtgacaggagccacggggttcagtgtcctggcccggccccggttcccgggcttgcaaactctcacatgaccgtggtcatcccccgcccccgccgaccccaccgccgggtggacagagagcagcttttcttttctcctgctcccgtcaccgcggcgaccaaacccacactggcggcgcgtcaccctctgtcgtcgcggcctctttgtctgaacaagccggctcattcttaggctccaagctccggctgaaggcagcggcgggacctgccccgctggtctatttttcactttctcgtgggcacctcattcattccctctctttagccccttctaaatatagctgccccggggaccgatttagcctgagagcaaagggcccacactgacagggacagtcacaaggcactattttccagccagtgcggccctcccttccatgtggcagaggccctcccgcccgcagccctgggccccacggccctgccttgaggtcacagagccaccaacggtcagagctggcacggaaggccccacacacagccgccctcccaggccctgctgggcgacctggccctggagaggctgcaggtgcagggtgggtgcccacgctgggtgcagggtctctgcatgcagaccctggttgctgagggggccctggggttctgtggagcgggcagcaggtgtggccagtctcagacctgtctcttgtattgaagtttccatttcagtcgggctccccgggctctgcgtgggtcccctctttggcgtcctggtgagaacatggcaggccgtggggggcctgcatcccagctgccaggggacacatcaacgcctgatcgttgccctgtgccttctcaccctgatgccctgtgtccgctctggaagctgtgtgcacctttctttttcgtttgtttgttttgttttgttttgttttgttttgttttgtttttgaggcagagtctcgctccgttgcccaggctggagtgcagtggcgcgattttggctcaccgcaacctttacctcccgggttcaagcaattctcctgcctcagactcctgagtagtggcattacaggtgcccaccaccactcacggctaatttttttgtatttttagtagagagggggtttcaccgtgttggccaggctggtctcaaactcctgatctcaggtgatccacccacctcagcctcccaaagtgctggtattacaggcatgagccactgcacctggcctttttttttttttttttttttttaagacagtttcgctcttgttgcttaggctggagtatagtggcacaatcttggctcactgcaacctctgcctcccaggttcaggcaattctcctgcctcagcctcctgagtagctgggattacaggcatgcgctaccatgcccagctaattttgattttttttttagtagagatggggtttcactatgttgaccaggctggtctcgaacccctgacgtcaagtgatccgcccgcctcggtctcccaaagtgctggaaatacaggcataagccaccgtgcccggcctatgtgtgcacctttctgcagagtctaaaccagggtcccctaggcactgtagacatggcggccagattgttctctgaggtgggcctgtcctgggcactgcagggtgctgagcagtatccctggcctccacccactccatgccaggagcaccccccagttacgacaaccacagatgtcgccagacagtgcccagggtcccctggggggcggaattacctctaggtgaaacccccagggataggggattccacggacccccaagagactctgcgtcccatgatcctctgctgtgctgaggtcccaggaggctgcacacaatgaaatccacaccgagctgggagggagagaggaggtgaatcccaggagttgggggtccccctggttcacaccatccatcccgttgggagcttattctagtgtgggtagggattgaaccccattttccccaaataattaactcagggtcttctccctcagcactgtggacagtggggtaagatccttctctggggtgaggctgtgctgggcacttacggttgctgagcagcgcccctggcctccacccactccatgccaggagctcccccaaccccgacaaccacagatgtctcaggcatcgcccagggtttcctggcggggctgaatcacccacccccccaattaagagccactgttggcccagcacggtggctcatgcctaaaatcccagcactttgagaggccaaggtgggcagatcacctgaggtcaggagtttgagaccaacctggccaacatggtgaaaccccatctctactaaaaatgcaaaaattagctgggcgtggtgggggtggggggcgcctataaccccagctactcaggaggctgaggcaggagaatctcctgaacccgggaggcggaggttgcagtgagccgagatcgcgccactgcacactgtcctcaggggcttctgtgagatgcactgaggtcctcatggctcccgggggtgctcatggctgaggccctcgtgcccacagcaggcgtgcagatgtgcacattgacgcaggtgcccagggacacagctctctgcaaacccagctgccccagccactgtacgaaggcgacttgttcctcacagtgcctcggagccttctcttctctcccaaactactgttccattttgtttgggtttggatcttttcctctctaaacataacaccctgtctctcttgtctctgaacactgtgttctcagaagcagtcatccctccacggggaagggctgacgtttccactccaagcattgtctcccctcctgccaaatctggttgctggttttgttgcttggggtttatttttctttcctttttcgaggcaggcagaggtttggaggggtgagaggtgggggattgccagacccccaggaggaaagagtccaggagctctgcgagctataaagctactggttctggaagttttagagccagatgaaggttgcttctgttctcacgttgctgctgcaggccggccgcccctcccgccttcaaggccaccttcccccggggctgactcaccccggcacgccgcgccacacaaggctggctctgctttgatgagcagactggaaaagcgcagccgcctcattgtggagctgcctggaagccgccagagcccgctctgagctggaattcgctgagcctgacttcctgtgccgtcaggagagcaaacgcccgctggccttaggagccggtttacaggaagcagccatgggaggacggtttgctcggctcatggagaagcagccaccctctgcacgggttttaatgctgcaccctcatctcagggctgtgaaaagaaaaattgcaggccgggagcgggggttcatgcccgggatcctagcactttgggaggccgaagcagagggattgcttgagcccaggagtttgagactggcctgagcaatacggtgaggccccagctctaaaagaaaaaatattaaaaattagccgggcatggtggtgcacacctgtagtcccagctactcagaaggctgaggtgggaggatctctggaggccaggaggtcaaggctgcagtgagctgtgattgcaccactgcactccagcctgggtgacagagcaagaccctgtgtcaaaaaaaaaaaaaaaaaggaggccaggcacggcgtctcatacatggaatcccaggactttgggaggccaaggcaggtggatcacttgagatcaggagtttgagaccagcctggccaacatggtgaaaccctgtctctacaaaaaaataaaaataaaaaataagcctggtgtggtggtggatgcctgtaatcccagctactcgggagactgaggcaggagaatcacttgaacctgggaggcggaggttgcagggagccgagatggcgtcattgcactccagcctgggtgacagagcgagactctgcctcaaaaacaaaacaaaacaaaacaaaaaccaccaaaaaaaaaaaaaaaaaaggaaaacagcagagatgatgtgtgcagcatgctcagtccagcgtctaacacctagcagcagcagatggcaaataagagctgaagctgtcctgggctgtgggaccccatgcctgctcaccggggggccctccagcctggagaccccaaccagtcccatcctggccttgcgtatcagctccttacactgcataagaaactactgcatatgtggtggcttagagcaacacgcctgcctgagcttacagttctggaggtcatggtgcaatgacgtcctctgcccagggtctcccaggctgaaactgaaacgtgagccgcctgctgtctgacgcgaagcttccagttgtcgtccccagctcattcaggttcttcctgaattcacttccttgcagtcgtagggcgcagtccccctttccttgctggctgtcagtaataaacattcagtgcacaaatgaaaaaacccaccccaggccaggcgcggtgactcgcacctgtaatcccagcactttgggaggccgcggtgggtggattgcttgaggccaggagttcaagaccagcctgggcaacatggtgaaaccccgtctcgactaaaaaatacaaaagttagctggatgtggttgtgagcgcctgtaatcgcagttactcgggaggctgaggcaggagaatcacttgaacctgggaggcggaggttgcggtgagccgagatcacgccattgcactccagcctgggtgacagagcaagactccatctcaaaaaaaaaaaaaaaaaaaaaaaaagaacacacagcgctgcctcccatgagcctagccaaggcccgactgtgcacctgccacagggagctctttggaagggccgccctgcagccagccccagacaggaggcccagcagcactgggtacagaagcaccatttcttcccatctcagccctcggccctgatcagcctttcttattttatttttattttcttgagacagagtctcactttgtcccccagtctggagtgcaatggtgaaaccctagctcactgcaacctcaaactcctggcctcaagccatcctcccgcctcagcctcccggagtagctgagactacaggcttgtgcgaccacacccagcttaccttttaatttttttttttttttttgatggagtcttgctgtgtcgcccaggctagagtgcagtggcgtgatctcggctcactgcaacctccgcctcccaggttcaagcgattctcctgcctcagcctcctgagtagctgggattacaggtgcccaccaccatgccaggctaatttttttgttttttgtatttttagtagagacggggtttcaccatcttggccaggctggtctcgaactcctgacctcgtgatccacccacctcggcctcccaacctgctgggattacaggcgtgagccactgcccccggccttgatttttttacttagaggcagggtctcgctgtattgcccaggctggagtgcagtggtgccatcccagctcactgcaccctcattatgttctcctgaaattcggcttcgcttccccaagaacatttatttttatttttttattttagagacagggtctcactgtgttgccccaggctggctttgaactcctggcctcaagcaattctcctgactcagcctcccaaagtgctgggattacaggcacgagccaccgcacccaacctgatcagcctcttttaacagggtctgggggactcaggaccttccctgccgatggaggaaccctcggtagctcccgctccctcgcctctctggccgccaggcccaggagccgctcggtaaagtccctgtctctgccaggccgggtgcattcttgacattcctgtccttttacgcaggccgccccggccagctctcagaagcctccaccggctgcatgctctctccctgctggtgagaagatggccctggcggcggcggctcctggtcggtttatcgagccgggagtggcactttcccaactatgagaactatgcttggaattcagagccaccgccagcctctctgggtctcgctgtcacggcttcctgtgcagctggaaaacacctccaagagtggccgtggcatcacagacctaaaaaaggagctgggtttgctccggcaggtctccccgggaggagggaagccagtctgtcccgctgcccggcgggcctcgctgtctgctcggcagagacaggccaggcaggtttggacttctcgggatgctccagcctcagcgcccccagggtccccgcaaaatctccaaccaccccaggcctgctgtctgcttcttggctttacagcccaggacacctggattcagcccacccacccccgagcaggggcccacgcacccaccctctgcacaggctgggcacgccgtcgggctaagggtcccggcaagaatcagtcttagagcacaggccgagtgtggaggctccgtctgtaatcccagcactttgggaggctgaggcaggaggatcaccggaggccaggagatcaaaaccagcctggacaacatagtgagacccccatctctacaaaaaattaaaaaattaggggggcatggtggtgtgtgcctgtggtcccagctacttgggaggctggggcaggagaacggcttaggcccaggagttcaagttttcagtgaggtgggatcacactactgtactctagcctgggcaacagagtaagaccccttctcagagaagaaaaagaaagaaagagagagagagacggaaggaaggaaggagaaaagaaaagaaagaaattgagaaagaaacagagagagagagagagggagggaggagggaaggaagggagggagggagggagggagagccagagagaaagagaaagaaagaagaaagaaaaaaggaaggaaagagagagagaaggagggagggaggaaggaaggaaggcaggaaggagagggagagagaagaaagaaagagaaagagggagggagggaaggaggaaggaaggaaggagagggagagagaaagaagaagggagggaggcaggaaggagaaaggagaggtgtgagttcctgcgatggtgtgtatttagaatgcagaactttaggccactggatgagcaaggcctctaggttgttctccctaaaccctttggccaatgagacagggcagctgggggagggacgacacccagcctccagcacagaggtccattcagggctccactgggaccgtgtcaggtgtgtgtccatcccccattggatatcgtatgtgtctaaaattgagcttatggccgggcgcagtgtctcccgcctgtaatcccagcgctttgggaggccgaggcgggcagatcacctgagttcaggagttcgagaccagcctggccaacatggtgaaaccccgtctctactaaaaatacaaaaattagccaggcgtggtggcggacacctgtaatcccagctgctcgggaggctgaggcaggagaatcgcttgaatcaggaagcaaaggttgcagtgagccgagatcacgcctttgtactccagcctgggtgacaagagggaaacaccatccaaaaaaaaaaaaaaagttggtatatatgtttatttctcagtttgtgaaaatatccttaatttattgtcgtcacaaacaaatttcaattctgattactatgcaaggaaaaaacagaagataatctgctttgcaacgcagtttatagttcatttgtttacaggaacatgcaatatatgaaaaattactaactaaactacaagtattaaatacctaaattagttaacagtttattataatttatttaacaatctagggctgggtgccgtggctcacgcctgtaatcccagcactttgggaggccgaggtgggcagatcatgaggtcaggagatcgagaccatcctggctaacacggtgaaaccctgtctctactaaaaatacaaaaaaaaattagccgggcatggtggcgggcgcctgtaatcccagctactcgggaggttgaggcaggagaatggcttgaacccaggacgcagagtttgcagtgagctgagattgcgccactgcactccagcctgggagacagagtgagactccgtctcaaaaaaaaagaaaaaaaagaaaaatatatatatctaggaagtctgaagccatcagcacttccaatgcagtgaggaattcaggaatctcagtggagctgttagagtagtgaaccttgtaagtaaaatatatgcatgcctttctattgtgtttttttaaagacagggtcttgctctgttgcccaggctggagtgcagcggtgcaatcatagctcacttcagcttccaactcctgggctcaagcagtcttcctgcctcagcctcccgggtagctggaactacaggtgtgcaccaccatgccaggctaatttttttttttttttttttttgcagagacgggggtctcactatgttgcccaggctggtctcaaactcctggcctcaaatgatcctccagccttggcctcccaaagtggtaggatcacaggcatgagtcaccaccactgctgatggcctgacgcatgctttggatagcatcgtggagggatctctctaaaattgacctggtcggtttcattctcagcagactgacctgggccactcagcacggctttccttattcctgatgctcgtgtatgttctctttttacaataaagtcatcatcgtcagaagataccagtttaccatccatggcatcagggcctccgtagccactgcagcttttctcctctccattcattgttgttttgttttgttttgttttgttttgtttgagagagagtcttgctctgttgtccaggctggagggcagtggcgcaatcatagctcactacagcctccgccttccaggttcaagcaattctcccacctcagcctcctgagtagctgggactacaggcatgcaccaccacatccggctgatgtttgtattttttggtagagatggggtttcaccgtgttggccaggctggtctggaactcctgaccgcaagtgatctgcctgcctcggcctcccaaagtgcattcattatgttcttttgaaattctgtgtcgcttccctcaagacctttcataatttcttgtcagccctgcagtcactgtaaccgggtcccagcctaacaccacaacccccactccagggccagtttcccgcctccagcttcaccacaacccccactccagggccagtttcccgcctccagcttcctgtcccatcagaaccgtacactttgagcatgctcagtgtattatatgttgattacatttatatattatgaccctattctatattctatatcagatttattttattatagccaggtgccatggctcacgcttgcagccccagtgatttgggaggctgaggcaggaggatcgcttgagaccagcctgggcaacatagctgtagagacttcatctctacaaaaaataaaaaactagccaggcctagtggcatgcacctgtagtcccagctactcaggaggcccaggcaggaggatcgcttgagcccgggagttggaggctgcagtgagctatgattgcaccactgcactccagcctggacaacagagtgagaacctggctctaaaaatatgtatgtggccgggcgcggtggctcatgcttgtaatcccagcactttgggaggccgaggcgggcggatcacgaggtcaggagatggagaccatcctggctaacacggtgaaaccccgtctctactaaacaaaatacaaaaaattagccgggcgcggtggcgggcacctgtagtcccagctactcgggaggctgaggcaggagaatggcgtgaacccgggaggcggagcttgcagtgagcagagatcacaccactgcactccagcctgggcgacagagcgagactccgtctcaaaaaaaaaaaataaaaataaaaataaaaatatgtatgtatatatattttattatctgtataataaaatatacacatacacaaatggagtccgaccaggaagcacagactgtaccccaaggccaagagagcccctcccgagaacccagggtggcccagcctctgcacagaacccctagggtgtcgtggagcacaggggaaaccgctgtctagttctgaactttacagccgagaaagctgaggctcagggaagtccaggggacgtgctcagaaccaggtctccggcccaagaaagtcctccctgtcgggacctcgctgcaggcctcctgtgctctgtcacatatacgacccacacacgcttcagtgcggcagtgctcttgtctgcaagccagaaacacagatcttatatttcttgctccaagacaaacaaaacatcgattgttttaatctttcactttagttctgattaggaagaaaacatgtggcttcagtttcaaaaacagcaagctgaggcccttttcttttcttttcttttctttttttttttgagatggagtttcgctcctgttgcccaggctggagtgcaatggtgcaatctcggctcactgcaaccgccgcctcccaggttcaagcaattctcctgcctcagcctcctgagtagctgggactacaggcgcccgccaccacacccagctactgtttttgtatttttagtagagacgggatttcatcatgttggccaggctggtctcaaactcctgacctcgtgatccgcccacctcggcctcccaaagtgctgggattacgggtgggagccaccgcgcccggccttcttttctttttgagatatgtctcactctgttgcccggctgaagtacagtggtgtggtcataactcaccgcagcctccaactcctggactcaagcgatcctcctgcctcagccatccaagtagctgagactataggcacacaccaccacacccagttaattttcttatttttgtacaggtggggtttcactctgttgctcgggctggtttcaaactcctgggctcaagtgaccctcccaccttggcctcccaaagcactggaattccaagcatgagccaccacacctggcccaggatttcaacatatgaacttgatggggtcagaggaggacacaaatatttagtctgcaacaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcttatcaagctctttcctctctacaacatttttgttgtttttcacttcttcctgcattttctacctttcatctggaattatctttctctagttttaccttttaaaaggcaagtctgttggtgagaaagtctggttttgtttatctgaaaatgcccttatttccccctaattcttgaaggatattttcactgggtccacctaattgctgctgttttttcctctggcaacttttgtttgttgatttttgtttgtaattaactgattttatcaaagtccaactcaaatgcagtaagatgaacagatcttaaagatacagtttgatggattttagcaaatgtgtacacctgtgtacaccaacagctcaaccaacatagagaacatcgccatcaccctagaagttatttcatggccctttctagccaacaccctggccagaggcagcaacctctgttttcatttctatcaccatagttttgcctattcttgaactttatataaatggaattatataatatgcacctctaatatccagcttctgttgctttactttttttatttttgagaggcatttattttttaaatatttaatattaatatttaatatattaatattaattaaatactaatatttaatattgaataatgtattatcttttatttttttagaatacatttatatttttgagaatcatacacgttgcttgatctctcaatagtttattctttttttgtgtgcagccgtatttcattgtgtgaaatgccatggcttgtttattctctcgttgacaggcatttgggttgtttccaggttttgctgttatgagtaaaagcttatgaacatctcgtacaagtccttttatggagacatgtttttatttatcttgaataaatccctaggagtggaattgctgggtcataggtgaggtatgtgttcagccttataagaaactgctaagccattttccatggtggttgtactatttcacattcctgtcagtaatggatgatgcctccagttcttctacatcctcccaaatatttagtgttgtcagtcttttaaatttttgccactctagtggttgagaggcagtctctcttgatgactttaactcatatttccttcatgactaatcattagacaccatttcatgtgcttattggccatttctctgccactttttaggacatttcttttgcctgaggttctagggattctgaaatctgtggcttgaggtctttttatcagttttagaaagttattggtcattatctcttcaaagattgttcctgcttcattctctctctcctccttctggtgttccaataacacgtatattagacgtcactgcatcttctatgtcttttgctctttcttctgtagtttctttccctttgtgtcgtcttgcttcattctggatatttttctctgttctgtcttccagttcactaatttttatttcttccattgagttcttacttttcagatattgtcattttctccatatccactggttcctttttttccccattgttccaatttgcagcgaaaattccaatctcatctttttatctctttgaacgtaattaacacaattaatttaaagtctctgtcaattcccagtatatggaaaccctgtgggtctctttgtagtgctggtttttgttttttttttgtttttttttttttgagacggagtctcgttcttttgcccaggctgcagtgcagtggcgtgatctcagctcactgcaagctccgcctcccgggttcatgccattctcctgcttcagcctcccaagtagctgggactagaggcgcctgccatggcgcccggctaattttttgtgtttttagtagagacggggtttcaccgtgtcagccaggatggtcttgatctcctgacctcatgatccgcctgcctaggcctcccaaagtgctgggattacaggcgtgagccaccgcacctggcagtgctggttatttctgctgatttttgtttatgtggtcctggctcctcgtatgtcttacttgcatgccagatattgtattgtgcatttttttttttttttgggacggagtctcgctctgttacccaggctggagtgcagtggcacgatctcggttcactgcaagctccacctcccgggttcatgccactctcctgcctcagcctccggagtagctgggactacaggcgcctgccaccaagcctggctaattttttgtatttttagtagagacggggtttcaccatgttagccaggatggtcttgatctcctgacctcgtgagccaccgcgcccggcctgtattgcggatttgcatgtagaaataatctgaggcctgggatcgtattattttcctccagaggggatttatgtttacttcttccaggcatttggggccaccagcaatctcgcatcaccttaatccaatattagggattgagattattcaaaactctgctgtagttgctagaaggacctgtctgcttcctcttgatctttactcccttttttttttttttttttttttttgagacggaatctcactcagctgccaaagctggaatacagtggcacgatctcggttcactgcaaccaccgtctcccggattcaagggattctctcatctcagctcctgactagctgggattacaagaacccgccatcatgcccagctaatttttgtattttagtagagacggggtttcaccatgttgaccaggctagtcttgaactcccgacctcaggtcatccacctgcctcggtctcccaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaccccaaacccaggctctctttcgatcctcccctaaatcctggctggaaattctccattatcttaataaccctgcaggcccttgagcagatgctttgacattctgtccagcttttctttcttttttgagacagggtctcactctgtcacccaggctggagtgcagtggcacaacgtcagctcactgcaacctctgcctcccgggtttaagtgattgttgtacctcagcctcctgagtagctgggactacaggcacccgccaccacgtccagctaatttttgtattttaatagagacggggtttcaccatgttggccaggctggtctcaaactcccgacttcaagtgatcctcccacctcagcctcccaaagtgctgggattacaggcttgagccaccgcacccagccctgtccagcttttttttcttttttttgagacagggtctctctctgtcgcccaggctggagtgcagtggcacaatctcagctcactgcaaccactgcctcccgggtttaagtgattcttgtgcctcagcctcccaagtagctgggactacaggcacgtgccaccatgcccagctaatttttgtatttttagcagagatggggtttcaccatgttggccaggctggtctcaaactcccgacctcaagtgatcctcccgcctcgacctcccacagtgctgggatcacaggcgtgagccgccgcacccggccctgtccagcttttctagtggacctcagcaagagagtgggtttgtccttagctgctaatccaccattgtgcaagccaaaatctgccaagagagatttttaacccaaagtccaagtcgtttagaaggaggtcatggatattctagatcctcttgatcttggagccacaggatgacaaatggggacccatcctcagccttgagaggagccctctcatcttccagctgaggaagccaagacccaaaaaccaggagcagagccagagtgcgagcccggattttccatttccaggcaggcaccgtgtggtccctcttcaggagcaggtgtcagcccttatcccttgaacaagatccctggcaatgacctcacctctccctgaaacctgaatgttctgtcagttcagcaagaggctgatgcaactcacagtccccagaggcccttttgtctctcatcgagtccataaatgacacggaaatgatctaagcatgactggtcaccctggacttctggaactcatcacggagcttacaagactctcctctcacctttaccctatggctcagaagaagaagggatttgcccaagctcatgctttaagttcaacaacacaaaaatgggccgggcgtggtggctcacgcctgtcatcccagcactttgggaggcccaggcaggtggatcacctgaggtcaggagttcgagaccagcctggccaacatggcaaaaccctgtctccactaaaaatacaaaaattagccgggtgtggtggcgcatgcttgtaatcccagctactccagggggctgaggcaagagaatcgcttgaacctgggaggcggaggttgcagtgagccgagttggtgccactgcactccagcctgggcgacagagtgagccatcatctccaaaaaacaaacaaacaaacaaaaaaacccaccaacacaaaaatgggtaatttcaggacacccagtttgtggctctatcccgaatccgatccatgctgatttttaatctgatcagcttccagctctgcccaggtctctccagggccggcggtggggggctgttgcaattccctgctgcaccccagcctcagggcaggtcaggggagtggcgacagggtgcaagtccacggggagtgagatttctcaagagctccgggcaaaccggcccttccacattcgctgggtgcaggatgttccagccaccttgtctttccagcagctgtgtttatatttggcagttgccacaggtccctggaagagggtcctcttcctgcctgccagactctggaacccctgtttcctcacacaggaacctgggggccaggcctggtgcagagatgagagtgtccctctgagaattccaacagaggtcactggggctcagagagggaaggaaactttcccaaggccacacagcttggtagagccagggcagatttctggcctaccaccttcccgagttccctcctctgtgggagctgtggtctcactcccttcaaatgcaacggggctcacatctgggggaagactcccgccctgtggggcctctcctagtcacaaagcattctgggatgctaataaaattaaagcccttttggaaacacccctgtatttacttttttttttttttttgagaccattctcctgcctcagcctcctgagtagctgggactacaggtgcccgccgccatgcccggctaatttttttgtatttttttttttttttagtagagacagggtttcaccgtgttagccaggatggtctgtatctcctggcctcgtgatctgcccgcctcggcctcccaaagtgctgggattacaggcgtgagccactgagccaggcctttttttttttttttttttttagacagggtctcactctgtcacccaggccggagtgcagtggcgcgatcttggctcactgcaacctccacctcctgggttcaagcgattcttgtgcctcagcctcctgagtagctagaattacaggcacgcactaccatgcctggctcatttttttgtatttttagcagacgtgggggtttcaccatgttggccaggctggtcttgaactcctgacctcaaatgacccacccgcctcaacctcccaaagttctgggattacaggcatgagccaccacgcctagcatattttcattcagtaccatttatttttggggccttcagtcagctgggttcaaactctttgcgttttgcctaagggaaccactctgagctgcaggatttctcctgataagggagttccataaaggcctaaaattttcccccaggggacacctgtccaagtctggggacatttgtgctggtcatgactgtgggcgcactggtgggggggggggtttcctggcaaggagtgggtggagaccagggatgctgcccagcaccctgcagtgcccaggacagccccaccccagaaaaggatccagccagagggagagggcctgtactggagtgagttaaacttcccggtgtagatcaggtctctttaggattttaggaacttcggagttcagcccattttgcagactggggccctaggctgtgtctctctttactgacaccactgtcaattttgtcgcagttttgggtctttgtctgctcagccatctgctcagcaaacgtttaggccacacctcctcacctcctctcctcctcccagtggggacaggttcgagggcgggggcacagctccagaggggcgatgcctccaggcaggaacccaggcccccttcctggagggatgcgcgacaccaaaactccctctgcacccccagatgagggccggtgggagtggtgccgtctgagtgagacacagcattgggctgacctcagggtcccggttctgatagtgtctcatagtcacaggtgacgtcgccctggaggggaccgggagagggtgcgtggggctccctggactatgtttgcaactgcctgagtccataattgtttcaaaataaaaagttaagatagggccgggagcagtggctcacgcctgtaatcccagcactttgggaggctgaggcgggtggatcactaggtcaggagtttgagaccagcctgaccaacatggtgaaaccccgtctctactaaaaatacaaaaattagcccggtgtggtggcgcgcgcctgtagtcccagctactcgggaggctgaggcaggagaatggcatgaactcaggaggtggaggttgcagtgagccgagattgtgccactgcactccagcctgggcgacagagcgagactccctctcaaaaaaaaaaagttaagataaacaatattcaataaacctataacagattatataactatataatacatatatacagatataaaatagtaatctaaatatattataaatacaaatataaaatcaatagcaaacaatgtaaatgtcaaaatagaaatcaaactatataattaataatgtataaattatgtaaatgatgaataaatataaaatatgtatgcaataagtgtataatacatactaaatactaaaactatatattagtaatacaaaactgatatgaatatatagtgaatgaatcttcaaatatgtaataaatgcatgataaatgacataaatataaatatgagtataaatataaatatatgagtaaacaaatatataataaaatatataaatatgtaataaatgtataatactatagtataatatagtataagtttatattataaactaatagtagaccaggcgcggtggctcacgcctgtaatcccagcactttgggaggtcgaggcgggtggatcacctgaggtcaggcgtttgagaccagcctggccaacatggggaaaccccgtctctattaaaaatacaaaaattggccaggcgcagtggctcacgcctttaatcccagcactctgggaggccgaggcaggcggatcacaagatcaggagatcgagaccatcctggctaacacggtgaaaccccgtatctactaaaaatataaaaaattagccaggcgtggtggcgggcgcctgtagtctcagctacttgggaagctgaagcaggagaatggcgtgaaccctggaggaggaggttgcagtgagccaagatcgcgccgctgcactccagcctcggagacagagccacactctgtctcaaaaaaaaaaaaaaaaaaaaaaaattggcgtggaggcaggcacctgtaatcccagccactcgggaggctgaggcaagagaatcgcttgaacccggaaggcggaggttgcagtgagctgagatcgcgccaccgcacttcagcctgggcgacagagcgagactccgactcaaaaaaaaaagaggcagagcacttgctttcattctaacttttcactcttacacataacgcaattataaacgcctttctatatgtagatttttatttcttttcattttttgccctcgggataactgccggagcaaggggttagagggcggctgctccctgggggtccctgtggtcccacctccctccctgccggtgctgccagctcctgtcctgcggttttgttcagcccttctgtgcactggagcctcgtgtctgatcagctcaggtctgctctgtttcggggctggtcacccttccctgagcgaccacagatttccactatgtcctggagtggggggtaccctcatccttcttgactttcaggcgcgagtgggatttttctgcacgaggcgggcttagactcgggtgtggctatgagccttttgctaggaggccagcgcggggccgggcggcgtccctcttcagttttatttttggagagcctggcctggagccttgcctgcctgcaggagcctgtgcaccgaggcagagcccgaccgtcaggagggagccgtggggactgtgtgcacctttgaccacctggccctgcccccggagctgcctgctcccgcccctcccacagcttccccgggccacgggccccgaggcaagctcattcaggtcggggtgcccggcacccgtgcgcctctgcagggaggcagttgggaggggcgttcctggctgactcagtgcgtggccagttctgctgctgttggcttagtcctctgctgggggcatggctgctcctgagtcagtgccggctggtgacaccaccgagacggggacttagggaggcgactgcatgggtgatgcaatctgtgtctgagtctcggcatctcagcccaagcatccacatgcactcccgtgcgcacacacacgcacacgcatgtacacatgcagacacatgtacacacccacgcacgcacatatccacgcacctacagtgacgtacacacacgccaacacgcatgcacacacccatagtgacatgcatgcccacacacgtgtgcgcacacgcacatgcagtgccgtgtccacacacgtgcacatacacacgtgcacactggcatgcatgtccacacacatgcacgtatgcaaatgcacctatgcacacactcatatgcagacgcacacacgtagatgtgtacatgcactcatatagacacatgcacatgtacacacatgcaaggatgcacactcatatgcatgctgacgtgcacacccatgcatatgcaggtacacatacacatgcagatatgtgtgcacacacgcatatatgcacactcatgaatgccagtatacacatacacacatacatgcacacgcaaggtacacatacatgcacatgtgcacacacatacacatgtgcacactgacatgcacaccacgtgtacacacgtgtacagtcacatgtgcatcattgacatacatgcaaataaacatagacacacacacacagcgcagtcctctctggccttcctggcaggcctgggttattacccagcccaaagggagcatctcgcagggaatttcgcccaaaacagaaaagccagcacggctcaggacctgatgctcacatggaaattgcgggcggtggctgcccagggcagcaggggcccagggtctgggtggacactcctgactgtggatgctaaataggaccccctggccttccaaggaaaacaggaggtgcggccagcccgtttgttctctgcgtgcacgtatttttagcactgagtaatttaggtatttttaagcccaaccaagggcggttttccctgagttggatgttttgtggctgctttgaagctctctggaatcagagccctctgagcggccacacgtgggctctgcctccagagcagacagattgggccttctctgcccccaaaaagtgggggtgggacgtctgctggaaaccaaggaggctgggcggtgtcaaagggattttttgtttaattgccccttttattgagatcgccgtggagtcacagccagtgctaacaaagaatgtagaggaattctgtgtgtcattccccggccgtccctggtggtaacatttggtaaagctatgggcaggatcgcagccagacagtcacacacccaccagcctcactcaggttccgcagtattcagtattgtgcccgctggtgtgtgagtgtgtgaggctctctgtgagtttatcactcatgtaggcttgtggattcatcaccgtagttgaggcactaacagggatcattcgtgttgcccttttattatttattcagagatggggtctcactaaattgcccagtctggcctcaacctcccaggctcaagtgatcctcccacctcagcctcccaagtagctgggaccacaggagtgcgctacccatgcccagctaattttctaattttttgtagagagggggtcttgctatgttgcctaggctggcctcaaactcctggactcaagtgatcctcgcatctcagcctcccaaagtgctggtattacaggcaagagccaccatgcctggctgtgttgcccttttatacagagacctatctccctcccagcccctgcccctccctgatccctggcagccgctaatctgttctccatttctaaaatttcgtccttgggccgggcatggtggctcatgcctgtaatcccagcactttgggaggtcgagacaggcagatcacttgaggccaggagtttgagaccagcctggccaacatggtaaaaccatgtctctaccaaaaatacaaagattagccaggcatggtggcacatgcacctgtaatcccagctactcaggaggcagaagtgagagtatcgctggagctggagaagcggagcttgcagtgagctgagatcatgccactgcactccagcctgggcaacagagcgagactctgtctaaaaaaagtcctcttaaacacattacacaaacagaagcatgctacacatcccaggccctggagattcccctgcggtgtggtatgcatggatggtcctttccttcttttttttttttttttttttttttttttgagacagagtctcactctgtcccccaggctggagtgcagtggcgtgatctctgctcactgcaagctccgccttccgggttcaccccattctcctgcctcagcctcccgagtagctgggactacaggcacccgccaccacgcccgggagacggggtttcaccgtgttagccaggatggtcttgatctcctgaccttgtgacccgcccgcctcggcctcccaaagtgctgggattacaggcgtgagccaccgcgcccggccagtcctttccttcttatcactaagtaggcattttttgagaactctggaatctgccttgacttctctgcggctgcctggctctgcaaaacagacagcgatgccatgagttatgacagagacagggtgcggcttaattaactgctcacagacgcccggctgggactgcggctgcccaggactcttgaacctggcccctgcccctgccacccccatcagcaccaaccccctcactgggtcctacgaagcaggtttctctaggctggacactactgacacgtggggctggatcgttccctggagcggggccgtcctgggcactgcagggtgctgagcagcatccgtggcctccacccactccctgccaggagtacccccaagtcatgacagccacaaatgtcccagacatcacccagtgctccacggagggcagagtcacccccagatgagatctggggattccacggactcccaagagactctgcgtcctgtgatcgtctgccctgttgaggtcctgggtttttccaggagaattcaagaagcaacagcatgggctcctgactggttcaatatgaaggacacggaggagaggccgggctcacacctgtcatcccagcactttgagaggccgaggagggtggatcacctgaggtcaggagttcaagaccagcctggccaacatggtgaaacgctgtctgtactaaaaatacaaaaattagccgggtgtggtggcacgtgcctgtaatcccagctactcgggaggctgaggcaggagaatcgcttgaacccgggaggcagaggttgcagtgagccgagatcacaccactgcactccagcctgggcaacagagcaagactctgtctcaaaaaaaaaaaaaaaaaaaacacggagggggacagtcaccaggggttctgctgtgatccctgccctgacccagggtctcccctgggtactatggatatcgcgttcggatccttccctggcgtggggccgtccggggcactgcagggagctgagcaatgtccctggcctccacccaacccactccatgccaggagcaccccccacagccacagatgtccccagatatcacccagtgtcccctggagggcaagaacccctgccatggactgaggcaggccacccgggagcctgcgtgggtcctcccttctccagagggcctggcctattgcctttgccctttctttattttttctttatttttttttttgagacggagtcttgctctgtcgtccaggctggagtgcaggggcaccatctcggctcactgcaagctccacctcccgggttcacgtcattctcctgcctcagcctccagagtagctgggactataggcacccaccaccatgcctggctaatttttgtatttttttttttttttagtaacgatgaggtttcaccgtgttagccaggatggtctcgatctcctgacctcatgatccacctgcctcagcctcccaaagtgctgggattacaggcgtgagccaccacgcccagcctgccttcgccctttcattctctcgttctgcaaactcccacagaggattgtgacggctgaccgcgtgccaggctctatgctgagagttaaacgagtgccagctctttgtacacggaggcccctggtccccacccagaggcaaagtggccgtgcctagagtcgggaaggttgagccaaggcctggcgcccctgctgccacccagaggcctgacctgaactttgacccacacccctctgcttcccccacagctctctggacaacggggcccagagctgatggcagacaatgtcagccactaacaacatagcccaggcccggaagctggtggaacagctacgcatagaagccgggattgagcgcatcaaggtgagcccagcgggcatcaggaagaggaggggagagacccttgggggccccgcaaatgatgaacaggaggctcggcaggagggcagaggcttgcaccccaactgtgtctcttgctgtgtgaccttgaggccctcccttaacctctctgagcctccatttcctcggcagaaagaggcagctgatctaacacctatctcctgccttcgtgcagcaatgtaacgtgctttgtaaacacactggggccccgtggagacggtcatcgtgacagagcgctttgtcgtcctcatctgcattgatctgtccagctccttggcaatgacagatgcaaattaaactgagagacacagtcccaggcgggaggagactgcatgtcctatctacttttttcacttctgtgttgtttgaaggatttgtttgttttgtttgtttgagacggagtcttgctctgtcacccaggctggagtgcagtggtgcgatctcggctcactgcaacctctgcctcccgggttcaagcaattcttctgtctcaacctcccaaatagctgggattacaggcatgcaccaccatgcctggctaattttttgtatttttagtagagacggcgtttcgccatgttgcccaggctggtcttgaactcctaacttcaggtgatccgcctgcctcggcctcccaaagtcctgggattccaggcgtgagccaccatgcctggcccgtttgaagttttttacaaggatcacacttgaggctgcgccttgtcgagatttattttaaggcaagctctgaaatctgcagtgtaggccagcaggctggagacccagggaagagttggtgctgcagctggaaccccaaggccacctggaggcagagttccctcctcctggaaggaccccaggctttttctcttaagcccttcaactgattagatgaggcccatctgcattacagacggtcacctgctgtgcttgaagtctacggatttaaatgtgaatcacatcaaaaaaaaaaaaaaaattttgcatgtgaggcacagtggctcacagctgtaatcccagcacattgggaggccgaggcaggaggatcacttgaggtcaggcgttcaattccagcctgggcaacaacatagcaagaccccatctctacaaaataaaaaacaggctgagcgcggtgactcacacttataattccagcactttgggaagctgaggtgggcagatcacctgaggtcaggggttcgagaccagcctggccaacatggtgaaaccccgtctctcctaaaaatacaaaaaaaagattacccgggtatggtggtgcatgcctgtaatcccagctatttgggaggctgaggcaggagaatcacttgaacctgggaggtggaggttgcagtgagccgagatcgcaccattgcactccagcctggggaacagagcgagactctatctcaaaaaaaaaaaaaaaaaaaaaagaaacaagaaaaaaacaaccttcacagcaacatctaaaaaaacatttaactggccaggcacggtgactcacgcctggaatcgcagcactttgggaggctgaggtgggcggatcacaaggtcaggagttcgagaccagcctggccaatatggtgaaaccccgtctctactaaaattacaaaaaaattagccaggcgtggtggcaggctcctatagtcccagctacttgggagactgagtcaggagaatagcttgaacccgagaggcagaggttgcagtgagctgagattgcgccactgccctccaaccccaagcgacagggtgagactccatctcagaaaaaaaacaaaaacaaaaaaacatttaaccaaaccctggggcaccatggcccgccctagtgcacccataaaatcagccatcaccccacgtatccactcagaactcagctctccagcacctgtcaccagcttgtcattattggccacgggaatttattaggaaggggtgaccggcccttgctttgctcccagcggggaggcggacagagtcgtccctgctggccaggtggcacaggtggttctgatcggccggtgagtctccctccagcgcagctctgagccctcccagaccccatcacgctgctgctggccgggatccaaccagtaggggaggggtctgcctcccacgaggtgtctgaatgttccagcaatctgactgctgaggacagacctgagcattcaaagcattccttcgggctgaaaagagagaaagccctggttgaagtggttttccttttacgagtgggtgccagcccccagcccgggcggagggcggtgactcatcctgccctgtttgatgttgaggaggggcccccaccgcccctttgaatgtcgggcctcggggggagccaggatttgacccgtccccactcccagtcccgcctgaggttttacatccccagctccaacgcggcgaccagaaccacagaacctcaacggcgacgatcttggggctcaccagcccagcgcagtgggcatggggggtggtgccaaggtgccacgtgctggagccacaatgccagctattttcggggtctggaggctatttctgtcgtccaggagggccgcttcccaaatagaagtctagaaagcaggccaggtccgagtcatcacaggccgcggccggcgggctcactctgtgggcatgagcgtcccccggctgcccagctgggcaagaccccaaagctgtcccacaggctcctggccgtttgaggggcccaggtcccaggtatccttggggtccaaaggaggacagaggatctgggatgcagaggtactggccaggcgaggcggctcatgcctgtaaccccagcactttcagaggtctaggcgggagggtcgcctgagcctaggagttcgagaccagcctgagcaacatagtgagacctcatctgtaccagaaaattattctaaaaattatggccaggccaggcacggtggctcatgcctgtaatcccagcactttggcaggctgaggtgggcgggccacctgaggtcaggagattgagaccagcctggccaacatggtgaaaccccgtctctactaaaaatacaaaaattaccctggcgtggtggcgtgcgcctggagtcccagccacttgggaggctgaggtgggagaactgcttggacccagggggcggaggttgcagtgagccgagatcacgccactgcactccagcctggctgacagagtgagactctgtctcaaaaaaataaataaataataaaaatgaaaattatggccaggtgtagtggctcactcccgtagtcccagctactcaggtactcccagctgaggcgggagaatcacttgagcccaggaggtggaggctgcattgagctatgatagcaccactgcattccagcctgggggacagagcgagaccctgtctcaaaaacagataacaaaggcacctccgtgaagcgacactgcgatccttctcggatcatcccctcacctctgccacatctaatcctccccctgtgatcgccctctcgccttccaggaaagaaagcaaggagagaaaggtcgctgagtcccacagagacacagttaccggttacgggatgagatccagggccagatggacgtgtccccgtgtagcctgacccaggacaccggacaccccagccccagccctgctggggtgagctaagcggggagtggcagcggcacccccaaaggcatggccaggagagacgggcgtgtagcctggggcgggctggcagcagcccggggcagggggtccctcctgtgaccggaagcatcagcccctcagagggttggagtcatcagggggttcaggctgcaagagaaacatggagacgggcttatctcgtcctcaccgggcccagccccctggccgggtgtcaccgtgaaacctccctcaagctcatcaaatgtgcaggcagcgttttcctatcaggaccttccttccttggggtgagaatgaggtcttggactccgaaaacggggtccatctgtccctgaccctttgtgttcaaaatctggcaacgcttgctgaaggaagctcagccttttcttttttaaaaaaatattttttaggccaggtgccgtggctcacgcctgtaatcccagcactttgggaggctaaggcaggtggatcacttgaagttaggagtttgagaccagcctggccaacatgctgaaacccgtctctactaaaaatacaaaaattagctgggcgtggtggcaggcacctgtagtcccagctactcaggaggctgaggcaggagaattgcttgaacccggggagcaagagattgcagtgatcacaccactgcatttttctttttttaattttgggaaaagacacacataaatttatttatttgtttatttatcttaattgagacagggtcttgctccatcccccaggctggagtgcaatggtgtaatcttgactcactgcagccttaacctcccaggctcaagcaatcctccagcctcagccccccagttagctgggactacagatgcccacatcactatgcctggctcatttttgtattttttgtagagatagggcctcactgtgttgcctaggctggtctcaaactcctgggctcaagtgatcctcccgcctccgcctcccaacatgttgggattacaggtgtgagccaccgcacctggccaagacacatataaagtttaccactagtgatatttaatatagtcacaatgctgtgcatccaatcacgtttattccaggacattccatcaccccaaaaggaaaccctgtcccccatcagccatcactccccagcaccggcacccacgcatccccttcctgtctctgtggataggcctgtcctggacatttcatagaaatgggatcacacggccgggcgcagtggctcacacctgtaatcccagcactgtgggaggctgaggcaggcatatcgcgaggtcaggagttcgagaccagcctgatcaacatggtgaaaccctgtctctactaaaaatacaaaaattagctgggtgtggtggtgcatgaaggtaatcccagctactcgggaggctgaggcaggagaatcacttgaacccgcgaggtggaggttgcagtgagccgagatcgtgccactgcactagagcctgggcgacaaatagagtctctgtctcaaaaaaaaaaagaaagaaatgggatcacacactgtgtggccttctgtgtctggcatctctcactgagcatgaggcccttgagatgcatccacgttgtggcctatgtcagagcctcactccttttcatggctgagtaatattccagcgtgtggacgggccgcactgtttgcccacgcccccatcaatgggctcctgagctgtttccgcctgtggctcttgggaatggtgctgctgtgaacccgggtgtgccagcctcttcttatgtctcctctgtctcctccttgtgctcaaacacaggtctccaaagcggcgtctgacctcatgagctactgtgagcaacatgcccggaacgaccccctgctggtcggagtccctgcctcggagaacccctttaaggacaagaaaccttgtattattttataactgtgttctcatatgttctctctctctctctctctttctctctctctctctctgtctctgtctctgtctcaggcagggcatcattcagtaattagctcaaacaaaacatctcaagtccccaaaacctttaattccaaaagaaatcccccctctccccgccaaaaaaggcgttcccaccgcccggatggggtagaatggaccttgtaggtggagatgaattttcaggtccgaccccatggccctctcagtttgggccaaaagggatggaggctttacggccacttcccgttcggaataactgaaatcccccagcgatggggtaacaattttttaaaactctcgattgccgtttcaattgtggaccggcgccgagggggaaagggaggtgacttcgcccggtggcaatagttccgggagaattggccattggtaaaaagacttcatagggtcactggaatgctttgtgttgtttttaagtagaggtaaaattgagatggggggcgggaggtgacatcatgaagttttttggaaatatctctttatttaaaaaattgttactccatacggctaaactcggattgtgatggttgaacccgtcgctaaactgcacgatcctgcaatgaatgcacgatggagtgtgggggtcgggagggggcttcgtctatgaaaagttgccaagtgtgactcccctgcatgatgttagccatgggtcctttctgcagggtcccctctgtgccagaaatgggttttcgggacttgccccagggaagccgtcaccggcccggcccatcatgtttttggattttttttttttttctttttttgagatggagtttcattcttgttacccaggctggagtgcagctgcatgatttcagctcaccgcaacctccgcctccccggttcaagcgattctcctgcctcagcctcccgagtagctgagactacaggcgtgtgccactacgcccggctaattgttgtatttttagtagagacggggtttcaccgtattggccaggccgctctcaaactcctgacctcgggatccgcccacctcggcctcccaaagtgctgggattacaggcatgagccaccgcgcccagtggtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggggaggcttctgaaagatgactgcgtcctcctctgcggcacggacgggagcaggtgcagccacatcttccagggcctgccggcatcacctgcggccacacctgagatggaccccacgcagccctgatcgcaggaggcctggccgccccgaccccctccacggggctggcctagaagcaagtagtagaataaaactagcctagtcctgtccctccggccccagtggagacaggcgtctaagaacccgtgccgagagggttcctggacggccgcccaggtcctccgtgcaggcccgtgaggcggggatccctgcttggctcacttcctgagctggtgactgccagggttcccacctcgccaaggctagagggctccgggtgtgtgtgcaggtgtcgggggagtgacctccactcctcaacctcgggcagctcccacaggccacagccgggctccccacccccggcacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacgagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagatgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccatc
